United States Patent 12,344,895 (LONG NON-CODING RNAS (LNCRNAS) FOR THE DIAGNOSIS AND THERAPEUTICS OF BRAIN DISORDERS, IN PARTICULAR COGNITIVE DISORDERS) - sequence listing, part 3

SEQ ID NO: 1305 - DNA, 3330 bp, Homo sapiens
aggagttagagaccagcctgtgcaacatagtgagaccttattctactaaaaaaataaaactagccaggagtggtggttgcgtgcctgtggttccagctacctaggaggctgaggtgagaggatcacttgaccccggggcttcgaggctgcagtgagccatgatcacaccactgcactccagcctgagccacagtgtgagacccccatctcacaaaaaaaggaaagcctagtattctatacaaccttaacctattttttttttttttttttttgagacggagtcttgctgtgttgcccaggctggagtgtagtggtgcgatcttggctcactgcaagctctgcctcccgggttcatgccattctcctgccgcagcctcctgagtagctgggactacaggtgtccactaccacggctggccaattttttgtatttttagtagagatgggttttcactgtgttagctaggatggtctcgatctcctgacctcgtgatctgcccgcctcggcctcccaaagtgctgggattacaggcgtgagccaccgcacctggccaaccttaacctatttttaaaaaagatgtttatggctttgctgatagcaggctggaaagctagctgaatttgcaggcaacctcaagtagttaatgaaaaattattgtggcttgtccaaagggattgagttttccaaataaaaaagtgggcttcagttttatgtcattgtaagaggccatgtgagggatgtttggatgctcgctttgaatctgtaggaccactcaatgattttttaaaaccattggtttctggcaggcaaaacattcaaaatctaggctatcccaggaaatctagcataagggctgtcctgcagtaatgcattaaaccacgtaacaaacgaactcaagaagagggatgtggctctggatttgtgaccctcaacataacatttaccaccttgggcttcggcttcaacatcagttaaatggagggacacagacgactctttggctcttatactctatgacatgatcactggccaccttagaaaatcaagcctatttagaccacggtttgtgagaagtcagactctctgaggctcagtttccttatctataaaaaagaagatgataacattgggagaagccatcttaagcagcgaggaaagaaaaggacagtggagtcaagtgaacagtctcagatctcagccccgtgtaatctaagggaaggttactggagctgggtctactttcgtcatctgcaaaatggggataagaatgcctgttgtaaggacagttgaatgatcttgctcatgccaacttacagaaggtacgaaataaacgccgatctcctttattctgatctcacattcagcaaatgtgagagaaatgtgaatgtactgaaatgtctgccagaaaaaagaaaatccaacccctcaaaagaatgacatcaggggttttgatatctattcacctacacttccctcttccacaggaagcggcccaccttctgacccacactgcccatctctgtgcttatcatggagctttcaagagtgaggatcggaggctgtattgagcagtgggcacaaaccacagggagcgctgttcaaaaatggaaaacaaggtggccctgacaccgggtgctgctggaaactttactgcgaagcagccctcatcttaaggtggctcaacaccacacctgagatctagcccatgcgacagtatggaagcaggaggccctactccaccacagaaagaacatttatgggcgcctaagccctgggagaatggcacctgagggaacagagcgtgcccacaagcagaccttggggagggagaagaggcagccctgctcctagtcgcagccagcgtgcgtcatgtccaggccccacaagggtgaccctggctcaggttctcatgctccagaagctggcccaggtggcagtgggttccctatggaggcagctcatcattcacaacacagcaacaaaccttctgctctcatgaggagaatgtattttaaacttgggaagagtcataattctgggatgtttcacatgttgtcagctttaaccttctacagacacaggccctctcctctgtgaggagggacctctggcatgtgtgggtgtgtggtgggtccctctccctattagcagaaatgtgttgggcatgagccaggtttatgatttggattgtgtcctgcacataacacctgtgagaatacaactgggactaggacaatgcgggaagcatattcttcatgaggcggtaaccaaaaggcttggctataccaaaggattctggtggccgggcacggtggctcacacctgtaatgccagcactttgggaggccaaggcgggtagatcacttgaggtccaggagttcgagcccagcctggccaacatggtgaaaccctgtctctactaaacatacaacaattagctgggcatggtggtgggtgcctgtaatcccagctactggggaggctgagacaggagaaatgcttgaacccgggaagcagaggttgcagtgagccgagattgcaccacagcactccagcctgggtgacagagcaagactccacctcaaaaaaaaaaaaccacaaaaaaacacaaaaggattctgggtgtaacaatctcagtagagccagcgggtgactctggttctcctaaaattctgcccttacttgccactcaccacacccccagatctgaagggccagcccttttctacctatgacacctcaccagcaagtaaagggcacaggacctcagaagtctgtggtgctaaggatgaagactctactcagagaaggtgctcagccctagtgaggaggttctgggaagcaggtgggcctgctcaatgcagtccctaacccttgggagcatccatgtgagaggtaaaggtgcaaatgacttgggcatgttgactccctactgaggaaggcagggcccctcacatctgcagtggccgtatgcatcagagaacggcatgactgcacatgtgagaactgggtgcacccgagcagtgtcaataggaatcccttccctattccatgccaaacagtcttccccagacacaaagtttccaggtcctgaggcttgactcttctaaggctcaaaatgggttctgtttccagacgtgcttgccttgcttgtctttgcttgtcttaaggactctatttcaggccaatacttgatcctcagacaaactgggacaggttgggaactttgatgttgagatcgccaatgttgatgttccgaggaatctctggcaggttgatgtttttcacagcagacacagcccgcgcaggggctgctgaaaggccaccct

SEQ ID NO: 1306 - DNA, 826 bp, Homo sapiens
ttttcttctgtgggaacaagacaaatggaaaagttccagagaattcaccctggaagtgaacattcccatcttctctgaaaacttacctgcaaatggcttttacagccttttcctgagaatgcagagatcagtactcccagaggtactgaaagaagacacgtttcactgctttctaaagaacttctgactgggcatgaaggagtgaaccaactgatcaggaaattgccagtcttcaaaaggcctcattgccagtggaaagaggagaaacagaaaaaaatgaccctgcagaaagcaaatgctctgatgattcatgcattatttgcaatttttttgaataagagctaaaaactaaacactacttgaggctgggaatttctctgggggaaagaataaagagttatttccctctcaggacaacacctaatatttgcacagcacgatgagcctgtgttccattgctgcacgtggtgagcctttgaactgagagtggctgagcgcagagtaaccctggtagcacccctgggccacctgaaactgatcgtgctgtcttctttggagtggctgcccctttaaaagaagacttaacccgggggactttatctggctctgtgattcagctggaaagagacctgagcaaggcccgggtagggttgcagagcaaaggggcggtttgtcctacagcctaaagaagacagaaccatgatgaagcggcatagttcgtctgcgtaatacctgaggtgcgttgcctcatgccaaggaaatcaaggacatggacacgcatggagtgagggctgcagtaagaaggaaaggaaaataagaagatggg

SEQ ID NO: 1307 - DNA, 991 bp, Homo sapiens
ggaaaggttgcagaagaatatataaaatgacttcaggtactttttttttttttttttttgagacagattctcgctctgtcatcctggccggagtgcagcgtcatgatctcggctcactgcaacctctgcctcctgggttcaagagattcttctgcctcagcctcccaagtagctcagattacaggcgcacgccaccacacccagctattttttgtatttttagtacagacggggtttcaccatgttgtccaggcaggtctcaaactcctgaccttgtgatctgtccacctcggcctcccaaagtgctgggattacaagcgtgaaccgccgtgcccagcctagtggtggcattatagatgcctgaggctggataatttgttattgtggggagctgtctcatacacactcttggatgttggggagcatctctggcctctacccactagaggccagtaacacccccacccccagagtgacaagcaaaaatgtccagggtaatggaaggggacaaacctgccactagttaaagaccactgcctagaagtatcattttatttaatttgaacttccttccctaagagacaagtactacccttactctattttaaaagatgaagaaacaggctcagacactcctgcccaagattctacagctaaaaagcagcagaacagaacagaaaagatcgaaaccccgtcccacactgaccttattcccaaacttgcctcagtacaagaatcaactgaggttgctgttcaacatacagattcttggacacaaccctagaattgctgaattttttaactttcaagcaagaagcctgggaatatgttgaacaagcaccccaggtgatttttagcaagtaaacttaaggatttaaacgtctatataaagctagattcagagggaacagacttttttttaagcaagggaaagagaacagtgcaagagtttgatccattactgctttcctttgaaattacaattcaccag

SEQ ID NO: 1308 - DNA, 619 bp, Homo sapiens
gcacggctcattttttaattttttgtagagatagggtcttgctatgggcctagaaattaaattttgtaaaatctttaataacatggggaaacttttttttttttttttggtagagacaggtctcactatgttgaccaggctggtctcaaactcctggtctcaagtgatcctcccccatcttggcctcccaaagtgctaagattacaggtgtgagccactatgcgcgcctagcctcaaagtataattttgaagggaacaaaactgtatgcaacatgatccgaattaggtaaacatataaatggttccatctagtaggaatggaaatacaccccaaagacgtgaacagcaagttgtgtctagaatgagggcagcgggtgagggagggaagcttcatatgtattttcagccgctccccattgctggcattagtgcctgagctccgcctcctgtcagatcagcaacggcattagattctcataggagcatgaaccccactatgaactacacatgtgagggatctacgttgcacactccttatgagaacctaatgcctggtgatctgttgctgtctcccatcacccccagatgggaccgtccagttgcagaaaaacaaactcag

SEQ ID NO: 1309 - DNA, 1035 bp, Homo sapiens
gcctggaccatgtctccatgggtgtgggggatagctcttctgaagaaagacttaggctcagtatttaggaaacctgaaatgaaagtgagcccacctctgtttaccttgtaggaagctgagctaagtgagcagctgaagatgaagggaagcccagaggttttgcaggtcaccagaaaagccctaattgaaggaggtactatacaaatttagaagaaatggtgcgtgattgtttacaaaaggttcctgaattttcagtgtttggcagaggaggagacatggagaaatactgaaactcctgctaaaggacaccccttcaaagggcaggcgctgtgctgggctctgggactcgtgggtgaactgcacagagctgggccctgccttcagggaaagaagacaataagcaaaacatacccaaagagatggttacaaagacagcgagcacccggaaggaaaatggaagctgccaggaaaggggctcctgggcctactcaccaggaagtccagtcctcaccagcccggaggcctggtctgcatcctcagcctcacagaagctcaaccagtcacttaaaacgagattgcagtgatgttttacaactctgtgaacgcactaatagccactgaattctacactaacgtgtgcattttatgacaggagtgctgcatctggatggcatggcagagggaagccccagctgccactgctccagggacccttatagttccacggtgatggggaacagaaagaggctcttccaggaaacagccttggggacaaggagaccacacttctgggtgattcgaagatcagacaaggctcctgtaaaatgaacgaatgaagtgaatgaatgagacggagttgcactgttagagatggtggcagcagtgtgaatcaaatgaagtccctgctctcccggttgtggccacgttagtccagcccagaagagtctccaggggcccgagcatctgtcctcacatcagaactagctttgggattgtgactttggggttgctttgttggcttccttttcctgtcag

SEQ ID NO: 1310 - DNA, 490 bp, Homo sapiens
ggggtctttaacagtattaagccatggtttcacagttacagtggtccaaagaactagaggccatgtaggtcaaacacagaaatggcgaacacatcccaaaccactcaactgtttagttccactggtgattttttttaacgggtagtgatttcaaatgatttggtgggtggttttttgttttgttttgttttttctttttcttcagagcaaacaaatgatttgctctttgttgcaggcagattccagccttcctgcttcttccagatgtgagctcctgtcctcagaaattcttgaagatttctaaacccttctgcggcacggtcgcggctgtgtcccagtcattctcggggtaagttccgaagttggaggtgtcgccttcgcgggctatcttgggcacgatgggaggcttcagttttctctgaggaacagcttcccagtccacagagcggaaccaccgatggcgtttcacatcattcgccccgttcttcat

SEQ ID NO: 1311 - DNA, 16007 bp, Homo sapiens
gtgaaattaaaaaagcaaatctaaatatatacatagattcaaagactcattgtagtaaaagtattaattctgtacaaattggtgtataagtttaacacaatacaaatcaaaattctagcaggtatttttgtagctataaacgtgaagattctaaaaattataaggaaaaacaaaaactagaatatccaaaataaagaagaataaaattaggtgaatatatctaatttattttatataagcctatagaagtaaagatagtgcaaaccagtaaaggagaagacacattaatcaactggacaaaatagagactccagaaatagacccacaaaatatacttaattaaatcttagaaaaggtacaaaatcaaaggagaaatgattttgttttcaacaactggtgttggaataattgcaaacacatttgccaaatcatatgctttacaaaaaaattaactcaaaatggatcatagatctaaatataaaacgtagaactgtaaagttttagaagaacacatgggtaaaatattcacgtccaaaggagttaaaataagaatttttggccatgacaccaaatgcacaatctcacctccccaaaaaggtttaatttgacttaacaaaattgttaataaattatatgtgaaggtctctattaaaagaaagaaaatacaagaatctgtaaagaaatatttgtaaaccactcttgacaaatgttcagtatctagaatatattttgaactctcaaaacataaaagtaagaaagcaaacaaactatcttaataatgggaaaaagacttgaatagtcacttcacttagagtatattcatactcctttcttattgggtcctgagtggggggaaaagaagagaagaggatattcatcaggcaaaaacctaaaaaagaaacaaaaaaccgtgaaaaggtatttaacatcattagctattcagcaagtgcaaatgaaaactaggatggaataccattaaacacctagtagaggcataagataaaaaaaattgacaagacttagtgctgtggaggattcagagaaactggatttctcctgtactgctggtaggaacatagaacaatgcagacattcttaaaacattttgacagtccgttacaaagttaagtatatgcttatcatagagcctagcaatcctactcctgggttccttacccaaagatattgtatatttataaaaaacatgtacatgtctgtgtatagcaactctaccatagccccctagaaacaagccatatgtcttcaaatagatgaatttgaagcattacatgtacacgtggaatactactgaacaataaaaaggagcaactattgatatatgtgacaacttggatctatttcaaaagcattatgctaagagaaggaagccagtctcaaacgatgacatagtgtataaatccattcctatgacatctgcaagaaagaaagctgtaggtttggggagaaaagatcaggggctgccagggattaggggttggggggagggtagttgcaaatgaatagcacaagagagtttttggggtgatggaactcttctgcttcctaattgcacagccgttataagaatctgtaaattatgttaacatttatgaaattgtacatccaaactttcaaatttatggtatattaattccaaataaatgcaagcccatagattatatgaggataaagtctctgcatatttttgttgttatatctccagcccatagcatcattcctggcaaacattacacatttaaaaatatttgtggatggaataaatgaaaaagtgtagaattaccattgttattattatttatttattattttttgagacagcggcttcctctcttgcccaggctggagtacagtggtgccaatacagctcactgtaaccttgacctcctgggctcaggtgatcctcctgccttagcttcctgagtagctgagactacaggtgcacctcaacataattggctaattcttttaattttagtagagatggggttttgacatattgtccaggttggtctcaaattcctggcctcaagcaatcctcctgcctcaacttctcagagtgctgggactggaggagtgagccaccccacctggcaaaaattatcttttaaaagccatatgttaggagctagtttaggggaaatatggtgactacttggacatatatatttatattgtatgatgatactttacagctatagattactaataatttataaagtacattgttttatatttagaatttgcaatataagaagaagggttttgcacgagggtggggctgtggtcatttgatccagtttctgttttaagaacatgccacagtctgcagtggagaagagaaaggagagagggaaagtggaatctctaagttgtattaatgctacatcagtgactattcttctacataggtctttgtgcatatgatgtctatttaattctaaaaatggaattactaggtcaaaggttatgtatatttagaaatattacacatatattacatgaccctcccaaatgcccagtgttttatacttttaccaagtctcaggagagttttcaacgaacttgtacataaaataaaagctggtggcatggtggctcacatctgtaatgacagcacttcgggaggccaaggcaggaggactgcttgatctcaggagttgaagactagcctgggcaaaaatattttttaaaaaattgccaggtgtagtggtgtgtgcctttggttctagctactcaggagactgaggtgggaggatcccttgagttcaggaggttgaggctgcagtaagccaagatcacagcactgcacgctagcccaggtgacagaatgaaactctgtcataaataaatagataaagctgatacagtatctgtaatttgaaatatgtactgtacacttctgaaccaaccatcctccctcccttcctcgctccccctcccctcccctcccctcccctccttccttccctctctccctccctccctccctcccttccttccttccttccttcctgtaataagttgtgagttttctcataatgtcttcaccaatagggcaacacatgatagccctcatttcacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgacaaataaatatttcaccagccagtgacagcgttatgagctaattaaaatctgagccctggaagaagtggtgccattagctcaattcacaggactggaaagtatgtgtctgctcacggactgagaggtagacatttacatatgggaaggagggggccggcttattaagagcaacattgaggtttggatgaagagagcactctgtcaaagctgagatatttaaagaaaagccaaaatgacaatatgagaggtttcttttgcccttgggaagaaagaggtaacactgcatggtggtgttaagtgtaagggcttgggggacgggccacactgtcttgagttcagatcccagatctgccatttagcagagatagaactttggggttgtcgttcagcctttctaacctgcagcatcctcatttgtgcagtgggcatagaaatccacatagtggcaagggtataaaatcagatactacttttagatcctcagcagagtgccaggcaaatcaatagatggttgataccttgtcactagcgtcaactcttgtatccacaagaagtcatgtttaaacgtccagttttctgttaaaaatttcaaacctgtcggatgctaagcagttttctagtttgaagtttgttccttcagaaaatatggttaacacacattttttgataacttatgatgtgccaagtcatggatggttctaagcattttacggtcaacatctcatttcatcatcgcaataatatagaagatggatatcgttaactctacagaggaagctgaggaacagcagcaatgagttatttgctctaaaatttaacactttttttttttagacagatgcctaaactccctttgtttcacacaactatgcaaattgtgaggccaaggatatgactgcaaacgattaaggtttaatttacatgaatagccaggcgaagtgcctcacacctgtaatcccagcactttgggaggctgcggtgggtggattacctgaggtcaggagttcaagaccatcctggccaacatggcaaaactccatctctactaaaaatacaaaaattacctgtgcgtggtggcacacacccgtaatcccagctgctcgggaggctgaggcaggagaatcacttgaacctgggaggcggaggttgcagtgagctgagatcgcaccattgcactgcagcatgggcgacagagccggactccatctccccccaccaaaagaataaaaaataaaaaagtttacatgaatgagctttcttccccatgaaaataactgtgtcacttctcccttggtctaacccacacaaaatccccaccctgtctggcacagatacacttaacatgcaatattaagtacaatttccattttatttttctccagagtatcgtgtgtcttcagtcttgaaggactcagctccttacatgggctttggtgggggtcatggggcagcacccgcaggtctaaatcgaggtgggggtttttggtccctgtggggttcacaagatcaattcctgactactttactgtgaactgtgcagctcacacagtaacgtggcttcacatacagcttgggaagcacaaaggcatcgaagacgcttgcttcagaaacatccctgactgctgtggcctctactatgttttgaatacaaatttcttaatggccttgtctttgggcacgcgctgggcacagttcgtgcagcaaataggctgcatgtggctgcagccctttttggcatgactgttgttcttccttttcttagtcatcttggaggcaaggaccggagatcctaagttgttcttttaaatatatatgtatatatatataatattcgtctgggtacattggctcacgcctgtaatcccagcatttcgagaggctgaggcgggcagatcacctgaggttgggagtttgagatcagccaaagattttcttttagcctggccaatacggtgaaacctcatctctactaaacatacaaaaaaatgagctggatgtggtggcaggcacctgtaatcccagctacttgggaggctgaggcaggagaatagcttaaacccgggaggcagaggttgcagtgagccaagatcgcgccactacactgcagcctgggcgtgacagagcgagaatccgtctcaaaaaaaaaaaaaaaaaaattattgcagacctaagagaaaatctggttggtccttcctagaccccttttgtttaaacagctatgactgaggggagcacttcatgtggtcataaatggtggctggtgttctacccctgactgtgattataatttcagagaaagaaaagtctctgtgaactagccacaaatgcctccgaaagcataaaatcgttattcagcattctccatactttcctgtatccatggtgttgtcagcaatatgtaatattatccatagtacttatgatactgtgtttgcttggtctcaagagagaaggttaaaagtaacaatctcaggtctggttataagcattttgtaaataataacttatttgatacttattatcaccctatgcacttagccactattatccccatcttatatatactgttatgtcaaggtagggagaaataaatatgttaagaaataaatagagcagtttttgatgacagggatttacttacaggtcttttggtatatggtgtgtactgtatgtgtatgcacgagcgtgcatgtgtgtggggaatgtgtacattctgtatcatggtgtgaataagttgagagtgagagtcgggagtaagggagatgacaattgtgtggtgatgatttcaagttaagagtataaatgtggaatgaatgagtttctttcagaggactttgggttgtatatgcttcaaaacgagcttttatcttctgcattcttcctcatagccccgtggaggcaggctgaagccttggcacatcttggtaggatgacctgactgagagcaaaggtcgtttgcaagcatataaggactttattaagcagcatattaatcaggcactgttggttgcaagcaacagagtcacaatgcacctggtcttttgtttagaagagggagttcattggcttacacaactgcaaaggtccgaaagaggctgggttcagatgcacaaatacacggtttgaaatctggttctttgctgtttcttggctcagcttttcagtcttgacatcgtcctctggcaaattcttccttaatgggggctcaagtgatgcagcagctccaggcttactttctatgaaatggacagccctggtgaaaagcaaatgtctccttcctaaccattctgacaagaacaataaaatcctcaaagattttctttcaaagaataatagcatgtattaagtgccagacactaagtcctttttgtatatgaactctgttatttccttgaatcctcacaataattctgcaagataggtactatacttaaccccattttaatatggtaaaacttagttacagaacagttctgtcacttagctattgctgtgtaatgagctagtccaaagcctagtggcttgaaagagtgaccatgagtctgataaattggcaaaccaagagagcctgaatcctccagggtgacatcagcggggatagttcggttctgtacgtgtgtgtctctgatatccccagcaagctagcctggttcacttagtgaggtagagatacagcagtgagctggcacaattgtacatgcagaaggggcaaaggtactcaaagcctggagaggctcatgctaggaactgacacattctcatttctaccctattgttaccagaatatgttacaagtccagtttggattcagagggtggggaactaaactctaccacttgatgggaggatgttcatggtcatatcacaaagggctagaactggggaagaatcggaggctattttggtaatctgtctgacataatggtaacttttttttctttttactttttttttttttttttttttaagacggagtctcactttgtcgccaggctggagtgcagtggtgcaatctcggctcactgcaacctccgcctcctgggttcaagccattctcctgcctcaacctcccaagtagctgggactacaggtgcatgacaccacgcccagttaatttttgtatttttagtagagatgaggtttcaccatgttggccaggatggtcttgacaccttaacctcgtgatccgcccacctcagcctcccaaagtgctgggattacaggtgtgagccacggcacgcagtcataaaggcaatcctggggtgccatcaagaagagatgatgaggcgacagtgacacagcaatgactgccttcagttttatcatcagtcctggatagagaaggtgcaccacctataagtgaaggtgatcagtttttccatttccaaagagatgggtatcttaaaagttagaaatttgtgactttgaattgcctttttaatcataagaatcatagcttctggccgggcatggtggatcatgcctgtaatcccagcattttgggaagccaaggcgggcagatcacatgaggccaggagttcgaaacaagcctggtcaacatggtgaaaccacatctctactaaaaatacaaaaagttagccaggtgtggtatcgcacacctgtagtctcagctactctggaggctgaggcaggagaattgcttcgacctgggaagcggaggttgcagtgagccaagaccacaccattgcactgcagcgtgggcattgcagcgagactgtctttttttttttttttttttttttaaaaaaaaaaaaaaagaatcataggttctgcttagtcagtgcctacttatgttttaagttatagttggccactttacatctcttgcttctgctccggtaggtttcataatctccattttatagttgagggaatgagtacctgaaaggatggaataaactcaccataatcaacctagctggcaagtgattggaactgaggtttgaaccatgttcatttgactctgaacactgcagtctttcctgaataccatccctcaagcagagagttgggcccagatgagataggcagagcttccttagcataaagtcaatattgtctttttgccagacagtaagccaagcataaccgcatacatctgaccagaggctcttgtacaaattggccactcaggttctctgaaggagcttgatttggggcctgtgaatagtcctgtgaatattgggatacatgagattaatttttccctacatctaaacatccaaatggcttaacttccagaggggcacatcttagcttctagggggtgagaggcttcccagtatcttaaagaagtggttcttaatctcactggcaagttagaatcacctggagaactttaaaaaacattgatgactagagtcctttttttctttctttttttttttttttttgagtgtcattctgttacccagactagagcgaagtggcacaatatcaggtcactgcaacctctgccgcccgggctgaagcaattctcctgactcaggctggaattacaggcaccttccaccatgcccagctaatttttgtattgttaatggagatggggttttcccatgtcagccaggctggcctcaaactcctgacttcgactgatctgcctgtctcggcctcccaaagtgctgggattacagtcatgagataccctgtccggccagagtccaagttcatcattgcaatgttctttatctgtatatatttttaattgaactcctatgttcactgcagcattatttataatagctgagagatggaagcaacctaaaggtccattgatgggtgaaaggttgaagaaattgtgatacacagacacacacacacacacacacacacacacacacacacacacacacacacagtcactttatcttgaataacataagacaaatgtattcaggtataagtattaattcatggtgccttgcataatggtgagaggcacacatgtttatgaaggcagaagtaaactatttgtaaagctgaaaaaaaaaaaccacacacacacaatggaatagtattcagccctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaattaattgtttatttaataagtggtatttttctgagttctgcttatagtttctttagacgtagaataacacatcattaagaaaaataataattgatctgccatgaaaaaaaaagaatgactgacacagcttctttgctgtcagcccttttgtactccaaaacgtaatgcccattttgaaatatcatggctaatccaaaaaatatacagctaaacagaaaaacaacatcagttccaaatatgaatacatgatctgctacttaatatgtcagggtatttgtcaggttgataacattaggctctgcggcattcaattctaagccttgcaatatttgaagtgtgatactgtgcttcagtaaatttaatacgtgggcctcagtaatggagggaatcacgttagcacttggcagtttgttatgctgtataaaattgactgccctgcaaatacaatagcgatcataaaaacggtggtcagcagagaggggtgtaatgcatttttgaggtttcagtaaaggtccagatgaaatttattgagatttttgccatttggatggtgatcaatagagctgtgctaataatttgttgtgaggatgttctctggggatatgacattttgctgtgaaactttggaaattcagaaagtagactaagtgatgatactgctccagtatatataaccgtcaaagactttaacatcgctctgggagaggatttatagtgatggtgattacttcttcaggcattgaggatgtgatgcatccaattattgatatgttttcatgcattttccagtttggactcacagtcatttgatcgtattgctgtttcagcccagagttttgtgataggtttgtttttaatttcattcacagtttccaaattgctagcctattttcttaattatatcattgatttcccctgcctcctctcccttcaccctgcccacatccagaaaatgatcgttgaagaaaagaattccgtcagctttcattcacatcaacagaggctacttagaaatcctgactgtgaaaactacttttgttgtgttgtagttgctgttgctgctgctgtagatggcttgtgtgctgtaccgaatttgcaaacaggcttctgagttaatgttaaaggagtacatagcatgcagataatgtttgtgatggttacagttttaatgcacatatgtcagtggacctgttaaatcactgtgaggcagcattctttggctttatggtggttgccgttgaatttatcttttttttttttcaattttgattagccgcgttccaagagagagagatgaattatccaatctttgcaaagtgggattccacactgacaatacagagatatcattctgagaaaaataaaataaaacaaaataaagaaggttttaaaacttcacatttggtaaaactgacttatcctgaggctgtttttatgtctgttctgtatgttagaaaaggaatttctgagttcgtgtttatttccctgttacattgttctgtttcctcagtgtatttcatgaacctgaccaattaagtttcagccctgtctaggaatttttttgttgttgctgttggattaaagcaactaagtaactctgcagtggacagaggcttagagagactccacattatttgtttgcaagaggaaatttgtcagcactttgcagaaagaacactgagactaggcacagcagaacaatttattttcaatgagcatgcacaaagtaagatttatgactttgcatcttcgatgacatttcttacattgttaccaagctacagcaaattaaagggatccgtgaatactaaggggtgtgtttttgtaatgaggaaaaagagacagagcaataagaagataattaaggtaacaacttgtgaaaaattaaagtgtttccatctttcatttttgaatctctgagcataaactttgtagttgttaatttaattgccgctgttcgcggcatccctgaagaatattgaggattaatcgtctggttcattccaacaagagataaggcctaagtgaattgaaattttaccaatttaaccctgtcttcctcctaatatgacatgattaacatttttcaattaaccacatgtaattattctgaaggcctcattccacttatttctagtctttttgactgcagattggccttttcaggtagtttggatctagaataattcaaagaaagctctgtttgttctattttgcatctggcacacaggttcatctgcattgtctttggagttgccatttcatcggaaaataaagatccataacagttgcattcatttttgcctaggtgctcttcctgtaaagcacagtgctgctcattgaagcctgaaggagtaatgtggtattgttggagcatatttgtaactgagcagagtgaaagactaaacaccttgcaggcaagaatgtcaaaggaagagattggctggaaatggttttccacagtaaatggaaagacctcaagattcgggagagtttggcatttccaaggaacagaataaaggctagttctttgtgttcgtccatatggtagccagtaatcacagtggatattgaaatgtaaattaattaaagtttaatgaaatcaacagttcagtttgtctcatattagccacatctcaagtgtccaatgacccccctgtgactagtagctgtcatattggagccaatacctagtagagatacagaacatctctatcatcttgggattttttttttttttttttttttgacagggtcttgttctgttatccaggctggagggcagtggtgcaatgatggtgcaatacagccttaaactcctgggctaaagtgattttctaacctcatccgctcgagtagctgggattacaggtgcacgccaccacacctagctaattaatttgtttgtttgtttgttgtgtagaggctgggtctcataatgttgcccaggctgatcttgaactcctggcctcaaacaatcctcctgccttggcctcccaaagtgttgggattacgggtgtgagtcacttcacctggccccatctagggaaaattatcggatagtgctaggccagagcacagtcatcaggtggatagtggttagtattaaccagggcattctaaattctgatatggcaacaaaaatctctgtaccagaggggttaatgctacatgggtttatttctctcatacacaaaatctactgcatgcctgggcaggaaggaggcatctagaagtttgcgctggggccctttcattcctcgtcatggcccatgggccaggactggatgcccatgccctgcctccctgcaacaggacttttatttcagtcttttgtttgccaactggacactaagttcctatttgtatcaccaaacactattattatttctattctataaaggagaaactgaggcccagagaagttagatagtctaaaataaatacctaaagaatgatgcagtgggtttctaggtacatctgagtccagctgcaaagtctaatctttactgagctagctggactcttctggtgcacactaggaagtcatcagaggctttccagctttagaaaacctattctgaccagcacaggtgatacggtttggctgtgtccccagccaaatgtcatcttgaactgtagctcctgtaattcccacatgttgtgggagggaactggtgggagataatcgaattgtgggggtagtttcccccatactgttctcgtggtagcgagtaagtctgatgagatctgatggttttataaggggaaaccccttcacttggttgtcattctctctcttgcccgctgccaatgtaaggagtacctttcaccttccgccatgattgtgaggcttccccagccacgtggaactgtgagtccattaaacctccttttctttatacattacccagtctcaggtatgtctttatcagcagcctgaaaacggactaatacaaaaggaaacttagaagggaacctcagattaggggcaagctccttggttagaagcctgatacgtgacaacagcaacttaactcaaaggaataatggtggtaaactcgaacacataacattatgcaacagtccctacctggtcctggagtagaaactccaaaaggggaaggttgtagttcatctgcaaatgtatgtgcacaggctcactacatgttttggctgatttttattgagcatctgtgatttgccagatattgttttaactttttagcttgatgtacattagctaattaaatactcaatatttcagtgagttagcctctattttcatggttttacagatgagaaaatgcacgtagagagaggttaggtaacttgcccgaggtgacacagcagaggagctggaattttagtcaccatcttaagaatgaagcaatgtttggagagaatggtgactcagagattcgtatcacagccaaatcatacagaaagcgctgttgactcaaatagggtaaacagataatgcaaatccaaagctttgggtgtgaggatcagatggggcaatgaggatggcgaaaggaatacctgaagtcatgagagatggtaagattgctgagagggtgcagatataaagggagaaaaataagaggccacacatgagatcttcagcaacatgactcattaaataagaccaagggtttcagtgttaaacggacttctgtaaatcttggctttggcactatgtcacatgggcaagtcatgtaactttctgggacaagatttccttattggcaacgtggaggcaaggatgctcaaagcaccagacccaaccaggacaaagaagagaatgagcatgcacatctctgcccacaaactcagtcttggaataagaagcacagttttgtgttattgtgaaacaacgttaattttatcctcatccccacttttccttcatggccaggaaatgtaaccccccattatgcaaaagataataattctcacctggggcctacaaaggtgaaggggatggggaggacctgcctaatcatctaccttcatcatctcccagatatataggctgcatttctgcaggccgtatgcttgagacttgaatatttcactaaaacaaggaacacacatccatttccctttggagagctctgctgctggataaactcagactttttttataagatggagtctggctctgctgcctagcctggagtgcaatggtgtgatttaggctcagtgcaagctccgcctcccgggttcaagtaattcttgtgcctcagcctcccaagtagctaagattacagcctcctaccacctagttaatttttatatttttagtagagacaggtttttaccattttgagcaggctggtctcaaactcctggccccaagtgatctgccttccttgccctcccaaagtgctgggattacaggcatgagccaccatgcatggtcaacttacagattttgatattcttaccagtgtctggacatctcttttataatgcagatgaaatcaatctctctctgtgtgtgtgtgtgtgtgtgtatgtgtgtgtgtttgtgtgtgtgtgtgtctgctcctcctctcttctctttctttttctattttcattatagctactctgtcactcccc

SEQ ID NO: 1312 - DNA, 651 bp, Homo sapiens
gtggatttggacagccaagccctacctcgcaggacaagcgtagcgagcagcgtcattgttgccaggctgggccgagggaagcaggaaggctccccaccgaggacagaggtgaagtgcgggggtggacatgactcggaaacaccaacgtccaccagcgtgaaaccctgaaatccctggaaacaggatcacagcactagctcccgggccaggctgggcgtggcgtagatggaagatggtaaagaagccagctagaaaggcaggaacgcagcgtgacggtgccatacccagagggcctgcctgggcagcccccagaggccttcaaagctacactggagagcttggccgagggaccaatggcaatggcacacactgaagtgttttacacaaaaaaaaccgcctggctggatgtggctggcaagaagatggccggagctgcaggtgacgagtgatcaagaggagcccatggcagtggggacaggtcacagctgaagtgggtgacctgcaacatgttcagcagacggagtctggctctgtcggctaggctggagtgtagtggcatgatttcggctcactgccacctccacctcccaggttcaagcgattctcctgcctcagcctcctgagtagctgggattacaggcaagtaccacc

SEQ ID NO: 1313 - DNA, 434 bp, Homo sapiens
ccccgaagttttagtcttgaagtttaggctggaaaattagtacctgtgcagacagctaaaagagagacttagcaatgcctagcttcctgccaggatcccaggtgggtgtctttcgagatttcctggttcttctcctgtccaaattccctcagcactaccaaagtgtattcttcagtcaatctctaactgtccacgtgctgtttcattcattcattcaacaaatactttgcgagtgcctcccatgtatcagacactgttcgaggcactgcagacaaatacagtaagtgaatgaaatagataaaaatccctgcctcatgggcttacattcttctgaacccactttaaaacatatgccccggccaggcgcggtggctcacacctgtaatcccagcactctgggaggctgaggtgggtggatcgcctgaggtcaggag

SEQ ID NO: 1314 - DNA, 454 bp, Homo sapiens
cagaagttgactaagacacacatcatgaaaaatgcaagatgtgcctttcttccccttccccttctgccacaattgtaagtttcctgaggcctcctagtcatgcttcctgttaagcctacagaattgtgagtgaaacctcctttgtttataaattatccagtctcaggtatgtctttacagcagtgtgagaacagactaatacgacaacacacggatcagactcggacaaccaagaattatccaccccaaaataccaataatgctgggaatgagaaaccctaatctagatcagtggtctacaaactttttctggagagagcaagagagtaaatatttcagggtttgctacttacagcaaaaggaacgatggataacatatacatgaatgatcaaggctgtgtctcaacaaaaccatatttacaaaaacaggcagcatcctgaaattggctcacag

SEQ ID NO: 1315 - DNA, 321 bp, Homo sapiens
gtccctctcctgagtatgtattcagaggaattgaaacaaggatcttgaagagatatctgccctcccacggtaattgcagcattacctcaatagccaagacacagaagcaacctaaatgtccatggatggatgaatggatgaataaaatgtggtctgtttttgtgagaaggtggccaagaggaatcaccatccaaggcacaagtacttggagccacaggaccttttaaacacttctgctgtgagtgtttggcatgatttagcggagttggtaatatacttattcaataacccagcaactagagtcttaaatatttatcccag

SEQ ID NO: 1316 - DNA, 1366 bp, Homo sapiens
atgatgtctggcaaggagccgctgaaaagtacaggcatgggataagaaaacagccatcactgttcactttttcccttttccttttgatacgacttctgcaaaagaggtgtgaatgaaatcataaagctgtttggcatttgcagcattccccagaatactcgtgagctcgtcttgtgacagggctgctaattctgcgatgttcttaacgtggtgcatcaaggagcggcagtttttggcattcacccctggcatttttaacaagaagtcttggggaccaggattatacttctctgactcgggaagggtttcagaatctgctgtaatggccagtgctgtcgccgcatcaggctgtggcttgctttgtttcagctcctcaaacaactccgccgttgcatgaggagaggggcaccagagaatccgtagtctggggaagtgaagtgtaagaagagtgagtttggaactaatgtcattgctggagatctcctgaaacaaggcacctcgggaagtgagagagaaaggcttgctagggtcaaactcaatcagaagcacgggacgcttgtagtagcgggacatggagatgcactggctgtagaggcggccgttatttaaagagccgattaaatcactgatactcttgcgctccacgcacatttctggagtgaggatgtaatctccaacctctaaagtcacgggttcaatgtcaatgccccgacgatggatcagagatggaagctcacttcgaaattcacgcatatccacaactatgctttgctgtgtaccattctgttcctggccacctacagagaaaaagtatgacagaaaagatatataagctgagtctcttccctgcttgggttcacaactgatgtcgagggaacaaagcaaacatgagaagaaaaaaaaaaacaactggaactgaggaactgcgataaaacagactaaggtgaggggaacagaagaggaaccatcaatgttaattaatttcaacaagggttaaaacaaccaagattttcccattgatatggtctggctgggtccccacgcaaatctcatcttgaattaatagttccgataatccccatgtgtcctggaagggacctggtgggaagtgattgagtcatgggggtggtttcccccatgttattctcatgatagtgagtgagttctcacgagatctgatggttttagaagtgtctggcatttgtcctgctggcactcattctctctcctgctgccatgtgaagaaggacaagtttgcttccccttctgccatgattgtaagtttcccaaggcctccccagccatgtgaaacttgtgaatcaactaaacctcttttctttataaattaccaagtctggggtatttc

SEQ ID NO: 1317 - DNA, 671 bp, Homo sapiens
cttgtgattcacagacaatcgtagtcttgttttgatcctcttcaaaaggtggtttataatcagctgtagaacttaggtgctcttaaatgcatatttccaatatctttagattgtgatattagaataaaggaaaaacattcaggactcatgaagagctgaaatattcatgaatatcaagcagagcaagagttaactgaatgggctgaactaatagaagacatgtaatctgtttaactttttgcttaaaactttgctgatgttttgtttttcagagtcaagaaaacttttattttgagctatttacagcttttaacaattgagtaaggtatactcctgtgaacaaaatttggagtgtatttgttcctctgctggtttctctagaattcagaaactattttgatctctggctgaagctcagaagaaacaagggatggttaatatagaaatctggatctggatcaatattctagaggaggcggaggttgccgtgagttgagatcatgccattttactccagcctgggcaacaagagtgaaactccatcccaaaaaaaaagaaaaaaagaaaacatgttcaaaccaatccttgtacatgaatgctcataataactaaaagtggaaacaactcatgtccatcaactgatgaacaaaatggcaatatacccaaacaag

SEQ ID NO: 1318 - DNA, 2993 bp, Homo sapiens
tattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaagggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatctgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctcagggtggaagcggcccccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgcctgagggtggagctgagggtggaaggggagtgagctgacgctcggaaggtgtcttgagattatcatccgctgagggtggaagcggcccccgcagacgctcggcaggtgtattgatattatcatctgctgagggtggaagggcatgatatgacgctcggaaggtgtcttgagattatcatccgctgagggtggaagcggcccccgcagacgctcggcaggtgtcttgatattatcatctgctgagggtggagctgagggtggaaggggagtacggacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagtagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctga

SEQ ID NO: 1319 - DNA, 790 bp, Homo sapiens
gtgtcactctgtcgcccaggctagagtgcagtggtgcaatctcggctcactgccagctccacctcctgggttcacgccattctcctgcctcagcctcccgagtagctgggattgcaggtgcccgccaccacggccagctaatttttgtatttttaacagatggggttttgccatattggccaggctgaccttgaactcctgacctcaagtgatccgtccgcctcagcctcccaaagtgctgggattacaggcgtgagccactatgccagccaagaatttttaaaaaaggagtttcattcagcccacctcattcctctgcagggcacctgtgtgcagggcaaaactgctcaaccctactcagaagccctgtgaaagctgctgaaaggatgagcagattgaggcctgaactgtatcttggatttagcagcctggaggtcataatggattttgccaagagtgatggggcagaaattggaccagtgtgtgttaaggagctagaagaagtgaagaaatgggagaggggaatctagacaactttagtttggctgcagcaagtaaaggcagattgtttgatggagggacgtgtgggattgatggagtttttcctttttatatgtttttgtatttttcaatggaatacattagaaagtgttgcatgtttatgggggggatttagttcagtgggaaaagtatttgaaaagctacagtaaggtggaagtagatggaatcctcagtaaggtctagaatcgggtacaggtattttatggtatcttcctcaccccaccccgag

SEQ ID NO: 1320 - DNA, 2629 bp, Homo sapiens
tattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaagggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatctgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatctgctgagggtggaagcggcccccgcagacgctcggcaggtgtcttgatattatcatctgctgagggtggagctgagggtggaaggggagtgagctgacgctcggaaggtgtcttgagattatcatccgctcagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagcagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctga

SEQ ID NO: 1321 - DNA, 492 bp, Homo sapiens
ctcctatttgtctggccctggggatggtggagcgaagaagaaaaactgaatcttggctctcatggagaggatgggggagagcgttagcaccagcaacagtgacctcacacagtgagggcactgggaaggaaataaaagaggcaacacagagtgatagtgacacaggagagtggactggaaaggccgtcctgaggaggagacatttggctcagccgtgaatggcacctgagtcccggagctctggtggttttgcccagggccagccaggagacacagtgtggtagtgtgctcctcaaggcatctgtgacctgctctcctcagctcagagaaagccagcgtggcgtttgagggaacaacctcagctccaaagggaacgctgacaaagggggcagtccagccctgggcagggtcagaccccagcacccacaaacaccaggcaggcccaggctaggatcacaggagcgggagtaggagtgatggagtaacagctcg

SEQ ID NO: 1322 - DNA, 203 bp, Homo sapiens
tataaactcttttgcatatagacacaccttgttttattgcatcttgctttattgcttttggcagatactgtgttttttaccagttgaaagtttgtggcaaccccgcattgaggaactctatcgacaccatttttccaacggcataacttgccacagccaccccaatgttccacaaccaccaccctgatctgatcagtcagcag

SEQ ID NO: 1323 - DNA, 1312 bp, Homo sapiens
ccccttttgtcctgattattcaatgagcagactagaaaagcctaatacctttctggggacagctacgttttaataatccacctaccttactaagctgtgtgtgctgggagaaaagtgagggaagtagagtcaggctgtcagtccactgttgcaagctgcaactaatcccaaaagctgaatgcaacaagtcaacagcagtgagagaagccccagagaaggtttgagtctggtctgtcaaaagcaggaggagaggtcatagtccttgcgatgtgcccttccccagcttggagcgtttggcaaatattagaagttaggaatgcaattagcctctgtattagagacaaagagcctatcagcagcttgatcttagatggtcccattagagaataagcccttttcagccaggttccaggacgttttcatagtttagcgctccacggagggggtccttaatctccaacggccccaacgtctgagtcctggtcattgagcctgtgcctgctttcagttcagcatagctcgtgttgaggctaaaacagctcaaggcagacagtagcaggtttcagcttagagtcagggccaggcaattaggatctgagaatttgagattctcaacaagcagctgcttttcttcagcagcagtgaaggcatgctgcatggccagacagctgtggtccaagtgacatgcaagatgatgtgcctatttcctaaggttcttataatgagattctgcaaggacagcactccaaatagtacaggcacatggttttgacagttgtttctgttattattgaaataaaaagaacctatacctgttcccaggaagctcagagtctctcacaggccttttcagttcctggggctctcatatttcctcattctcccagactcctctgaccctactcttcctcaggttcttactgctcctgtgggaaatcagaaagagcagccagcagacaacaccaactgagatgaatgcagctgaaatggcacaggtcagtatggccaagaaacaccatgggctaatgttcagacccatggtatgaaagccagagtgggtgtgaatttcactcccatgtctcttatcttggatggttttcatctgcatgacccatttgcccaatgcccaatggatgtgaagatacagaaaagtccaggtactgttttcagggaagtaagatgtcctgtgccaactcttctcacttcagggtccaagtcagagtgcacaaggaaagcaggtggggctggcccaccagcaaaagcttcaggagagcaagggattggctgactgggctgcaagggtagtgttcaa

SEQ ID NO: 1324 - DNA, 718 bp, Homo sapiens
gtaagaggatgttagacctttaggatctgggctttggctgggtgatttgggggagggtccaggggtttgctctggatcgagtgctgataggaggtaggaaaattctatcatccggtagcggtatcttttctagaaagaggtttggctggagtagggctaaagctacaatgtgtaaagaagccacagtcactcctatcagctgggagaagggaatgtctggtattctgtgggtggcacagtgaccttgcttttgtccttacacagaatgatgacgtggtctcgtgtcatctcctatcatcaccactgcagagtgtccttgtgtgagtggtctgcatgattgtttatgtccaataggagaacaacatggccttgttgtgggcaccagccagcttccaaaaacatacggcctggctcacagcaccaggcaagctcctagaagtcagttttgcttttctgtttttcacagtggaggaggtgagccttaaagagatcgataagggtttgcccggcagaagaaaacagcgtgagcagaggcatggagtctgcagtagaactgcatgttaggtgaacctgatatagggtcaggaggggtagcaggagagatttctggacaggctttcacacagtgaatcgtggaagctcccccaaatcacccagccaaagcccaaattataaagatctaacatcctcttactgatatgctcctcatggtgtgagt

SEQ ID NO: 1325 - DNA, 232 bp, Homo sapiens
aggtaacctggatcccaaaatgagaacagaagaaccacttcatgtgacttgaaccagatctgaaatctgaagtgaagcccagaagagtgtagctgaagacaagtgaacctacttgaccagcaaacgcacatatcaaagggccccctggctactaaggaagatgaatgaagaaagggcccatacatggacacctacttcatagtaaaatctgaggacatgaagtataaagagg

SEQ ID NO: 1326 - DNA, 1621 bp, Homo sapiens
ggaccactgggttaaggagaactcttcaggtccctgatagtgtgcttttttcttcagcacttgttccttcatatttggagggtgggtgggggaagaagctgaggtgtgtgttcccccaggattactttttttttttgttcttttgagacagggtctttctctgtcacccaggctggagtgcagtggtgcgatctcagctcactgcaacctccacctcccaggttcaagtggttctcctgcctcagcctcccaagtagctgggactacaggcgtgcaccaccacccctgactaatttttatatttttagtagagaaaggatttccctatgttggtcaggctggtcttgaactcctggcctcaagtgatctgccctcctttgcctcctaaagggctgggattacaggcgtgaaccactgcacccagcccacaggattacttttaataacagcatcgtgttttcttagaaagggacctgcaattcaagccccagcttcttctttacacttagttttgcacctgctatgtttaggaaagattcccagaaatatgtgccaagtggccataattgtgcattccagaaaaggggatttctttagcccagggaactctttctattcagggatgctcttacacgttgtgttttctgcttcttgatttccctcaggacttaggtttgtgaaacacagagatctaaacttctcaaagacaaaagcaagagaaagacttgtttctctctgtttctgcaactcctttcctacgataatgactgcttatttgtccaaaaggaggaagcacccccaggtaaaaggaattgcagggatgagaagagggaaatttggacacagacacactgagagaagaattctttgtgaagacatcaagacaaaagagacaaacggattgaatcccatgtgacaacagaagccgagattgcactgatgcatctacaagtcaaagaatgtcaaggatttcagcaaccaccggaagttaggaagaggcaagtaaggatcctctcgtgaaaccttcagagtatgactctgcttacgccttgattttgtacttctcagctccagaactgtgagagaattaattgctgttgttatcagtcagcagattgtggtactttgctatggcaaacttaggaagctaacatactggggttcccctagttgcatagatggtgcaatggtttgtgatggtgatggtgtagatcttgcagctggacgtctgcaggacatgcaagcagttgagggtctgggtgtttcagatcttgatggtcttgtaggagccactgttcatgctgctgtggggcaccactgggtcctgagcttactgctggaggctgttcaactcctttagctccacattggtattcataatattccagaatttttggtcttttggaacccactcaacagcattgtgtgcagagacctgtgtgaacgtaagactgccatatgtgctaactgtgttcaccttattcaggctctggatgtcccagataatgatgatatcatctgcagagccactctaggatttggtctctggatgcaaagcttcatcatcatactagcatttcttctagtgtattctgtcactggagttggtaaatgaggccca

SEQ ID NO: 1327 - DNA, 338 bp, Homo sapiens
cacgcctgtaatcccagcactttgggaggccgaggtgggcggatcacgaggtcgggagatcaagaccatcctggctaatacggcgaaaccccgcctctactaaaaatacaaaaaattagctgggcatggtggcaggcgactgtagtcccagctactcgggaggctgaggcaggagaatggcatgaacttgggaggcggagcttgcagtgagccgagatcgtgccactgcactacagcctgggcgacagagcaagactctgtctcaaaaaaaagaaaaaaaaagaaaagaaaaagaaaaagaaacaaaaatcttcaccttcatagtgctgacactctac

SEQ ID NO: 1328 - DNA, 1213 bp, Homo sapiens
gtctgaggtgggtgtgtgaggaaggggtcgtgtcctgatctttgatccctgcagggaagtccttggcatcttgcctcatcagtaacattcctacaagtagccctttccttccaggaggcattcgtgtgatccccgcacccatgccagcgtgcatggtttgtgcctggtatggcccctgcctggggccacctcggccttgccacgtgtgagcacactgaggggtaccagcttccaggggctcggggctatgctgggcagagacatggaggaagatgaggatctaggtgtgagcatgcagagccctgaggctgggcaggcagggagctctgcctgcacaatgatgtagccgtgtgtggccacaccagcactgggcagcacctctggggaggggggcagggcaaggacaactggagagacaaagccagatggggccacgtccttagaagtgtgtgtgcacgcacgtgtgtgtgtgtgtgtgtaatacgcagggcagaaacacaccatgtaggtcaggcaggacagaaacacatcatgtaggccaggcgtggtggctcaggcctgtaatgccagcacttagggaggccaaagtgggcggatcacctgaggtcaggagttcgagaccagcctggccaacatgtcaaaacctcatctctactaaaattctaaaagatctgtggtctcacgcacgcacacacactgttcacagaggacagagagggcgtgatggactgctgtgttacacttggctgcagtctacacaacagccccggtgaagggggaagctcagaccacgcacacacacccaaggtgggggtggagggggtgctctggtgcatcacacacatcacacgcacacgcacgctggggtgtccacacgtctcgagcatgtgccggcggcatgcatgttggtgtgcatgtgtaatcacgcctgctgcgatctacgtgcggggacggggggggggtccatggcccggtgaggtccagggacaccagggtctgccgtgggggtggggctgcctgggtctgttttgggagtgagcctggagcaggggatggagtgaaaggggtggtgggggtattgctcccgatgtggtgggggaagggtctgggagagagaagggtggggggggcctacaagcccagcgtccccccaatggatgacgccaagaccacccccagcaccacacagcaaatgatgatcatgattttcttc

SEQ ID NO: 1329 - DNA, 230 bp, Homo sapiens
cctccctcctgcactcgctgacgcggcagccagaggacccgggaccagccctcaccttgggcaggatttgtggagcaggtgaggaaaccgaaggcctgagggagaaatgacttgccaggaacccctgttaaggaaaattaacaaagtgtggttattaaagaagaactgagttgggagtcagacctggaggcccccacccttagatacaacagagaaatgcataatgtcca

SEQ ID NO: 1330 - DNA, 679 bp, Homo sapiens
gattccattagttgctaatcgatgatccacttgattccatttgacgatgattccattcttgtccattcgatgattccatttgtttccatatgatgatgattccattcgattccatacgatgatgattccattcgagtccattcaatggtgattccattcaattccattcgatgattccttttgattccatttgatgatgatggcattcgattcctttcaatcattccctttgattccactcaaaggtgatttcattcaagtccattcgataattgcattcgattccattctatgatgattccattcgagtccatttgatgattccattcaattcaagtcaatgatgattccattcgattccattcgatgattccattggattccatttgatgatgattccattcaaatccattcgataattcaattcaagtccattcgatgattattccaatcgaatccattcaaagattacattcaatcccattcgatgattcccttagattccattcgatgattccacttgattccatttacgatgattccattcgattccatgtgatgattccattcaattctattcaatgatgtttccatttgattccattcgaccatgattgcctttgattccattcaatgattccattcgggtccattcgatgatgattccattcgagtgcat

SEQ ID NO: 1331 - DNA, 6180 bp, Homo sapiens
gaatggacttgaaatgaattgtcatcaaatggaatcgaatggaatgattgaaggcacttgaaaggaatcatcgaattgactcgaaaggaatcatcacctagtggaatccaatagaattatcgaatggactcgaaaggaatctttgaatggactcaaatggaatcatcatcgaacggaatctaatggaatcattgaatggactcgaatggagccctcatggaatgtaataaaagagaatcaccaaatgcactaaaatgggatgattgaatagcctcgaattgcatcatcattaaacggaatcgaatggagtgatctcatggactcgaatgtaatcatcaaatggactcaaaaggaatcatcatcaagtggaatcgagtgaaatcatcgaatggactcgaatgccatcatcgaatgtggtcgaatggaatcatcattgaatagaatctaatggaatcatcacatgggcttgaatgcaatcattatcgaatgtaatggaatggaatcattgaatggattcgaatggaatcatcatcaaatggaatcaaaaggaataatcgaatggactcgaagggaatcatcgaatgaactctaatggaatcattatcaaacggaatccaatgtaatcattgaatggactcgaatggaatcatcatcgaatggaattgaatggaatcatcgaatggaatggaatggaatcatcctcgaatggaatctaatgaaatcaccgaatggacacgaatggaatcatccaatggatttgagtggaatcatcattgaatggaatcgaatggaatcatcaaatggactcgaatggaatcatcttcgaatggaatcgaatgaaatcacaatcgaatggaatggaatggagtcatcatctaatggagtcgaatggaatcatcattgaatataatagaatggagtcaccatattgaatcaaatggaaagatcatcgaatggaattgaagggaatcatcgaatgggaatgaatggagtcatcaaatggaattgagtggaatcatcaaatggattcgaatggaatgatcatcgaatggaattgaatggtatcatcgaatggactcgaatggaatcatcatcaaatggaaccaaatggaatcatcgaatggacacgaatgcaatcatcattgagtggaatcaaatggaatcattgaatggtatcgaatggaatcatcatcgaatgtagtctaataaaataaccgaatggactcaaatagaatcatcgaatcaagtcgaatggaatcatcatcgaatggaatccaatggaatcatcgaatagcatcaaatggaatcattgtcgaatggattcaaatggaatcatcgaatggactcgaatggaatcgtcatttaatgtaatcgaatggaatcttcgaatggactcgaatggaatgatcatagaatggaacctaatggaatcatcgaatggaatagaattgaatcatcattgaatggaatcgagtagaaacattgaaagaaatcgaatggaatcatcatcgaatggaatcgggtggaatcatcaatgaatggaatcgaatggaatcatagaatggaatccaatgtaatcatcttcgaattgaaaacaaagcaatcattaaatgtactctaatggaatcatcgaatggactcgagtagaatcatcgttgaatggaatataatggaatcatcgaatgcaatcgaatggaatcatggaatggactcgaatggaatcatcatagaatggaatgaaaggaatcatcaaatggacttgaatgaaatcattgaatggactcaaaaggaatcatcatcgcatggtattgaaaataatcgttgaatttaccctaatgggaaaatcgttgaatggaatggaaagcaatcatttaatggaatagaatggaatcatcattgaatggaatcaaatggaatcctcaatgaatggaatcgaatggaatcatcatcgaatggaattgaacggaaacatcagcgaatggaatcgaaaggaatcatcatggaatagattcgaatgattccatctctctcccttcgatgattccatttgattccatctgatgatgatttcacttgattcctttcaatgatgattccattcatgtccattcgatgcttccattggagtccaaacgatcattccattcgattccattcaatgatgattccattcatgttcattcgatgaatccattcaattccattcgatgatgactccattcgagtacattcgatgattccatttgattccatttgatgatgattccattcaattccattcgaagatgattccattcaattccattcgatgatgattctgtaagaatccattctctgattattccattcgattccattcatgaccatttggtgattccattcgatttcattcgttgatgattccattcgagtccattccatgattccattcaagtccatttgatgatttctttgaattcaattcgatgatgattccattcgagtccattcgatgattccattctgttccagtcgatgatgattccattcgagtccatatgatcattccatttgatttcattcgatgatgattccattcgtttccattcgatgattccattctattccattcgatgatgattccattcgagtccgttcgatgggtccattcgagtccatttaatgattccattgggttcaattcaatgattattacattggattccgttctatgattccattccattccgttcattgacaatttgattccattcgatgatgattccatttgagttcattcgatgattctattcgattccattcgatggtgattcaattctattatattggatgattccactcgattccatttgatgattattccattggagtccacttagtgaatcctttagattctactcgaagatgattccattcgagtccattcgatgataccattcaattccattcgttgatgcttccattcaagtgcattcgatgatatcattcgattccatttgatgataattccatttgattccatgcgatgattctattcgattccattcaatgataattccattcaattcagtgattcctctggactccatttgatgatgattccattcgattccattcattggtgattccactcaattccattcaatgattccattccatttctttcaacaatgattccattagtttctattcgatgatccacttgattccatttgacaattattccattcgtgtccattcgatgattccatttgattccatatgatgatgattccattcgattccatacgatgatgattccattcaagtccattcaatggtgattccattcaattccattcgatgattcctttctattccattcgatgatgatggcattcgattcctttcgatcattccctttgattccattcaaaggtgatttcattcaagtccattcgataattgcattcgattccattctatgatgattccattcgagtccatttgatgattccattcaattcaagtcaatgatgattccattcgattccattcgatgattccattggattccatttgatgatgattccattcaaatccattcgataattcaattcaagtccattcgatgattattccaatcgaatccattcaaagattacattcaatcccattcgatgattcccttagattccattcgatgattccacttgattccatttacgatgattccattcgattccatgtgatgattccattcaattctattcaatgatgtttccatttgattccattcgaccatgattgcctttgattccattcaatgattccattcggttccgtttgatgatgattccgttcgattccatttgatgattccatttgattccattggatgagtctatttgattacattcgatgattattccattcgagtgcattagatgattccattcgagtgcattagatgattccattcgagtccattcgatgattccattcgattccattcgatgttgattctgttcaaatccattcgatgattccactcgattccattcgatgactccatttgatcccattcgatgatttcctttgattccctttgatgatcattccatttgattcaattcggtgatttcatttgattccattcagtgatgtttccattcgactccattcgatgatgattccattcgactccattcgattatgatttcattcaattccattcgataatgattcccttcgggtccattcgatgatttcattcgattccgttcaacgatgatttcattcgtgtccattcgatgattccatttgattccacttgatgatgattccattcgagtccatttgatgattccattcaattccattctccgatgatttcttttgagcccattcaatgcttccactcgattccatatgatgatgactacattcgatgaaattcgatgatgattccattcgctttcattcgatgatgattccacttgagtccgttagaagtttctgttcaattacattccatgacgattccgttagagtccatttgatgattccattagactccatttgaggatgattccattcgatgttattcgatgattccattcgatttcattcgatgatgattccattcaactccattcgatgtttccattcgagttcattctattaatccattagattccgttcgatgatgattccattcgattccatttgatgattgcattctatttcatttgatgatgattccattcgagtccattcgatgattccattcgagtccatttaatgaatccattggtttcaattctatgatgattacattggattccattcgttgatgatttcattcgattccattcaatgatgattccattcaattccttgcaatgtttccattcaattccatacgatgatgattccatttgatttgattcgacagtgagccattcgattcaattccatgatgattgtatttgattcaattggttgacatttccattcgattccattcgatgatgattcaatttgattccattctagcccattcaatcattccattcgattctattcaatgatgattccattcatgtcgatttggtgattccatttgacttcatttgatgatgattcctttcaagttcattagatgattccattcgattccatttgatgatgatctcattcgagtccattccgtgattccattcctttccattccatgatgattccattccattccattcaatgattccattcgattccgtttgatgatgatttctttcgagtccatttgatgattccattcgatgatgattccattcgggtccattagatgattctattcgaatccatttgatgatttcttttgattatagttggtgatgattccattggagtccattcaatgattccattcgattccaatcgatgattattccattagagtccatttaatgattccatttgattccagtctgatgattacattcgagtccatacgatgattccactcaattccatatgatgatgattccattcgattccattcgatgattccattctattctattcaatggtgattccattcgagtacattagatgattccattcgattccattcaatgatgattctatttgtgtcccttagatgattccacatgattccattagatgatgatactatttgagcccatccaatgattcccttcgattccattcgatgaggattccattcgattcaattcattggtgattctattcaatgcaattctttgattccattccgttccattcgacaatgattccattctatttctttcgatgattccactcgattccacttgacattgattccattcgattccattcaatgattccatttgattccagtggatgatgattgccatcgattccatttgataactccattctattccatttgatgatgattacattcgattccatttgatgattccatctgattctattcaaggattccaattgatcccattcgatgatgattccattcgagtccattcgatgatttcattcgagtacatccaatgattccattcgagtccatttgatgattccatttgattccatttgattatgattctactagagtccattcaatgactccattcgagtccattcaacaattccattcgagtccattcgatg

SEQ ID NO: 1332 - DNA, 2307 bp, Homo sapiens
atcaaatggaaacaaatggaatcatcatcgaatggaatcgaatggaatcatcatcaaatggaatcgaatggaatcatccaatataatagaattgaatcaccatcgaacggaatcgaatagaatcatcgaatgaactcaaatggaatcatcattgaatggaatcgaatcatcaacgaatggaattgaatggaatcatagaatggaatccaataatggagtcatcgaatggaatcgaatggaatcatcatcaaatgaaatcaaatggaatcatcgtatggactccaacggactcatcatcgactggaattgaacagaagcatcgaatgaaatcaaatggaattatcatcgaacggacccatatggaatcatcattgaattgactcatatggaatcatcgccgaatggattccaatggaataatcatggaatggattggaatggaaacatcatctaattgaatcaaatagaatcatcatggaattgaatcgaattgctcaccgtcgcatggaatcaaatggaatcatcgaatggaattgaatggaatcatcatcgaatggaatgaaatggaatcatccaatggccgagaagtgaatcatcattgaatggaatcgaatagaatcatcaaatgaaatccaatggaatcatcatcgaatacaatcgaattgaatcaacatcaaatggaatcgaatggaatcatccaatataatagaatggaatcaccatcgaagagaatcgcacagaatcatcgaatgaactcaaatggaatcatcatcgaatggaatcaaattgtcaatgaacggaattgaatggaatcatagaatggaatccaatgtaatcatcattgaattgaacccaatggaatcattaaatggactcgaatggaatcatcgaatggactcgaatggaatcatcatcgaatggaatagaatggaatcattgaatggaatcgaatggaatcatcattgaatgaaatcaaatggaatcatcatatggactcgaatggaatcatcatcgaatggaactgaatggaatcatcgaatggactcgaatggaatcatcatcgaattgaattcaaagaaatcatcaaatggacttgaatggaatcatggaatggactcgaatggaatcatcaacgaatgaaatcgaatggaatcaccaaatggtcatgaatggaatcatcatctaatagcaacgaatggaatcatcgaatggactcggatggaatatcatcgaatggaattaaaagcaatcatcgaatggactccagtggaaatattgaatggactaaaatggaatctttatcgaaaggactccaaaagaatgattgaatggtctcgaatggaatcatcgattggactcaaatggaattatcgaatatccgcaaatggaatcatcgaatggactcgaaaggaatcatcgaatgcaattgatcagaatcatcatcgaatggaatcaaatggaaccatcaaatggaatcgaatggatcatcgaatgcaattgatcagaatcatcatcgaatggaatcaaatggaatcatcaaatggaatcgaatgcagtcatcatcaaatagaatcgagtggaatcatcatcgaatacaatcgaatggaatcatcaaatggaatcaaatggaatcaccattgagtggaatcaaatggaatcatcatcaaatggaatcgaaaagaatcatcttcaaatggaatcgaatggaagcatcatcgaatggaatccaaaggaatcatcatcgaatggaaccgaatgtaatgatctttgaatggaagcaaaaggagtcatcatcgaatggattctgatggaatcatcattgaatggaatcgaatggaatcatcatctaatggaaaatattggaatcatccaatggaattgaatggaatcatcatcaaatgaattgaatggaatcatcaaatggtctcgaatggaatcctcatcaaatggaatcgaatggaatcatcgaatagaatcaaatgtaataatgatcgaatggactcgaatggaatcaacatcaaatggaatcgaatggaattatcaaatggaatcaaatagaaacatcgagtggactcgaatggaatcttcgaatggaattgaatgggatagtcaacggaccctaatagaatcatcatcctatggaattaaatgaaatcatcaaatgtacacgtatggaatcttcatcgaaaggaatcgaatggaatcatcgaatggactcgaatggaagcattgaatggattcatcaaatggagtcgaactgaataatcatcgaatggtatcgaatggaatcatcgaatggactcaaat

SEQ ID NO: 1333 - DNA, 5214 bp, Homo sapiens
cattcaatgattccattccattccattcgatgatgattcccttagattccattcgatgattccacttgattgcatttacgatgattccattcgattccatgtgatgattccattcaattctattcaatgatgtttccatttgattccattcgaccatgattgcctttgattccattcaatgattccattcggttccttttgatgatgattccgttcgattccatttgatgattccatttgattccattggatgagtccattcgattacattcgatgattattccattcgagtgcattagatgattccattcgagtccattcgatgattccattcgattccattcgatgttgattctgttcaaatccatttgatgattccacttgattccattcgatgactccatttgatcccattcgatgatttcctttgattccctttgatgatcattccatttgattcaattcggtgatttcatttgattccattcagtgatgtttccattcaactccattcgatgatgattccattcgactccattcgattatgatttcattcaattccattcgataatgattcccttcgtgtccattcgatgatttcattcgattccattcaacgatgatttgattcgtgtccattcgatgattccatttgattccacttgatgatgattccattcgagtccttttgatgattccattcaattccattctctgatgatttcttttgagcccattcaatgcttccactcgattccatatgatgatgactccattcgattaaattcgatgatgattccattcgcttgctttcgatgatgattccacttgagtccattagaagattctattcaattacattccatgacaattccgttcgagtccatttgatgattccattagactccattcgacgatgattccattcgatgttattcgatgattccattcgatctcactcgatgatgattccattcaactccattcgatgtttccattcgagttcattctattattccattagattccattcgatgatgattccattcgattccatttgatgattgcattctacttcatttgatgatgattccattcgagtccattcgatgattccattcgagtccatttaatgaatccattggtttcaattctatgatgattacattggattccattcgttgatgatttcattcgattccattcaatgatgattccattcaattccattcaatgattccattcaattccatacgatgatgattccattggatttgattcgacagtgagccattcgattcaattccatgatgattctatttgattcaattggttgacatttccattcgattccattcgatgatgattccatttgattccattcaaagatgattccattctagcccattcaatcattccattcgattctattcaatgatgattccattcatgtcgatttggtgattccatttgacttcatttgatgatgattcctttcaagttcattagatgattccattcgattccatttgatgatgatcccattcgagtccattcagtgattccactcgtttccattccatgatgattccattccattccattcaatgattccattcgattccgtttgatgatgatttcattcgagtccatttgatgattccatttgattccattcgatgatgattccattcgagttcatttgatgattctattcgaatccatttgatgatttcttttgattatatttggtgatgattccattggagtccattcaatgattccattcaattccaatcgatgatgattccattagagtccatttaatgattccatttgattccagtctctgatgattacattcgagtccatacgatgattccactcaattccatatcatgatgattccattcgattccattcgatgattccattctattctattcaatggtgattccattcgagtacattagatgattccattcgattccattcaatgatgattctatttgtgtcccttagatgattccacatgattccattagatgatgatactatttcagcccatccaatgattcccttcgattccattcgatgaggattccattcgattcaattcattggtgattctattcaattcaattctttgattccattccattccattcgacaatgattccattcgatttctttcgatgattccactcgattccacttgacattgattccattcgattccattcaatgattccgtttgattccagtggatgatgattgccatcgattccattcgatcactccattctattccatttgatgatgattacattcgattccatttgaggattccatctgattctattcgaggattccatttgattccattcgatgatgattccattcgagtccattcgatgatttcattcgagtacatccaatgattccattcgagtccatttgatgattccatttgattccatttgattatgattctactagagtccattcaatgactccattcgaatccattcaacaattccattcgagtccattcgatgattccatttgatgattccattcgagtccatttaatcattacagtcgagtccatttggtgattccactggatttcttttgataatgataccattcaattacatttgatgatgatcccattcaatttcatttgatgatgattccattagagtccattccatgatttcattcgagtcccttcattgattccatccgatttcattggatgatgactccattcgagtccattcgatgattccactcgattccattagatgattccattggagtccatttgattgttccattcgattccattcgattcctttcgaagattattccatttgagtccattcgatgatgattccattccattccattcgatgattccgtttgattccattcgatgattccctttgattcctttctatgatgattccattccattccattcaatgattccattcgaatctattccatgatgattcctttcgattccattcgctgatgtttccgttcaattccattcgatgatgattccattcgattccattcattgaggattccatttgattccattcaatgatgattccattctattccattcaatgattgcattcaattccattcaatgattatcccattagagtaagttcaacgattccatacaataccattcgatgatgattccttttgagtccattcaatgatttcattcaagtccatttgatgattcctttcaattccattctatgatgattccattcgagtccattcgatgattccattcgattgcattcgatgattccattatattccattcaacgatggttccattcgagtccattcgatgattccattagagtacatttaatgattgctttgttttcaattcgaagatgattacattggattccattctatgattccattcgattccattcaatgatgattctatttgtgtcccttagatgattccacatgattccattagatgatgatactatttcagcccatccaatgattcccttcgattccattcgatgaggattccattcgattcaattcattggtgattctattcaattcaattctttgattccattgcattccattcgacaatgattccattcgatttctttcgatgattccactcgattccacttgacattgattccattcgattccattcaatgattccgtttgattccagtggatgatgattgccattgattccattcgatcactccattctattccatttgatgatgattacattcgattccatttgatgattccatctgattctattcgaggattccatttgattccattcgatgatgattccatttgagtccattcgatgatttcattcgagtacatccaatgattccattcgagtccatttgatgattccatttgattccatttgattatgtttctactagagtccattcaatgactccattcgagtccattcaaaaattccattcgagtccattcgatgattccattcgattccatttgatgattccattcgagtccatttaatcattacagtcgagtccatttggtgattccactggatttcttttgataatgataccattcaattacatttgatgatgatcccattcaatttcatttgatgatgattccattagagtccattcgatgatttcattcgagtcccttcattgattccatccgatctcatttgatgatgattccattcgagtccattcgatgattccactcgattccattagatgattccattggagtccatttcattgttccattcgattccattcgattcctttcgaagattattccatttgagtccattcgatgatgattccattccattccattccattcgatgattccgtttgattccattcgatgattccctttgattcctttctgtgatgattccattccattccattcaatgattccattcgaatctattccatgatgattcctttcgattccattcgctgatgtttccgttcaattccattcgatgatgattccattcgattccattcattgaggattccatttgattccattcaatgatgattccattctattccattcaatgattgcattcaattccattcaatgattatcccattagagtaaactcaacgattccattcaataccattcgatgatgattccttttgagtccattcaatgatttcattcaattccatttgatgattcctttcaattccattctatgatgattccattcgagtccattcgatgattccattcgattgcatgcgatgattccattatattccattcaacgatgattccattcgagtccattcgatgattccattagagtacatttaatgattgctttgttttctattcgaagatgattacattggattccattctatgattccattcgattccattcattgatgattccacccgattccattcgatgatgattccattcgatttcattgaatgattctactcgattgcattcaatgttgattcaattctattccgttcgatgattccattagattccattctatgatgattccattcgagtccattcgaagattccattcgattacattccatgacgattccattcgagtccattcgatgattccatttgaatccattcgacgatgattccat

SEQ ID NO: 1334 - DNA, 1195 bp, Homo sapiens
attccattcgactccattcgatgattccattcgattccatttgatgattccattcgagtccatttaatcattacagtcgagtccatttggtgattccactggatttcttttgataatgataccattcaattacatttgatgatgatcccattcaatttcatttgatgatgattccattagagtccattcgatgatttcattcgagtcccttcattgattccatccgatctcatttgatgatgattccattcgagtccattcgatgattccactcgattccattagatgattccattggagtccatttcattgttccattcgattccattcgattcctttcgaagattattccatttgagtccattcgatgatgattccattccattccattccattcgatgattccgtttgattccattcgatgattccctttgattcctttctgtgatgattccattccattccattcaatgattccattcgaatctattccatgatgattcctttcgattccattcgctgatgtttccgttcaattccattcgatgatgattccattcgattccattcattgaggattccatttgattccattcaatgatgattccattctattccattcaatgattgcattcaattccattcaatgattatcccattagagtaaactcaacgattccattcaataccattcgatgatgattccttttgagtccattcaatgatttcattcaattccatttgatgattcctttcaattccattctatgatgattccattcgagtccattcgatgattccattcgattgcatgcgatgattccattatattccattcaacgatgattccattcgagtccattcgatgattccattagagtacatttaatgattgctttgttttctattcgaagatgattacattggattccattctatgattccattcgattccattcattgatgattccacccgattccattcgatgatgattccattcgatttcattgaatgattctactcgattgcattcaatgttgattcaattctattccgttcgatgattccattagattccattctatgatgattccattcgagtccattcgaagattccattcgattacattccatgacgattccattcgagtccattcgatgattccatttgaatccattcgacgatgattccat

SEQ ID NO: 1335 - DNA, 4055 bp, Homo sapiens
aatcaatgaagggactcgaatgaaatcatcgaatggactctaatggaatcatcatcaaatgaaattgaatgggatcatcatcaaatgtaattgaatggtatcattatcaaaagaaatccagtggaatcaccaaatggactcgactgtaatgattaaatggactcgaatggaatcatcaaatggaatcgaatggaatcatcgaatggactcgaatggaatttttgaatggactcgaatggagtcattgaatggactctagtagaaacataatcaaatggaatcaaatggaatcatcaaatggactcgaatggaatcattggatgtactcgaatgaaatcatcgaatggactcaaatggaatcatcatcgaatggaatcaaatggaatcctcgaatagaatcagatggaatcatcaaatggaatcgaatgtaatcatcatcaaatggaatagaatggagtgatcgaatggaatcaatggcaatcatcatccactggaatcaaacggaatcattgaatggaatcgaatggaatcaatgtcaagtggaatcgagtggaatcatcgaaagaaatcgaatggaatcattgtcgaatggaatgcaatggaatcaaagaattgaattgaatagaatcaccaatgaattgaatcgaatggaatcctcatcgaatggaatcatcatcaaatgaaatcaaatggaatcatcgtatggactccaacggaatcatcatcgactggaatagaatagaagcatcgaatgaaatcaaatggaattatcatcgaacggagccatatggaatcatcattgaattgactcatatggaatcatcgccgaatggattccaatggaataatcatggaatggattcgaatggaaacatcatctaattgaatcaaatagaatcatcatggaattgaatcgaattgctcaccgtcgaatggaatcaaatggaatcatcgaatggaatcgaatggaatcatcatcgaatggaatgaaatggaatcatccaatggacgagaagtgaatcatcattgaatggaatcgaatagaatcatcaaatgaaatccaatggaatcatcatcgaatagaatcgaattgaatcaacatcaaatggaatcgaatggaatcatccaatgtaatagaatggaatcaccatcgaagagaatcgaatagaatcatcgaatgaactcaaatggaatcatcatcgaatggaatcaaattgtcaatgaacggaatggaatggaatcatagaacggaatccaatgtaatcatcattgaattgaacccaatggaatcattaaatggactcgaatggaatcttcgaatggactcgaatgcaatcatcatcaaatggaatagaatggaatcatcgaatggaatcgaatggaatcatcatcgaatgaaatcaaatggaatcatcatatggacacgaatggaatcatcatcgaatggaactgaatggaatcatcgaatggactcgaatggaatcatcatcgaattgaattcaaagaaatcatcaaatggacttgaatggaatcatggaatggactcgaatggaatcatcaacgaatgaaatcgaatggaatcaccaaatggtcatgaatggaatcatcatctaatagcaacgaatggaatcatcgaatggactcgaatggaatatcatcgaatggaattaaaagcaatcatcgaatggactccagtggaattattgaatggacgaaaatggaatctttatcgaaaggactcaaaaagaatgattgaatggtctcgaatggaatcatcgattggactcaaatggaattaccgaatctctgcaaatggaaccatcgaatggactcgaaaggaatcattatcaaatggaatcaaatggaaccatcaaatggaatcgaatggatcatcgaatgcaattgatcagaatcatcatcgaatggaatcaaatggaatcatcaaatagaatcgaatgcagtcatcatcaaatagaatcgagtggaatcatcatcgaatacaatcgaatggaatcatcaaatggaatcaccatcgaatggaatcaaatggaatcatcatcaaatggaatcgaaaagaatcatcatcaaatggaatcgaatggaagcatcatcgaatggaatgcaaaggaatcatcatcgaatataaccgaatgtaatgatcattgaatggaagcaaaaggagtcatcatcgaatggattctgatggaatcatcattgaatggaatcgaatggaatcatcatgtaatggaaaatattggaatcatccaatggaattgaatggaatcatcatcaaatgaattgaatgcaatcatcaaatggtctcgaatggaatcctcatcaaatggaatcgaatggaatcatcgaatagaatcaaatgtaataatgatagaatggactcgaatggactcaacatcaaatggaatcgaatggaattatcaaatggaatcaaatagaatcattgagtggactcgaatggaatcttcgaatgcaattgaatggaatagtcaacggaccctaatagaatcatcatcctatggaattaaatggaatcatcaaatgtactcgaatggaatcttcatcgaatggaatcgaatggaatcctcgaatggactcgaatgggagcattgaatggattcatcaaatggagtagaatggaatcatcatcgaatggtatcgaatggaatcatggaatggaatcaaatggaatcatcatggaatggaatcgaacggaatcatcaaatggattcgaatggaatcttcctcgaaaggaatcgaatggaatcgtccaatggacacgaatggaatcatcatcgaatggaatcaaatggaaccatcaaattcaacagaatggaaccattgaatggacttgaaatgaatcgtcatcgaatggaatcgaatggaatcattgaaggcccttgaaaggaatcatcgaattgactcgaaaggaatcatcacctagtggaatccagtagaattatcgaatggactcgaaaggaatctttgaatggactcaaatggaatcatcatcgaatggaatctaatggaatcattgaatggagccctcatcgaatgtaataaaagtgaatcaccgaatgcactaaaatgggatgatcgaatagcctcgaattgcatcatcattaaacggaatcaaatggagtcatctcatggactcgaatgtaatcatcaaatggactcaaaaggaatcatcatcaagtggaatcgagtgaaatcgtcgaatggactcgaatgccatcatcgaatgtggtcgaatggaatcatcattgaatagaatctaatggaatcatcacatgggctcgaatgtaatcattatcgaatggaatcatcatcgaatggaatggaatggaatcattgaatggaatcgaatggaatcatcatcaaatggaatcaaaaggaataatcgaatggactcgaagggaatcatcgaatgaactctaatggaatcattatcaaacggaatccaatggaatcattgaatggactcgaatggaatcatcatcgaatggaattgaatggaatcatcgaatggaatggaatggaatcatcctcgaatggaatctaatgaaatcaccgaatggacacgaatggaatcatccaatggatttgagtggaatcatcattgaatggaatcgaatggaatcatcaaatggactcgaatggaatcatcttcgaatggaatcgaatgaaatcacaatcgaatggaatggaatggagtcatcatctaatggagtcgaatggaatcatcattgaatataatagaatggagtcaccatattgaatcaaatggagagatcatcgaatggaattgaagggaatcatcgaataggaatgaaaggagtcatcaaatggaattgggtggaatcatcaaatggattcaaatggaatgatcatcaaatggaattgaatggtatcatcgaatggactcgaatggaatcatcatcaaatggaaccaaatggaatcatcgaatggacacgaatgcaatcatcattgagtggaatcaaatggaatcattgaatggcatcgaaaggaatcatca

SEQ ID NO: 1336 - DNA, 2691 bp, Homo sapiens
tgagtggcagagaaggagactcatacctctgttcccttagcctggtcgtctgcctggaggagctggacatttccaacttcatctgaagatcgccattttggatgttggatacttctcctttcttttttttggtttttttttttttttttttgagacggagtctctctctgtcaccaggctggagtgtgcaacctccgcctcccaggttcaagcgattatcctgcctcagactcccaagtagctgggattacaggtgccagccaccacgcccggctaatttttgtatttttagtagagacggggtttcaccatgttggccaggatggtctcgatctcttgacctcgtgatctgcccaccttggcctcccaaagtgctgggattacaggcgtgagccaccgcgcctggccttctgctttctttatcatattgtagttcagttcctgtagtttcaggttacttattgttagggatgggtgctgacatttcgggtcccctggctggcagccaagattcaagagcactgttttcttgctgtcaaatcacattgcaccaacatcaagttggatataaaagtccccacaagtatcaataaaagactgatggtgccttttattattctttgggctgaagtgagaaactggaaggctaaaagacatgcggataaatgtgacaggccgagtatgctctgtagtgtcagctccttcccaaaaccccgctaacactatggcaaagaaaaggtataaacttacaagaacgaagaaaaatggagagaaaaagatatcagagaagaaagatcagcagaacttgggaacgtgaaaagtggaaggctgagtgctgtcttggcagaagggaaagctgagaggcagcaggccagctcacatccaagaacctcggaagagctcaggaattgaagggccacagctcctcccacctgttttattgttcctgctggactttccacctggaacgcttacctctgcatctccggtggtgtaggaggaggtctggtggagagtcaggactttcactatcagccagcagtaataaaaccatgccacccaagtgttaatggagaccacctggggagccagagctcctaccactgccaggaagtaacaaggaactctccccataacctgcatcatcacttttggtgtcaagaaaggctcagtgggaaatctggccttttacctccatttgccagtgacaagcaagtgctattcctccccctgctgaagtggcattaaagaaatgaagttaaaacaagaggtttaaatgagatctaaaggcttatcacttaataaaaagtgttcaagattcaatttaaaaaactcacttttcataccaacagccagaaagatctcaaactgaatgaaaaacaatcaatagaggccaatgctaaaatgacagaggtattagaaacgtctgacaaagatttttaaagtgaccatgataaaaatgcttcaatgtgcaatataaacatgcttgaaacaaataaaaaaaagacaatctcagcaaagaaatagaagatataaagaactatatgaaaaatgaaaagtaaaatgactgaagtaataaactcagtggctaggcttaacagaatggaagtgacaaaggaaggatcagtgaactggaagacagaacaataaaaataactcatttaaacaacacagagaaaatagactaaaaaaaaaaaccagtttcagtgacctgtgggactacaataaaacatccagcatttatgttatcaggatcccgaaagaacaggagagactgaagatgacaaagcactgaaagaaataatggctgaaaacttcccaaatttggcaagagacataaatctactgagccacaaacaggacaaatccaaagaaattcatgtcaagattcataataattaaacttctgaaaattaaagacaaagttctgaaagcaggcagagaatgacatcttacctgaaggggaaaaacacacaagcaagcaagtaaacaacataatagcagactttttttatcttaaatcatgggggccagaagaaagcagtacagtgttttttgttttgttttattttgttttgctttcttcaaatgctgaaagaaaagaactgtcaacccagaattcaatatccagtgaaagtatccttcaggaatgaatggggccaatgaagatattctcaaaagaaggaactttaatagaatttatcactagcagacttaccctaaagaaatggctaaatgaagttctctaaatggaaagtaaatggtaaaagaaggagccttggaacaccaggaagaaaaaataaaagctaaaatacagatctgaaagccggaagtctgagatcagagtgacagcatggtcagcctctgctgaggactgtcttcagggttgcagactgcagacttctcattgtatcctcacatggtggaaagagcaagataactttctgcggtctcctttagaagaacactaatttcattcatgatgcctcctctctcatgacctaattatcttccaaagtccccacctcctaataccatcacactggggtatggatttcaacatgtaacttttggtggggagtgggagaggagtacaagcattcagtccataataactacataataaaaatatttaaaaaatgaaattattaaacaggaacacagtacaaataatatgataggacaaagacc

SEQ ID NO: 1337 - DNA, 2132 bp, Homo sapiens
acaggaactgtgtctgggctcagtttccctcgccttgcttcattcagtccatctttcatctcttaaatcccagcattgggtggagactgagtggcagagaaggagactcatacctctgttcccttagcctggtcgtctgcctggaggagctggacatttccaacttcatctgaagatcgccattttggatgttggatacttctcctttcttttttttggtttttttttttttttttttgagacggagtctctctctgtcaccaggctggagtgtgcaacctccgcctcccaggttcaagcgattatcctgcctcagactcccaagtagctgggattacaggtgccagccaccacgcccggctaatttttgtatttttagtagagacggggtttcaccatgttggccaggatggtctcgatctcttgacctcgtgatctgcccaccttggcctcccaaagtgctgggattacaggcgtgagccaccgcgcctggccttctgctttctttatcatattgtagttcagttcctgtagtttcaggttacttattgttagggatgggtgctgacatttcgggtcccctggctggcagccaagattcaagagcactgttttcttgctgtcaaatcacattgcaccaacatcaagttggatataaaagtccccacaagtatcaataaaagactgatggtgccttttattattctttgggctgaagtgagaaactggaaggctaaaagacatgcggataaatgtgacaggccgagtatgctctgtagtgtcagctccttcccaaaaccccgctaacactatggcaaagaaaaggtataaacttacaagaacgaagaaaaatggagagaaaaagatatcagagaagaaagatcagcagaacttgggaacgtgaaaagtggaaggctgagtgctgtcttggcagaagggaaagctgagaggcagcaggccagctcacatccaagaacctcggaagagctcaggaattgaagagttgttaggctaaaatgagaccatagctgtgaatatcctttggcaggaaatgcagtagagaatgcaagaggcaacaatgatggctggaagagaagggccccaagataataaagccacacatggaccgggcagagatccctgagtggccactggaagaatccaagccatctcttcctttataatgctgttatttttaataagtcaacaaattggctaattatcttggaaatattttgatttgaggaaatggacattttacacaattcccttagagaagaaagaaaacagatttccaagtgcattatcaataagcagggcatttgaactctatgatcggaaatggagaagacatggtgagctcttgggttcagatgttcaatatttgaaggagacggtggagaatgagcattggcaggacatgtgcttcacctggatgactgaggatggttgaagggcaggcctcaagccaacttggatctcaagtccacctaaaagagttatgttcacagccttgaactgtcagggaatggagacagggaggaacatagttgaatgtcacccatggagtcccttgagggcagggtcttgccctacttgtctcctagcataggtctggcccctcatagatagtattacctattttgttgaagtgaaatggtttttcgggacgcaaatccactttcctacattgaaatcaggtgacatctagagatctagacttaaccagggcagttttccgggggtgggaagacagcctgggagcggtcaggagggagttgcgtctgccacgaagccattggatggctgtctcgaaaatgggtcatgaaggtgccctcaatgggaggaaggaacacagaacagaaatgtcactgacctcataattttgctgaaatctggtcctggttctctagcccatccctctaaaacctacttcctagaacaaaaaaaactacaggcttaatatcccagctccaaatctccccagaagctcaggttcctatgggatcccacctacccgaggcaaaagacagaatgaactcagttccctttaaaatcttcatctgacttcatttttgacctctttcctgatttctaatttagtcaaataaacccatataccttaaaatgat

SEQ ID NO: 1338 - DNA, 334 bp, Homo sapiens
gcctcccaaagtgctgggattataggtctgaatcaccctgcctgaccccctcgtaatttttatagcctgaactggaaaccaaatggccatcaacaggtgaagggataaagaaacttccatccatacaatggaatactactcagcaagaaaaaggaacgaaccattgataaacaaagcaatgtggatgcattctgcagacagcatgctgagggaaggaagccagactcaaaagcagactgtgatctcctgagggggactgtcatagcccagccccagcccagagcctgtcacataggatgacatcaggaaatgtctgctatggaatgaaggcagg

SEQ ID NO: 1339 - DNA, 367 bp, Homo sapiens
gcctagcccacatggtaaaaccccgtctctactaaaatacaaaaatcagccaggcatggtgacgggcgcctgtaatcccagctactcaggaggccgaggtaggagaatcacttgaacccaggaggcggaggctgcactgagccgagatcacatcactgcactccagcctgggtgacagagtgagactccgtctccaaaaccaaaaagagctacaatgttccccccttttcaacaactctctcctatgtgcaaagcacgtggatctttaaaatgtttgacacacaaatcttgtcctcaagttatttacttgaggaataaaaggaagacatgtgtcccctaaaataggccaactaataaagtagaaatt

SEQ ID NO: 1340 - DNA, 684 bp, Homo sapiens
caggctggaatgcagtggcgtcatctcggctcactgcaacctctgcctcctgcattcaagcaattctcctgcctcagcctcctgggtagctgggattacaggagcctgccaccacgcccagttaactttttgtatttttagtagagacggggttttgccatattggctaggctggtcttgaactcctgacctcgggtgatccagccacctcagctttccaaagtgcttggattatagccgtgagccaccatgcccggcgtggtgctgtttcagattggttccaaggaatttgggaaagttgcattccttactttccttgaatataaaagtggaggcagtgataaaatctacttccctggatggactcttggcagaaatcagtgagacagcccatgcacaaagcttcccagaaacatccatcagcacccccaagaggaagatgtctgagcccccagagaatcaatacatggagatctccagaggttttccacggggtagaaacatcgacaaggacttcggaaacacaccacttgaataccttcaagagtctcgctctatgacccaggctggaatgcagtggcccgatctccgctcactgcaatctccaccgcccgggttcaagcaatttcctgcctcagcctcccgagtagctgggattacagatgcctgccaccacacttggct

SEQ ID NO: 1341 - DNA, 1752 bp, Homo sapiens
ggctgctgtagggctgaggcccctttttggcaactggaacccccaaggggtctctgttaaaaccagcagggtcacagccaaaactggagatctttgaagacagaacactgggtttggggcaggcggtacttgaggggttagccacgggtgccagaaattctccaggctggcgggcaggggggtccttgctgttgtgggagactggggcctgtgtgcccccaggaccacccagcaggctgcccacacctggcgttggcgagcttccgtggggcgccgtgttggcgaggcttcccgacggcttgggggtgccggtgtcatgtctgctgggcggcggctgctctggtatcaggagaccggggcttgctcccatttctcccgcacaggcggctggaggagaacgcaaagcctctgtgaattctgtgctgtccggggctgactcttcggcagtttcaggctccttggcctcctggggaaagtccagcgacgggcgggtttcctctgaggtctcggtgttggtggggacctgcaggggatccttgggggccactgaggggcgatcagcacacttggggcctccctccctggcggccgctcccgtctccaggcttcgagacgggccacgggcctgagggctcctgccggggcccgggcgagacccgcccggctcctcggggttcgcgggggctccgtccccgccggcttcctgcctcgccgccttccggggtttctgtggctcatcctctctgggaccctgggtcagctccacttccttcctcttctcgcctcggccccgccggcctctgaagccggggccccgcggcggaggctgctcgtcctcctcggactccgaggcgaagtcgtactcgcggagcctgcggtcctcagctccgggccggggcctccccgccgccagggagccgcacctgcccgcccgccgccccagccgccggtggcgcctgttcttctgctgcacgatcttcagaatgagctccttgccccaggcgccgccccgagccttcctcttcctggggtccttcctggggggcagccggcggcgccgggagctgcgggtctcctcggggagggcggcggctctcgggacccggggcgcggggtctgcgcggctcccgggggcctgcgttctagggcgccggggacggggtgggggccgctccccgagaccgtcgttcctccggggcctcaggccggaggctctgccgccgccgcccgaccccgacccctctgctgcgccgcccgagtccagatccttccggaacagcttcaactgcttccccctcctctgctgcctgccctggctgggcgcatccgcctcggtgggggccagacccagggaacgcgttttgggcctgcctcgggctgggcagcccctgtccccagggcggggggtttgggggtccggcgtggctgctgggagcgggggcggagctttgctctctggagtcacccccgccttgctcttaagggggtgtccggagctgggacctctggggccggaaggctcctcgtccgcgaagacgtcgatgaagctgctgtcgatctccgggttgtccgactggtactccatgccgttgagcgcctctgtgatgaggctgtccagcttggcgtcatcctccatgtccagaagatcgtcggctacgctcactgttctgcacctgacctttttttcatgtaacaacatatcctgtagataatcccacaacattccgtgaagaggtttctcactctctgtcc

SEQ ID NO: 1342 - DNA, 598 bp, Homo sapiens
acagtacacgtgggggacggcagcgccacgcaggccgtggggacgcagtgtccttctctgacagcagcatcagggctcaggcaggccgggaggatgcatcacagctggcggccttggacggggcagtggctcccccggcctgaggagtgccgccccttgtggccacgctgcccagcaggccggctccttccctctcgggcgccagcagcagctcctactccttctcacgagtccacttgatcatggtctccggtgagcggtagaggaagatgagcttggcgtacaactcctcctccagctccagctcccgagtctcccgcaccaggaagatgtcctggcagagcttgaggatgcggtccacgcacggcagctcctcgaacataatggagtgcgagatctcgctgaagaatccgcgcacgaacttgccgatgaccagcacgatggacacgtacagccccatgatgctgcgggggaagctggttgcagtcggtccggcactcctgcagctcgatgacccaccattcgaggaagccggtggcccccgcaccctgctccctccgcagctggatacgcacgccgaggtagtcggcctcctcat

SEQ ID NO: 1343 - DNA, 301 bp, Homo sapiens
gcagtctaaagcctgggccccattcctagtctttttcccgttggatttgacgaattctgttagacttggtcaaatctgaagcaaacttccaagttgtgggaaacaagcctctgaattagctgaattcccacagctgggaaaaaggaaaaaaagccagaaaaagggaaaaaagattttgaccacgtgatgggctttatttgcataacgaggccacgtttttccagccaagccacactcgaagagtaagtgccgtcacctcacgctgcagttcggtaggtagagtccgccatttttccaccag

SEQ ID NO: 1344 - DNA, 5303 bp, Homo sapiens
ctcggatgaagtgagcagcattcccaggaggcgggacgttggacgctatttttattttaacatctcatattgccccaggttctctgagtcaacaccctcaaaggggacagacagaaacagaaaggaacttttgggctgattataaggattcagctggccttgggaaaagtctaaacatctttgaaacacaattggaaagtaatccaaacagcctgtgagctcaggcttcccagttagaactgcctgtcccaagttaatcttgcttagttttttggggggcatcatacctaaagaagaagaagaagaaaaaaggcaagaataagtaaaaggaaaaaaaagaaaaagaaaggcaggcaagaatttttgtccctgtcgggagaagagtctggtctgtggacaccagacacctaagcaagtttcttggaagggaggctttggcaaccctcgcaattcgcattcacaggagacatgccctattttccacaacaggcagcctcgccaccagccccaggagggaggaagctctcttctcagtgtctgcaggtttatccctaaatgctacggaagcagcagctgccaggggaaggggatactgctcagtcttttaaaactctcgtgtaagcttgatattacagtcatgacctaaaaaggcaaagaccagatatgcggagctcgctgcggatgtagcctgcacacggccgcaggatttgtcaccactcatccatgtttaaaaaagccagtccaggcaagacagccacaggctcccgcccacaagtgatcacgaacacacttcacactgccttatggcagagcaagtgcatatagcccggtcttgtgtgaccttcacagccaatattcattataatcccctctcaccaatattgaaaatggatgctcaggggatcagtgactcgcctggtgtcaaagtgccaggtccaaatcaagacctgcagatcaagtcttctgtggatgcttccaatcccaggctgctttcatttctgatggacacgtccttcatgtcccacagatccatggatcgccggcatcttccctcctgttcacataggtgagaaggaaggagctggcaggcaatgcccttccaggtgggctacagggaaggttcttttctcattaggttgatcccttggcttccctagtaaagtggggagctgttgaaaagaaagaatggaaacgaggtaatgatcctggagcctaatggaagggccgcagccagttttcccctgttgaaaggacacaggacttcccgaagagttttcatggcaaaaacgtccaaccagctactaaggaaacaggatggactcatgcgtgcaggagagaaatcactaaaggacacaagacttcccaaagagttttcatggcaaaacgtccatccagctactaaggaaacaggatggactcatgcgtgcaggagagaaatcacttggccgtcactggaagagcaggctgtgatgggaacggtaaggacagagaagggaaggttcacaggatagaaattcacagggcaagtagggttccaagtcagaagcaaaacactttacacaacattacagacaggctccactgcaactgggcaggtcaggactgggctcagtcggccacattctgctcccacgcgttgcttccttagactgtcagggaagggagaagggcagccaccaggagcggccagggtcacggacttgctacttctttcctagagtctgttctgttttctgtcagcagtaaggaaatacattctagcaaatgacatccagtaatgctttaattaactgcagtattttgtgctccaacatgcaggcagaaatcacttccagatggagaaaatgaaagctatttacacaaagaagcaatccctttattttaaggaaatttatatctcccaaaggtgtagaacttcgagggtccaagaggctattctgatgaatactaaaacaggactgggaatttttatttaatatataaaatgtcatcgtacccttcatgtaggccagcatttcaggtgtccatgtttctaaggcttttgcttaaattgcccattggagctctattttatttttaggaatctgacttggagtagacgagaagtgtgagacacttgctgtcaccctcaagcaggcaggttgttctgagtgctcttcctagcgaaggaatcccatttccagcaggttattccgagtgctcttcctagcgaaggaatcccatttccagcaggttattccgagtgctcttcctagggaaggaatctcatttccagcaggttattccgagtgctcttcctagggaaggaatcccatttccagcaggttattccgagtgctcttcctagcgaaggaatcccatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagggaaggaatctcatttccagcaggttattccgagtgctcttcctagcgaaggaatcccatttccagcaggttattccgagtgctcttcctagcgaaggaatcccatttccagcaggttattccgagtgctcttcctagcgaaggaaccccatttccagcaggttattccgagtgctcttcctagggaaggaaccccatttccagcaggttattctgagtgctcttcctagccaaggaatcccatttccagcaggttattctgagtgctcttcctagggaaggaaccccatttccagcaggttattccgagtgctcttcctagagaaggaaccccatttccagctgtgcacatgcagcatttcccctggcattctttcaacagggaaccaggtctcctcatccgatggcaattcaggaagggttggtgtcataccctgcatcgagcagcagcctcggacctgcccccacgctctgcgtgccctgtactggtcatgctggtctcagcttgtctgctctcagtcctgtctgatctgcacagaggagccaccctagacataagaaatcaggcaccccttctcgggggtgggcagagccctgggtactggctctttgttcttcgagagaggaaggagtggcggtagttagcttcaatccctgagctgggtttggagatcagaacaccttgtccattgcggctcctgtttcattgttaagagtccacacaggatgttctctggcctggacaccgctaagccagctttcagacaagtcccctcagtaagagcagagtgaactctttattgattatacaaattaccactatttattttaaacccaaagtgacttcaaagttgttttttggtttttaaaggggctacagaaaatggactgaggggaaggaatgggcacaatatctaggtctagctgaatcacagagctgttagctgctgctttcatccacaggtactccttttaccttattattttttagagagtcttgctccgtcacccaggcaggagtgcaatggcatgatctcggctcactgcagcctctgcctcctgggttcaagcgatcctcctgcttcagcctcctgagtagctgggattacaggcgcccaccaccacgcctggctaattttgtatttttagtaaagacagggtttcaccatgtcggccaggctggtctcgaactcctgacctcacatgatccacctgcctcggcctcccaaagtgctgggattaccagtgtgagccaccatgcccggcctattttttaatagagatggggtctcactctgttgcccaggcttgtcttgaagtcctgggctcaagcaatcttcccacctcagcctctcaaagcactggcattacaggtgtgatgccacagtacccggcctagggtgcccctttgatacgttatttttgaagtgatgttaataaataaagcttctgcttgggggttggtcatcaaaacaagaagaatcctcatcagtatggagagagcccaatcctgggcatggtccccaccaccaccaaaagtcttttttttttaactgagtctcactctgtctcccaggctggagtgcagtggcgggacctcggctcactgcaacctccgcctcccggattcaactgattcccctgcctcagcctcccaagtagctgggattacaggcacccgccacctgcctgctttttttttttttttttttgtatttttagtagagatgggattttgccatgttggccaggctggtctcaaactcgtgacctcatgtgatccgcccacctcggcctcccaaagtgctgggattacaggcgtgagccaccgcgcctgacccaacacaagtttaaaatgaaagctgttatcagtagagaatcttcaccacgttggcaccagctcaagtgtagtgtcggcgcacttttagcttagagtcagaaaaatagacatgtatgaaaatgcgtggcaggagcccttccataaagcaaatctctctgttgcagtggttcttaacaaggtgtaaacgttataactacctatggaacttttaaacctgtatgccaggccccatccaaacttactgactcaaaatctccgggcatctgtttttttgtttgttttgagatagagtctcactctgtcgccaggctggagtgcagtggcgtgatctcggctcactgcaatctttgcctcccgggttcaagcgattctcctgcctcagcctcccaagtagctgggaggtgtgcacgccaccacaccccggtaatttttgtattttttgtagagatggggtttcaccatattggcaaggatggtctcaatttcctgcgcttgtgatccgcccgcctcagcctccccaagtgctgggattccaggcgtgagccacggcgcccggccggcatctgtagattttaaaaggccccagtggttctgatgcacacccccagaagagaaacacagcgtctctacacagtactgagtccccatcaaggagacatttaacagaaactcctactgacatccattggttccttggggattactgacaatgtaacaaatcaagacagcaacttccctggctgtgaccaccaactgtggaaaacagcagcttgatagctcaatgctgtgatggagccgtccggaaaacgactcctcaacaatgaaccaaaaagagaagtg

SEQ ID NO: 1345 - DNA, 248 bp, Homo sapiens
cccctctatattccccgttttttattgttgctgttgcccaggatggagtgcaatggcgcaatctcggctcaccgcaacctcggcctcccgggttcaagtgattctcctgcctccgcctcccaagtagctgggattacaggcacccaccacccccggctaattttgtatttttactacagacggggtttctccatgttggtcaggctggtctcgaacttctgacttcaggtgatccacccgcctcgccc

SEQ ID NO: 1346 - DNA, 1128 bp, Homo sapiens
gaactggctctctcaagggagcttggattgaactaggtagggagtctggggtcttgggaagacccctgtgatctcgaaaacatgatgactgattcatagaaaggaaggcctggtcagtgcactggttggggaataacagagggaagcggtaataaggagagcttgggacaggacagcagtgggtgcaattttaacagagaaatgttaaacggcagagggtctgtcttaccagcatgggtggaatgtgctgctcctccagccaagtggggctgtgaagaacaaaaagggggctataagtgcagaggggacatgtccatccatattgcttctttaataatctctcccgacctcctttctgtcattaggagctacaatgtccaccagccagtgggaaattaaccgcagactagggcctattgctatatgggtttatggtagtttaatccagttaagaccacatccagttagtttccattttctcctctactcacgtgggcctttgattaaggttcttccagaagacatctccataacgctggggcatgggtctgaggctctgggaaggcaaccttgggggtggagatcggctgaccaccctggaacacctgaggtgaggacaaggtgatctcacccagtaccatgctgtcaataagctgatgactcccaaatctatatatccagccctggttcctctctgggctccactcaacatctcctccccaaccttcctcctctcaatgaaaagcactcaaatgcccagttgctaagaccaaaaacatggtatgtctcactttccctcacctcccacatctaatccatcagcagttcctgtcagttttacatctaaaatactgtgtacctgaatttgaccactcctcatcattcccactcctaccaccatatatttcaggtcatcttccccttcctggactgttgcaatggtctcttccccccgtctctgcttccattcccatcccccaacaatatattctgcacagaactgtgagagatgatcatacgaaataatataaggtttgagatgtacttcaaaagaatttgagaaatagggggctagatgggtatagagatgaaaagattatccatacaatgataattattgaagctgac

SEQ ID NO: 1347 - DNA, 375 bp, Homo sapiens
ctcctgatctgcacaaaaatgactgtaggacccacttgcaaaacaaacacagaaaagaataaccactaattgtgaaacgtgatctagctccgatgccgcttaccttcccagaagctcttgttgcaacatgtgcatgtgaagatggtgcaaatattggcaactgctccccttccctcagcatgggcggggccgggggtgcagaatacatttctgaggatacttgaagtagcctaaatgtaagatgcctccactgggagggccctggtagctggatttcccaggatgtttttctttctactgggtctccctctggttggaaggcacatagctcttaagagagcctccctttcagactgaccactctatgcccctgcc

SEQ ID NO: 1348 - DNA, 3680 bp, Homo sapiens
cttggctcaccgcaacctccacctcccaggttcaagtgattctcctgccctagcctcgcaagtacctgggactacaggcgtgccccaccatgcctggctaatttttgttatttttagtagagacggggttttagtatgttggctgggcatagtaactcctcatgatcaactcgtgacctcgtgatctgcccaccttggcttcccaaagtgctggattacaggtacgagccaccgcacctggcctacactcattactttcacagggttttttcccacatttaaacttgtcactcgactaggaagtcaagattgaaatggctctttccatgaataatttagttttggggttgttgccaaagtgatttataatgattttaataatgatagacatcccttaaaacattctcaagtaattagacccctggggctggtgcagtggctcatgccggtaatcccaaccctttgggaggctgaggagggaggagtgcttgagcccaagagttcaagtccagcctgggcaacatagtgagacctcatctctttgtatgttaaaaaataaataatttaaaaaattgtatcgttgggaccatattctagtgtcagttctgagacagaaaaaaaaaaggtgattatgtccaagagcttttggcttttccacttgattatacttacgtttgaaaaatccagtaggtattttctctgctttcccaccttcccatggtttttttctaataaaactcatttgtagtgcaataagatgtggtctccatcagacttttcctagttttactgcattcattaggtttctgctacctattagaataggtcctgtttgtagactcttacagtcttcaaattcctttccaatgtgaagtttctggtgcttaagaaaagctgtccacccactgaaggccttaccacagttgctacattcaaagggtttctctctggtatgaattctttgatgactgacaaggtgtgagttctgactgaaggccttccaacattcagggcattcatagggtttctctccagtatgaacacgatggtgtctaataagatctgagctgcccctaaaagatttcccacatttgttgcatacataaggtttttctccactgtgaattctatgatgtctcagaaggtctgagctctgattgaaagttttcccacattctttacattcatatggtttctctcctgtatgagttacctgatgtccgatgaggtctgagctgccctggaaagccctaccacactgattacaccaataagctttctcttcttggtgaattttctgctctcccctaagctcctcatccttgctgaaggttttctcacattcttcaagtttctctccagcatgcagtctctgatgtttgaggaaagccgtgtgccacatgaagagtttcccacattccttacattcatagggtttctcaccactatgaagtctccgatgttgaataaggagggaacgccgcctgaaggcattcccacattcactgcactgatagggtttctctccagtatggattttctggtgtgtagcaaggtgtgacctctggctgaaggctttcccacattcactacattcatagggtttctctccagtatgaatacgatggtgtttaataagatctgagctacccctaaaagatttcccacatttgttgcatacataaggtttttctccactgtgaattctatgatgtctcagaaggtctgagctctgattgaaagttttcccacattctttgcattcatatggtttctctcttgtatgagttacctgatgtctgatgaggtctgagctgccctggaaagccctaccacactgattacaccaataagctttcgcttcctggtgaattttctgctctcccctaagctcctcatcctggctgaaggttttctcacattcaagtttctctccagtatgcaggctctgatgtttgaggaaagctgtgcgccaaatgaagagcttcccacattccttacattcatagggtttctcaccactatgaattctccgatgttgaataaggagtgaacgccgcctgaaggctttcccacattcagtgcactgatagggcttctctccagtatggattttctggtgtgtaacaaggtgtgacctctggctaaaggctttcccacattcactacattcatagggtttctctccagtatgaacacgatggtgtctaataagatctgagctgcccctaaaagatttcccacatttgctacatacacaaggtttttctccactgtgaattctatgatgtctcagaaggtctgagctctgattgaaagttttcccacattctttacattcatatggtttctctcctgtatgagttacctgatgtctgatgaggtctgaggtgccctggaaattcctaccacactgattacaccaataagctttctcttcctggtgaattctctgctcttccctaagctcctcatccttgctgaaggttttctcacattcttcaattttctctccagcatgcaatctctgatgtttaagaaaagctgtgcgcccactgaaggtcttcccacatctgtgacattcatagggtttctctccactgtggagtctctggtgttcagtaaggtgagaatgctgcctgaaggctttttcacattcattacatttgaggggtttctctccagtgtgaattctctgatgtgggacaaggtgtgaactttgactgaacatctgtccacagtcataacattcatagggtttctctccagtgtgaattctgtgatgtataataagatctgtgctttgactgaaagccttcccacatttattgcataaatatggcttccccctactgtggattctctggtgcaggacaaggtttgagcttcccttaaaagccttcccacactctttgcactcatagggattcccaccactgtgaatttgcttatgtctcaccagattggagctctgattgaagtcttttccacattcatgacatatataaggtttctttcctgtatgaattctctgatgtataataagatttgaactttgattagagtctttcccacattcattacacacatatggcttatttcctgtatgaattctctgatgtatgatcaggtttgaactcctgttgaaggttttttcacattccttacattcataggtcttatttatattatgaattttctgatgttcagttaatcctgacttctgtttgaagttttggccactaacctcatatctatgggagctttctcctgcagaaagtattttttctccttcattacatccatggccaatctctcccacaatggctttctgggggataatatgcatttccctgataccgctctcttgggaagggagatgtctcattgcatcctttaaagggcttacccagtgcttcaataatctgtcctcagaattactggtttcaactaactcacattcctgggtgatttgtctttggagtttttcggatgcagcccttgctgacttcttttcttcagaaatttccatctttgatttccattccttcatcttattcctgtcttcagaatctgaaatgataagtagatcattctataattcctaaaatacaaatatcatctcttcattatactgggcagtctaagagggaggaacaaagaactcagaagacctttcc

SEQ ID NO: 1349 - DNA, 576 bp, Homo sapiens
ccaatgcctgtgggatgtaagaaaaagattctgggtccaactccagctccaggcacccaagggcaagctctgcctggagggaaagttgggcttatctgccaggccaggtgaggaggggctggaaagcaggaaagaagctagctgaactcattctgagtcaagaggaaacagacgtgagccaccctggaaggctgtaagggacgctttttttttttttttttttgagacagaatttcactcttgttgcccaggctggagtgcaatggcaagatctcggctcactgcaacctccgcctcccgggttcaagcgattctcctgcctcagcctcccgtgtagctgggactacaggatgatggattcacacctgcctcggccatgcaccccatcacaaaaccagaagcctaggagtgctcctgtcatcttgatttttctctcacatcagtgattccaaaataaggacttaacctgtgtgcttctcttcttctcgctgtccccacccaccagagtctcccacctggactgttaccattgcctcctaactgaccttcctacttgcatgcctgtcatcatctgcc

SEQ ID NO: 1350 - DNA, 1399 bp, Homo sapiens
ggggacaggcagggggtgggtggggtaggagtgagaacaccactgggccagtgagttctaacagcacaagtggagaacaagacaagagtctgcatcagaaacgggatccagaagttcaccgggagctctgccacaaggcatttatgtacaacggagctgggctgggggtgacgccccgtgagggaggcaagaactgcacagcagcacgggcaagctgccctgggccctagcccgctgccgcaccccacgtgccctcagttctcctcgtcactgtcatccgggctgatagccgggcttgtgagactgtaggtggggctggtgggcgagtacttgggggaagtgggcgagtaagtggggctagtaggtgagtacttgggagaggttggggtgtagactggagaggttggggaataagtaggagatgttggggagtattttggggtggtgggtgaataggtgggactggtaggcgagtacttgggagaggtgggtgaatatttgggactggtaggtgagtacttgggagaggttggggtatactctggggagctgggactgtaagaaggactggttggggtgtacttgtgggtgaggttgggctgtagctgggcgagctggggctgtagctgggtgagcttggggtataggttggagactgtggtgtgtatcgtgggctggaaggggagtaacttggtgaggtcggggaatagctgggtgatgttggagagtagcttggagaggttgggctgtagttagggctggtaggtgtgtagttgggactagtaggtgaatagctgggtgatgtcgggctgtagctgggtgatgttggggtgtaattgggactggttggagaatagttcgggctggtgggtgagtaacttggggaagtgggtgagtagctgggggaggtgggtgaatagcttggagaggtaggtgagtagctgggagaagtgggagaatagctgggtgaagttggcgagtagctgggagatgtcggcgagtagctgggagacgttggcgagtagctaggggaagtgggcgagtagctaggggaagtgggtgagtagctgggagaggtgggcgagtagctgggagaggtgggcgagtagctgggagaggtgggtgagtagctgggagaggtcggtgagtagctgggtgacgttggcgaatagctgggtgatgtgggactatagttgggactggttggagaataggatggagaggtaggggagtaggagggtgaagtgggggaataagagggactctggggtgtgtagcccccaggagagcggggctcgtaggcaggtgacgttggcgagtagctgggagacatggcaccacctgtggggaagcagccaacaaaggagatgagcaatggacagactcacccagaactgtg

SEQ ID NO: 1351 - DNA, 7137 bp, Homo sapiens
gagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaagaaagtttgacttcctgtcttcctatttgaatagcttttctttctttctcttgcctgattgccttggtgagaatttctaatactgtgttgaataggagtggtgagagagggcatctttgtcttgtgtcagttttcaagggaatgcttccaggttttcaggtactcaggcaacaaatagcgttacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcacgaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaagattaatcaagaaaagaagagagaagctccaaataagctgtattagaaatgaaatgggagatattaccactgataccacagaaatacaaaagattattcaagactactatgaacatcttcacatccataaactagaaaacctacaggagatcgataaattcctggaaatatacaaccctcctggattaaatcaggaagatatagaaactctgaacagaccaatcagaagcagcaagattgaaaatggtaatttaaaaattgccaacaacaaaaaagtccaggaccagatggattcacacctgaattctatcagacattcaaagaattggtacccttcctattaacactatttcacaggatagagaaagagaaatcttccctaaatcatttgatgaaaccaaaatcaccatgatatgttttggctctgtgtccccacccaaatctcatcttttagctcccataattcccacatgttgtgagaaggacccagtaggagatgattgaatcatgagggcaggtcttttccatgctgttctcatgacagtgagtgagtgtcacaagatctgatggttttaaaaacaggactttctctacacaagctctttctttttgcctgctgccatccacgtaggatgtgacttgctcttccttgactccaccatgactttgaggcctccccaaatatgtggaactgtaagtcaaataaacctctttcttttgtaaattgccccgtctcaggtatgtctttatcagcagtgtgaaaatggactaatacacaccctaatactgaaacagactaatagacaccctaataccaaaagcaaggaaggacataatgagaaaagaaagctacagaccaacatccctgatgagcagagatgcagtaatcctcaaaaaaatactagctagctgaatctaacaacatatcaaaaagataatccatcatgatcaagtgggtttcataccagggatgcagggatggtttaacatctacaagtcaataaatgcgatacactacataaacagaattaaaaaacaaaagtcacatgatcatctcaatagatgcagaaaaaccacttgagaaaatccagcatccttattttattaagaccctcagcaaaatcagcatagaagggacatacattaaggtaataaaagccatctatgacaaacccacagccagcattatactgaacagggaaaagttgaaagcattcctcctgaaaactggaagaagacaagattgcccactttctccacttctattcaacatggtactggaagttctagccagagcaatcagacgagagaaagaaatcaagggcatccaaagtggtaaagaagaagtctgcctattgctgtttcccaatgatatgattgtatacctagaaaaccctaaagactcatccaaaaagcttctagaactggtaaatgcattcagcaaagtttcagggtacagagttacacacaagtgtgcacaaatccgtagctgtgctatacaccttcagcgaccaagccaagaatcaaaccaataactcaaccctttttacaatagctacaaataataataataacaataaaatacttaggaatattcctaaccaaggaggtgaaagatctctgcatggaaaactacaaaacactactgaaagaaatcacagatgacacaaacaaatggcagcacatcccatgctcatggatgggtagaatcaatattgtgaaaatgaccatactgccaaaagcaatctacaaatttaatccaattcccatcaaaataccaccatcattctttacaaaatgatgaaaaataatcccaaaattcatatggaaccaaaaaagagcctacatagccaaaagaagactaaccaaaaagaataaatctggtgacatcacattacctaacttcaaactattctgtaacaccatagtcactaaaacagcatgatactggtataaaaataggcacatagaccaatggaacagcatagagaacccagaattaaagccaaatacttacagccagctgatcttcaacaaagtgaggaaaggacaccctattcaacacatagtgctgggataattggctagccacatttaggagaatgaaactggatccttatctctcaccttatacaaaaatcaactcaagatggatcaagaacttaagacctgaagccttaaaaattctagaagataacattggaaaaacccttctagacattggcttaggcaaagacttcatgaccaagaagctcaaaacaaatgcaacaaaaacaaaagataaatagatgggacttaactaaactaaaaagcttttgcacagcaaaagaaataattagcagagttaacagacaacacacagagtgggagaaaatcttcacaacctacacatccaacaaaggactaatattcagaatctacaaagaactcaaatcagtaagaaaaaaaccaatcccataaaaaagtgggctaaggacacgaatagacaattctcaaaagaaaatatacaaatggccaacaagcatatggaaaaatgctcaacatccctaatgatcagggaaatgcaaatcaaaaccacaacgcgatatcacctcattcctataagaatggcaatattaaaaaaattaaaaaataatagatgtcagcatggatgtggtggaaagggaacacttttatagtgttgatactaatgtaaactagtacaaccactatggaaaacggtgtggagattgcttaaagaactaaaagtagatctaccatttgatccaacaaccccattcctcagtatctacccagaggaaaagaagtcattatacaaaaaagatacttgtacacatgtttatagcagcaaaattcataattgtgaaaatatggaaccagcccaaatgcccatcaatcaatgagtggataaagaaaacgtgatatgtacacacacaccccatggaatactactcagccataaaaaggagcaaactggatggaattggagaccattcttctaattgcagcaacctggatggaattggagaccattcttctaagtgaagtagctcaagaatggaaaaccaaacatcatatgttctcatatgtgggaactaagctatgagaatgtaaaggcagaagaatgatacaggggactttggggactcagcggaaatggtgggaagggagtgagaaataaaagactacacattgagtacagtgtacactgctcgggtgagggatgcaccaaaatctcaaaaatcaccactaaagaacttatttatataaccaaacaccacctgttccttaaaaacctattgaaataaaaagtaaatttaaaaaaacctcctggattcattgatttttttgaaggtttttttgtgtctctatttcagttcagccctgatcttggttatttcttgtcttctgctagcttgggagtttgtttcctcttggttctctagtcattttagttgtaatattaggttgttaacttgagatctttctctctttttgatgtgggcatttaatgctataaattttcctcttaacactgctttagctgagtcctggagattctgttatgttgtctctttgttctaattagttttaaaacacttcttgatctctgccataattttattatttaccccaaagtcattcaggagcagattgttcaatttccatatagttgtgtggttttaagtgaatttcttaatcttgagttctaatttgattttgctgtggtctgagagactctttgttatgatttcagttatttttcatttgctgaggagtgtttttcttcctaatttatgattagttttagggtaagtgtcatgtggctatgagaagaatgtatattcgcttgttttttgttggagagttctgtagataactatcatgtctacttgatccacagctgagttcaggtcctgaatatctttgttaattttctgtctccatgatgtgtctaatattgtcattgtggtgttaaagtctcccactattattgtgtgggagtctaagtctctttgaaggtctccaataacttgctttatggacctgggtgctcttgtatagggtgcatatatatttaggatagttaactcttctggttgaattgaaccctttaccaacaggtagtgctcttctttctcttttttgatctttgttaatttaaagtctgttttgttagaaactaggattgcaagctctgtttttttctgctttctgtttgcttggtaaattttcctccatccctttatttttagcctatgtgtttctttgtgtgtgagatgggtctcttgaatacagcatactgatgggtcttggttctttatctagcttgccattctgtgtctttcattggagaacacattgagatttaagaaagatcgtcttcaagctctgagattcttttcttggcctattctgctgttagtaattgtgatttcattgtgaagttcttgtagtgtgtttttcagctctaacaggtgagttatgtttttctctagaccggctattttggctgtccgctcctgtactgttttgtcatgattcttagtttctttgcattgggttacaagatgctcctttaggtcattgaagttcactgttattcacattctgaagcctactctgtcatttcagccatctcaggctcaacccagttctgagcccttgctggagaggtgttgcagggatactctggctttttgagtcctcaggattttggggttatttctcatctctgtgggtctatcttaaactttgaccttgaggatggggtttttgtggctttttaaattgttattgttgttgtttcctgcttgtttttcttttaacagtctggccactcttctgcagggctgctgcagtttgctgggggttcgcactataccctagttgcctcggtttttcccatagctggaggtatcatcagtgaagtctgtgaaacagcaaagatggctgcctgccacttcctctggaagctccatcccagcagggtactgacctattgctggctcgaaagtgcctgtaggaggtggctggataccccagttgggaggtctcctccagtcaggagaaatgggataagggacctgcttaaagaatgattctggctactttttggtagaccagctgtgctgtgttggggatccctttagttcccattcagtttgggctgtccaaaggcccacaggctgaactggctgagaagcttgaaaggcctaggtggcagcctgccccacccctcaggcactccatcccgggaagaaattagagctctgttagccccatagaacatgagtgacctacaattttgatttgcccttttactggtgatgttggcattgatcacaaacagtggtgtctgctagctttctcctctgtaatgttactttttcaccttgtaattaattaatattaatattttgtggggaggtaatttgagactatgtagatatctctgttcttcatcaaactcaatttattcatttacttgatttgatatttacttgtgg

SEQ ID NO: 1352 - DNA, 6660 bp, Homo sapiens
gagcatatgtttttccatttgtttgtgtcatctctgatttctttgaataatggtttatagttatccttgaaaaggtccttcacttttcttgttagctgtattcctaggtattatactcttcttgtggcaattgtgaatgggagttaattcatgatttttctctcggcttgcctgttgttggtgtataggaatgctagtgacttttgcacattgattttgtatcctgagactttgttgaagttgcttatcagctaagaagtttttgagctgagatgatggagttttctagatataggatcatatcatctgcaaagaaagtttgacttcctgtcttcctatttgaatagcttttctttctttctcttgcctgattgccttggtgagaatttctaatactgtgttgaataggagtggtgagagagggcatctttgtcttgtgtcagttttcaagggaatgcttccaggttttcaggtactcaggcaacaaatagcgttacgaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttggcaacacaataatagtgggggatgttaatactccgctggcagcacgaggcagatcaccaagacagaaagtcaacaaagaaacaatggacttaaactataccctagaacaaatggacttaacagatacttacagaacattctacccaacaagcatagaatatacattgtatacatcagaacacgggacattctccaaaatagaccatatgatagggcacaaaacaagtctcagtaaatttaagaaaatcagaattatatcaagtactctctcagaccacagtggaataaaattggaaattaattccaaaaggaacactcaaaagcatgcaaatacatggtaattaaataacctactcctgaatgattgttgggtcaacaatgatatcaagagggaaatttaaaaattctttgaactgaacgataatagtgacacaacctatcaaaaactctgggatacagcaaaagtggagctaagaagaaaattcatagcattaaatgcctatatcaaaaagtctgaaagagcacaaataaacaatctaaggtcacacctcacagaattggagaaactagaacagtccaaatccaaacccagcagaagaaaagaaataacaaaatcagaacaaaactaaatgaaattgaaacaaaaaaatacaacagataaatgaaacaaaaagctggttctttgaaaagataaataaaattgataagcattagcaagattaatcaagaaaagaagagagaagctccaaataagctgtattagaaatgaaatgggagatattaccactgataccacagaaatacaaaagattattcaagactactatgaacatcttcacatccataaactagaaaacctacaggagatcgataaattcctggaaatatacaaccctcctggattaaatcaggaagatatagaaactctgaacagaccaatcagaagcagcaagattgaaaatggtaatttaaaaattgccaacaacaaaaaagtccaggaccagatggattcacacctgaattctatcagacattcaaagaattggtacccttcctattaacactatttcacaggatagagaaagagaaatcttccctaaatcatttgatgaaaccaaaatcaccatgatatgttttggctctgtgtccccacccaaatctcatcttttagctcccataattcccacatgttgtgagaaggacccagtaggagatgattgaatcatgagggcaggtcttttccatgctgttctcatgacagtgagtgagtgtcacaagatctgatggttttaaaaacaggactttctctacacaagctctttctttttgcctgctgccatccacgtaggatgtgacttgctcttccttgactccaccatgactttgaggcctccccaaatatgtggaactgtaagtcaaataaacctctttcttttgtaaattgccccgtctcaggtatgtctttatcagcagtgtgaaaatggactaatacacaccctaatactgaaacagactaatagacaccctaataccaaaagcaaggaaggacataatgagaaaagaaagctacagaccaacatccctgatgagcagagatgcagtaatcctcaaaaaaatactagctagctgaatctaacaacatatcaaaaagataatccatcatgatcaagtgggtttcataccagggatgcagggatggtttaacatctacaagtcaataaatgcgatacactacataaacagaattaaaaaacaaaagtcacatgatcatctcaatagatgcagaaaaaccacttgagaaaatccagcatccttattttattaagaccctcagcaaaatcagcatagaagggacatacattaaggtaataaaagccatctatgacaaacccacagccagcattatactgaacagggaaaagttgaaagcattcctcctgaaaactggaagaagacaagattgcccactttctccacttctattcaacatggtactggaagttctagccagagcaatcagacgagagaaagaaatcaagggcatccaaagtggtaaagaagaagtctgcctattgctgtttcccaatgatatgattgtatacctagaaaaccctaaagactcatccaaaaagcttctagaactggtaaatgcattcagcaaagtttcagggtacagagttacacacaagtgtgcacaaatccgtagctgtgctatacaccttcagcgaccaagccaagaatcaaaccaataactcaaccctttttacaatagctacaaataataataataacaataaaatacttaggaatattcctaaccaaggaggtgaaagatctctgcatggaaaactacaaaacactactgaaagaaatcacagatgacacaaacaaatggcagcacatcccatgctcatggatgggtagaatcaatattgtgaaaatgaccatactgccaaaagcaatctacaaatttaatccaattcccatcaaaataccaccatcattctttacaaaatgatgaaaaataatcccaaaattcatatggaaccaaaaaagagcctacatagccaaaagaagactaaccaaaaagaataaatctggtgacatcacattacctaacttcaaactattctgtaacaccatagtcactaaaacagcatgatactggtataaaaataggcacatagaccaatggaacagcatagagaacccagaattaaagccaaatacttacagccagctgatcttcaacaaagtgaggaaaggacaccctattcaacacatagtgctgggataattggctagccacatttaggagaatgaaactggatccttatctctcaccttatacaaaaatcaactcaagatggatcaagaacttaagacctgaagccttaaaaattctagaagataacattggaaaaacccttctagacattggcttaggcaaagacttcatgaccaagaagctcaaaacaaatgcaacaaaaacaaaagataaatagatgggacttaactaaactaaaaagcttttgcacagcaaaagaaataattagcagagttaacagacaacacacagagtgggagaaaatcttcacaacctacacatccaacaaaggactaatattcagaatctacaaagaactcaaatcagtaagaaaaaaaccaatcccataaaaaagtgggctaaggacacgaatagacaattctcaaaagaaaatatacaaatggccaacaagcatatggaaaaatgctcaacatccctaatgatcagggaaatgcaaatcaaaaccacaacgcgatatcacctcattcctataagaatggcaatattaaaaaaattaaaaaataatagatgtcagcatggatgtggtggaaagggaacacttttatagtgttgatactaatgtaaactagtacaaccactatggaaaacggtgtggagattgcttaaagaactaaaagtagatctaccatttgatccaacaaccccattcctcagtatctacccagaggaaaagaagtcattatacaaaaaagatacttgtacacatgtttatagcagcaaaattcataattgtgaaaatatggaaccagcccaaatgcccatcaatcaatgagtggataaagaaaacgtgatatgtacacacacaccccatggaatactactcagccataaaaaggagcaaactggatggaattggagaccattcttctaattgcagcaacctggatggaattggagaccattcttctaagtgaagtagctcaagaatggaaaaccaaacatcatatgttctcatatgtgggaactaagctatgagaatgtaaaggcagaagaatgatacaggggactttggggactcagcggaaatggtgggaagggagtgagaaataaaagactacacattgagtacagtgtacactgctcgggtgagggatgcaccaaaatctcaaaaatcaccactaaagaacttatttatataaccaaacaccacctgttccttaaaaacctattgaaataaaaagtaaatttaaaaaaacctcctggattcattgatttttttgaaggtttttttgtgtctctatttcagttcagccctgatcttggttatttcttgtcttctgctagcttgggagtttgtttcctcttggttctctagtcattttagttgtaatattaggttgttaacttgagatctttctctctttttgatgtgggcatttaatgctataaattttcctcttaacactgctttagctgagtcctggagattctgttatgttgtctctttgttctaattagttttaaaacacttcttgatctctgccataattttattatttaccccaaagtcattcaggagcagattgttcaatttccatatagttgtgtggttttaagtgaatttcttaatcttgagttctaatttgattttgctgtggtctgagagactctttgttatgatttcagttatttttcatttgctgaggagtgtttttcttcctaatttatgattagttttagggtaagtgtcatgtggctatgagaagaatgtatattcgcttgttttttgttggagagttctgtagataactatcatgtctacttgatccacagctgagttcaggtcctgaatatctttgttaattttctgtctccatgatgtgtctaatattgtcattgtggtgttaaagtctcccactattattgtgtgggagtctaagtctctttgaaggtctccaataacttgctttatggacctgggtgctcttgtatagggtgcatatatatttaggatagttaactcttctggttgaattgaaccctttaccaacaggtagtgctcttctttctcttttttgatctttgttaatttaaagtctgttttgttagaaactaggattgcaagctctgtttttttctgctttctgtttgcttggtaaattttcctccatccctttatttttagcctatgtgtttctttgtgtgtgagatgggtctcttgaatacagcatactgatgggtcttggttctttatctagcttgccattctgtgtctttcattggagaacacattgagatttaagggctgctgcagtttgctgggggttcgcactataccctagttgcctcggtttttcccatagctggaggtatcatcagtgaagtctgtgaaacagcaaagatggctgcctgccacttcctctggaagctccatcccagcagggtactgacctattgctggctcgaaagtgcctgtaggaggtggctggataccccagttgggaggtctcctccagtcaggagaaatgggataagggacctgcttaaagaatgattctggctactttttggtagaccagctgtgctgtgttggggatccctttagttcccattcagtttgggctgtccaaaggcccacaggctgaactggctgagaagcttgaaaggcctaggtggcagcctgccccacccctcaggcactccatcccgggaagaaattagagctctgttagccccatagaacatgagtgacctacaattttgatttgcccttttactggtgatgttggcattgatcacaaacagtggtgtctgctagctttctcctctgtaatgttactttttcaccttgtaattaattaatattaatattttgtggggaggtaatttgagactatgtagatatctctgttcttcatcaaactcaatttattcatttacttgatttgatatttacttgtgg

SEQ ID NO: 1353 - DNA, 243 bp, Homo sapiens
attccattccattccattccattccacaccattccattccattccactgcactcgggttgattccattccatttcattgcattccattttattccattccattccactccattccattcctttgcactcgcgttgattccattccattccattccattccattccattccattccattacactcaggttgattccattccattccattccattccattccactcaggttgtttctattcgatt

SEQ ID NO: 1354 - DNA, 504 bp, Homo sapiens
cctcagaaagggccaaatatccacttgcagattctacaaaaagtgtgtttcacacctgctccatccaaaggaatgttcagctctgtgagttaaactcaatcatcacaaagtattttctgagaatgcttctgtctagtttttctatgaagctattccctttactaccatagacctcaaagcgctccaaatctccacttgcacattccacaacaagagtgtttccaaactgctctctcaataggaatgttcaactctgtgaggtgaatgcaatcatcacaaagcagtttctgagaatgcttctatctagtatttaggtgaagatatttccttttccaccacaaaccacaaagccctccaaacgtccacttgcagattctagaaaaagagtgtttcatagctgctctttccaaaggaaagttcaactctgggagttgaatacaaacatcaccaaaatgttcctgagaatgcatctgtatagtttttatgtgaagatgattccgtttc

SEQ ID NO: 1355 - DNA, 604 bp, Homo sapiens
ccctgcctttggacacttcgaaaatttcctggtgcagaaggagggggaaactaaaattgactgggattaaactgagttatacaaaagctaatacctatttcctataccctgcagttgagggtggagtcattcctgctacacttgtgtcaagtactgtataatttatgatgtgaagccatggagtttgagtcaacccagatctgagtttgaattccagctgtgtgacccaagggcccccaaggcctggggataaacagcccacattctgcacattccctgctttgcagtacccctaagcaggcagcagatttatttggacctccagctctcagagacaactactgcctttcaggtaagagaatggtggtcctggctctgggggtttccagaaggcagaaccatactcagagggatttaagatagactgaaggagcatcttgctgatggggaggagaatgaggctctggagcaggttttgtctatgggtttggttcaagtttttctctttttttttttgtcttctgggatcatgagatgtacaggcctttcatgtcctaccatctctcctttggaggctgcagagtacaaagggcataggctttgg

SEQ ID NO: 1356 - DNA, 503 bp, Homo sapiens
agctaaaacagcggaagaggtgatttattatatggttgttacactcggccacaaataaacacagaaatagtccagaatgtcacaggtccagggcagaggaccaacatgggcattttgtttatgagcaagatccatcttacagcactgctgtgataacatggttccccatgatggctccgcagcttggcattcaaagccctagaagatctggctccaatttcctactctccctccttgtaatctacaggtactcatggcattcctcgaatactttcctgtgttttgcccttctcccatttcccttttgcaagtttagaatattgtccccaagatgtctgtccgatgctacacaatggcccttcaaagtcctattcaaatgggattgttctagtaacagcttcctgggtccaaactgaagtcattttcccctcttctatgcttcagaaacaatttatccctcctagtgcccacatccatttcttcttattaatgtagttattttt

SEQ ID NO: 1357 - DNA, 765 bp, Homo sapiens
gggctgactcacagtatggactcttttgaagtctaattcaatgtctttaattctgtcatagggatgagggagtgctgggaggttacagaggggaaattgtgtgtgattcttcgcaatgcctggagtccaggtgtagggcatggagttgggggtgccaagtattggcttttgaacctggagatggacatttgaccttcagcaaggaaatggttctcctcttagcattcgtggtgggtgctgttatgtgcttccttctccctctttgccccatgttggaggatagttgagtgctatagtcctggggtgagaatgattgtgccatgaagtttgtgcaactttaagaaattggtgtgagtgggccagagggaatgtgttgggtaggagaaggagataaagctgaaaaattagcttgaaccaggacttcgttgtaggcaggggaagccttagaaagttttttagcagggttgttatgtgatccaagccaggcttgggaaagctccagtgtcttaggggataaggagtgaatgggctacggggatgagggaagctaggcaggagctgcagcactgaacagaggcaagaaggtgacagtgaggatggacgggaagagggacatggtgatggaagaattggaagatcttaatagaccgtaggtgaggggaaccacatatctaactttgagattctgaacctaggagggaaagaagttggagtggggccagtgttgctgtgggcattgggtgggctccgtgaggaaagggatag

SEQ ID NO: 1358 - DNA, 862 bp, Homo sapiens
gttgtaagaaaataatttgaatcttatgagagattataagggaaactgatctatctagatgtcaaggaaggcttccagtaagaggatctttgatatactatctggaggataagtaggagtccagaggtgaagaagtggatgtatgagaaactgtacatgtaaaggccctttggcagaaggacaagaactgagaccaggccagtgtgactgaagagcagagcagacagggaagaaggccaggtgaaaatgggggagggactgaatcatgccagacattgcaggccatgtgaaggactttggtctttctctgaagagtgatgagaacccattcaaatggtttattcagatctggtgggttttgattagaggtggagacataatcagatttgtattttgagaagatccttttgccttctacgtggagaaccaataggaggaggctggagcagataggagctgcctgatgctgctgcagcagtctagggtacctagtgcacaaacctggcatacatcgctctcctccaagacccagcctgggagagcctacctcttgagagctgtctcaagctgaaggtaccaacatgatgccattgaacatgggacgtgatgtgcataatcagctcttgggaaccttcaggtgtgggctacagcacctcactggaccgctgggttcctagtagagtggaggaagtgttcacttagccacaactttgcttcaccctggaggccaactgaggcatgttagtataccctctccctgtagttctggagtgaggacattggaaagctaaacagtggtgcttgattcaaggtgcttgatctaatttctgtggcctttgtctgaagagggaggaataagaac

SEQ ID NO: 1359 - DNA, 1269 bp, Homo sapiens
tgtgtttgtgtctctatctttattattattattattttcctattatctgacttggcttgaagcccacattccttgatgctgctgtctgagaatctacaaggctcaccccagctggagcccagctcagaataccaggaatactaagtgactcggatacttgctgttgctgtgtccagtagagaaagaagagaggaggcctaaggggcacagagagaagtctagttactttggaccacttgagactcttctatgtggagttccattcaagagagactgagttcccgagttcttcattattgaagagaatgcttcttgatgctccttaaagcatgctgtatagtcagaaaccacatagctggaccagtcctacgcaaagaactagcggaccattaatctaagcctagagatcactggagctctgggcaatactgacctttgtttgttttgtttttaaagaaacagaaactactcttttagagtttagagcccacagagagactggatgtgagtatttttctatcgtccttcctgtcatgcattcagtaactaaatcaatcgtcaaatgtatattggtcacctactgtacatcaagttctcttttgggacctttgggggattcatacatggacaaggcatgactctccatccttaagacatcatgtgacatgtttgatcctctgctgatgtcacttgggaccaccttgcagatagactacttcattccttgtgactgagcctgcttgtgagacagcccagcccaagagaagcagccatatccttgtgcctgcaggaaccaacatcgtctgtgctaggttatgtgtttactcatttgcttacatcctccattcattcattcattttgtcagcccacaacatttactgagcattggctatgtaccagaaattgagaatttcatactcatatagagaaggggaaactgaggctctgagataaacatacacttcttcaaagtcccccaagaagcgagggaccaaaactagaatataaagtcaaatgcatcttatgcctaatcttactactggttgtttctcaacgggccatgcttgtaattacctggagagtcttatgcaaatacagacgtctgaaccccactccagaatcaattactgtctttagcactgggcccgggcctctgtgtttttttaaaactcactgccatccgccccacacacattgtctgactcaggatgcagcaagggagaggaatggaggctcttctgtaactggggctgaaactaaaggctgac

SEQ ID NO: 1360 - DNA, 901 bp, Homo sapiens
cttgtgtttgtgtctctatctttattattattattattttcctattatctgacttggcttgaagcccacattccttgatgctgctgtctgagaatctacaaggctcaccccagctggagcccagctcagaataccaggaatactaagtgactcggatacttgctgttgctgtgtccagtagagaaagaagagaggaggcctaaggggcacagagagaagtctagttactttggaccacttgagactcttctatgtggagttccattcaagagagactgagttcccgagttcttcattattgaagatcctctgctgatgtcacttgggaccaccttgcagatagactacttcattccttgtgactgagcctgcttgtgagacagcccagcccaagagaagcagccatatccttgtgcctgcaggaaccaacatcgtctgtgctaggttatgtgtttactcatttgcttacatcctccattcattcattcattttgtcagcccacaacatttactgagcattggctatgtaccagaaattgagaatttcatactcatatagagaaggggaaactgaggctctgagataaacatacacttcttcaaagtcccccaagaagcgagggaccaaaactagaatataaagtcaaatgcatcttatgcctaatcttactactggttgtttctcaacgggccatgcttgtaattacctggagagtcttatgcaaatacagacgtctgaaccccactccagaatcaattactgtctttagcactgggcccgggcctctgtgtttttttaaaactcactgccatccgccccacacacattgtctgactcaggatgcagcaagggagaggaatggaggctcttctgtaactggggctgaaactaaaggctgac

SEQ ID NO: 1361 - DNA, 1303 bp, Homo sapiens
tgtgtttgtgtctctatctttattattattattattttcctattatctgacttggcttgaagcccacattccttgatgctgctgtctgagaatctacaaggctcaccccagctggagcccagctcagaataccaggaatactaagtgactcggatacttgctgttgctgtgtccagtagagaaagaagagaggaggcctaaggggcacagagagaagtctagttactttggaccacttgagactcttctatgtggagttccattcaagagagactgagttcccgagttcttcattattgaagagaatgcttcttgatgctccttaaagcatgctgtatagtcagaaaccacatagctggaccagtcctacgcaaagaactagcggaccattaatctaagcctagagatcactggagctctgggcaatactgacctttgtttgttttgtttttaaagaaacagaaactactcttttagagtttagagcccacagagagactggatgtgagtatttttctatcgtccttcctgtcatgcattcagtaactaaatcaatcgtcaaatgtatattggtcacctactgtacatcaagttctcttttgggacctttgggggattcatacatggacaaggcatgactctccatccttaagacatcatgtgacatgtttggtaagtaaggtgtataatgttgatgacattgataatattaacttaacatttattagtctatagtttatagttgttcccaacattattcaacctttgaagactttgtttctttatctgtaaggaggaggtggtgataccattaatcccccatcccgcattgttgggaaaatcgcctgaggttacaaatgggaaagcacttagtaactgtaagaacgctgagcctggtggttattattattacttctgttgtttttctcagtctcggggaagaattattactaatgtcaacagaatcacagcttctatttacaggaagacaggccaagaatttcaatcccttgtccctctcccaattaaatcatggatgcagattgttctaaatccatcacaaggtctgggtctgaagatccaagtttgagtcccagctctgtataatcttatcaaagcctcttaatctttttgggttataatttttttttcacaaatacagatgaaataggtagattcgtaggtagaaaatgttctaattctgtgtttgtgtgtccttacatgtatatgggcatgtcctgacacaatcttgcatttccaaagagttcattccagcaaaagtcatcccttgcttcttccccac

SEQ ID NO: 1362 - DNA, 468 bp, Homo sapiens
gtctcagttaacgaggatttgggcaattttgtgctcccccccactgccatctccccaccccaattctttctcagctcattgattgattgattgggtgaaaggatcatggagaggatgccatccagttggagatatggtgtgagctgaaaatcccagagtaaatgtcctttccaggacagcagagacgaaaagagcttttctggctgggagattccaagaaggctttgtgaagaaggagcagcattaacccgagtttctcagtgggctcagacttacaggaagaaggtggtgttggaggaagactggagggggagccccctatctgaggtccccagactgtcttcagagaaagggaggagcagcctcagcttggcgtctggggccctgtttcatccttgggtccgtgagggaagaggattctgctccctgccagaaacattcctgtagagtatttgcattacatccggc

SEQ ID NO: 1363 - DNA, 1374 bp, Homo sapiens
ttttccccattatccttttactgctttagaattctttggtacaacatcattaatggggagagaggttctgtctcaagaattccaaccaaacatcctacatttcttctcaaacaggacttggctaattcacagtgcctgggtttgaggtggctaaagattctaggattggcaggcagatagagaggcaatctttttgtaaaatgcttcagagctcaaacatatgattgagaaagtctgtcagccaggagatacaaccaggataaaagcctacccttaaatcatacacataaggaggaataaggcaaaatagagcaatttcctttaaacccctcctctcactggtagcaactggcatgagccgcctgtgactttcagcacaataaacataaaatggccaagggtcacccatgacccatgagtgctcttctcccaacaacacagtcacctaaggacatgctgactaaacaagcaggcaggaagccactctcttctttccagtgacactctcacactttctaacaacttcaaaccaagacaggcctgaagttttcttgagaaaggaacaaggcttctgcctgacaacatacaagccagtgctgcacatctctgagtcttcattctctctcacttgactctgttcttggcacaaacaggctggaatttgccttaatagcagagatcaccagagcaagtccccatggacctgcctgtgggtatatcctttgagcagagaaacagcatttccaagatcatcatgaactgatgaatagagtcttttaaacttatcttttaagtaaagaagtaccttaatagcctcaacttaggcaactcaaatccacactcactaatcaatctgggttttatggtcaatttgtacaggcactaaaacaacaacaaaacaccttaaactttaaagcagatggcccctaaatagttctctcctttagttttgtttgagtaacctagggatctgaatattattaaccacatctggaagtatgtgtgtatgcacgtatgtatttttatgtgtaggggtacagacaagaaactgagtttcatgttaaaaactatattccttataaggtaatctgaaagagaataaggggaaaggggaatgaataaacaagtaatctgcgtttttaaagcggcacaataaaacaggatttaaaataaatttaatatgataaatattaatggatagtatagacttctaagaccctttcatccaattgccttctaaatcaatggataaataaatcagactttattcttatatatgctggtataatcagcaactgcagcattaaaacaaacctcttaagctgggtacagtggcacacacctgtagtcccagctacttgggaggctgaggtg

SEQ ID NO: 1364 - DNA, 292 bp, Homo sapiens
atgtggtattgctctgttgcccaggctagactaaagtcttttgtttttagagaaaatatatgtttcaccttgtttgttttagaaaagaaaaaaagctaaaaaaatcaaaaagctaagtattcatgtcaaaaagctaacaaagaaaactccaaaacaaacccaacaacaagccgctcccttcccctccaaaaaagcccagcaaaataaatccaggaaaaagaggagaaaaagcacacaaattgacaaaataagaaacaaaaacattaagaggatcaataaagacagacattgg

SEQ ID NO: 1365 - DNA, 1047 bp, Homo sapiens
cttggggttcacataggggcttagggagtaagaagatctgaggacgaaaaggagtttgtagatggtatcggggctcgggtttatttggaggtttgggacaatgtcagggtttgtcaatttacatcagagcttaggggatactgggattttcaggtgtttattttatttttggagacggagtctcgctctgtcgtccaggctggagtgcagtggcactatctcggctcactgcaagctccgccccccgggttcaagctattctcatgcctcagccttccaagtagctgggattacaggcgtgcaccaacatgcctggctaatttttgtatattttggtagagagggtttcgccatgttggccaggctggtcttgaactcctagcctcaagtgatccacctgcctcgtcctcccatagagctgtgattacagtcgtgagccaccacacccaacccagatctggcaccttttaagcatgcaataaacatatgcagaatacaaaacaagaaaaacagcaacagagaatacataaatgcacagtaattactatcctttaggaatttacagtctactgaattaggtaaaagagacacatcaacaaaaattatacaagattgaatatttaaaatgccacaggagagaaacagaaagtagaagtcagggaggaaattatagtatgagacataagttacagtattttctttttccctggacaccaatttccatccctaaatatttggcaaaagttcttaccactcaactttagccttaagtttctagtgaatttatactcatcatgaagaatatatatgaccacttcaagtgccctacgagaatatatcacattcagaattatctccactttttctggcctgaataactactgtatatttcaattcggtggcactggtatttctcaccaccatcatatctctccaggatagggaagtaagctagcacctacagtttaggtacattacagcatattggttaaaagcataggttttggcaccaagattctaccacttatctgctgtaagatcttgggc

SEQ ID NO: 1366 - DNA, 941 bp, Homo sapiens
cagtctcgctctgttacccaggctggagtgcagtggtgtgatctcggctcactgcaacctctgcctcctgggttcaagcaattctcttgcctcagtctcccgaacagctgtgattacaggtgcgtgccgcaacccccagctaatttttgtatttttagtagagatgggttttcaccatgttggtcaggttagtctcgaactcctgacctcatgatctgctcacctaggcctcccaaagtgctgggattataggcatgagccactgcgccaggccaattttttttatatcactcttacacctgcaactttgctgaatttgtttacttgttctgacggttttgtggattccttagaatttcctacatacaagatcatgtcatatgcaaatacatatggttttatttcttcctttctaatttgtgtggcttttatttctttttcttgctaatttcctggctagaaatttaagtataatgttgaatagaggtggcaagagtgaatatccttgtcttcttcctgatcttaggagaaaaacttatagtctttcatcattaagtattacctgtggggctggatgcgatggctcaagcctataatcacagcactttgggaggccaaggcgggtggatcatttgaggtcaggtgttcaagaccagcctggccaagatggtgaaacccccatctctactaaaaacatctctactaaaaatataaaaacttggcggggtgcagtggctcacacctgtaatctcaccactttaggaggccgaggcgggcagatcacgaggtcaggagatcaagaccatcccggctaacacagtgaaacccatctctactaaaaatacaaaaaaaaaaaaaagaaaattagctaggtgtcgtggcacacgcctgtagtcccagctacttgggaggctgaggcaggagaatcgcttgaacccggg

SEQ ID NO: 1367 - DNA, 1149 bp, Homo sapiens
gtcctatttttttttcttaactttgcaaattaaaccataaattttaataactttataaagataaaaggcaagcggtcagattcagtggctcacacctataatcccaacactttgggaggccgaggcaggtggataacctgagatcaggagttcgagaccagcctggccaacatcgcgaaaccctgtctctactaaaaatacaaaaattagctaggtgtggtggcaggcacctgtaatcccagctactcaggaggctgaggcaggagaatcgcttgaacctgggaggcggagtttgcagtgagatgagatggagccattgctctccagcctgggctacagagcaagactctgtctcaaaacaaaacaaaacaaaacaaaacaaaaagatgagcaacttgaattatggaggacactagaaatagtgtttcctacagaatcagggcttcctaccaacatagtcacttctagggttttcgacctgaaaagttctgtggcatattgtttctttgctatccacttttttttccctatttttccccctctttctctcctctactttatctcctagagatctaggtagttcccaaaggaataatgctttacggagtctaatgttgatttattaggtaaaaacagaaaatgacttttttttttacccacaagttccataccaaaaaatgaatgtaaacttcttatgcagtttcacacattgaaaatgcaggttattttaattccattgcatttttcagaattctcaatcgcaatcctctgacaactgttgaagatccgtatctctttaaattactggcattaaaatatctagacgtgggaacaacgcaagtcccacttacaacacttaagaacattctcatgatgaccgttgaactggaaaaactgtaagttatttttttcttagacttattttcaccctgttgcgtttttaggtttgttttattattttcttaagtcaggtttattgagatataattttcatatactaacattcaccctttttaagtgtacaatttgatgagttttgacaaatgtatagttacataaccaccaccacattcccaatataaagcatttctgtcgcctcaaaaaggtccctcgtgtccctttgtagtcaatcacctcctcccaccgtca

SEQ ID NO: 1368 - DNA, 268 bp, Homo sapiens
cccaggctgaagtgcaatgttgcgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccatcccaccctaccccaccctaccccacc

SEQ ID NO: 1369 - DNA, 1917 bp, Homo sapiens
gttacagaatagcataaccctgttagaaaagcatttatgatttccacatttaattttctcttctactcttcccatgttacaaagtgggaccaaatgagtccctttctgaacatgatcaattaagaagagccctaaatctggttgagtcctttggtaacggtcataatactcacaaggaaataaatattcagttccatggcatttgcaagacacatgttctttaggacagttaatattatgacacatctgttttattttgttactaaggcagcctatgttaaagggtctcgtctcaaatgtaggaagacctttacaagaaatgaacaatacagtaactgaaagaattgattttaaccttttctatgcaaacacaatctgaaaagttatgtgctgcatattgtgctcaaaatgttttatactctccacaagctgcaattaagagattcattcctatttttaaaatttagatccacatgggttagagaaaaatactctcaaaagtgagttcctagagaatattatccctttgcctcacagagattttaacctgcatttaagagtaagtgttaggttgaggcatatgatattgtcgcttttgcagatcagcaatggttgaacactggcaatttcatatggttcaaccttgcacatgactcaagtgtaaaaaaaggagaaaccttcaagtattccttatttcttccaataggggtacactttttttgtacagtgagatcaacccaaagtacgcaagcctcttctctcccttgatgtggtagctacaggcagttacattcctttgctgcttgtgagaagcttacattttggcattttcttccaaaaattaccacgttgaccaaagtaaacattacaagaatatgaacttgttattgggggaaaggggaagtgaagcaatctgtagaaaatatttaactgaaattacaaacataaggacaagcctttaaagcaaattatacaggcatttttgtcctctctctggtccctgcagttaattaacagggccacagataatctgacatctttagataaaacaactacacacctatattacttaagttaaagccagtaagttcaaaaaaagcaattacaaccatttgacatgtttgtatttttcatctctaactcctgatttcctaaattacattcagtcatacaaacatggctgaacaacagcaaatgggatctgactctgggatgtttacttcttgggattaaaattcccaaacactttggtgtctctttcttgtgaatctatacaacatttccaataaatgtttaataatgattttttaaaagatattgccaaaaatggctcagatttaagatgaaataaaaacatagcaaacaagctatggaaaagtagcctacattttggtgccctgcaaaaaagtgactaagtagctcaagcaaaaaattattcttttaatacagcttttaccaaaacagttttaatacatgagtggctacaattttattgtgtacacaatgtgcttatagtcacatgtggcccaatggatccaaatgcctcctctggctcatgaaatcccatgtacttcacaatctagcctaatcgtgtatatgcataaaagccactggtatactttttacagacatctttgtataatagtccagaaaaaaaaaatcagtggtacttaagaatgtttagacaatttgacatctacgtttgctttcttttcttttcagtagtccttctgatgattgggggcctttatcccataggtttatactgttaaaacagtacataaaattacatttagctttgcttcggaccggcgcgggggctcacgcctgtaattcaagcacttcgggaggccaaggcgggtagatcatctgaggtcaggagttcgagaccagcctggccaacatggtgaaaccccg

SEQ ID NO: 1370 - DNA, 651 bp, Homo sapiens
ttttaatttgagtgaagtcaatttaaaaaatttttttcttttgtgctttttgtgttctttaagatatattttccaaactcaaaaagaaattgtcctttgaagagaaggtgaagcaagatgggcgaagagaaggtgaagcaaggtgggcaaagagaagccttcactgaatgccctccttgcaggaatgccaaaccgcacaactatccatgcaaaaacgaaccttcataggaaccaaaagtcaagtgagtgatcagagtacctggttttaacttcataccactgaaaaaggaactgaagaagctctgccaacaaggcaactggggaagagaagggctgaatgaacacaaaatttctggttgctgcacaaaacaagatcaaagaaaagagaagaataatcagaggaggctcattggtattggaaatttcctgaggatatggactctggtttggtcttctttatttccccttgtaaataaaggaagggcatgaacaggtaagttcttgataaatacttacaggaataaaatatagaacttagaaatatcaggatagcatactctagaaattgtcatgtgtgttttcaagagcttttatctggctattgcaaaacatttcacttgaactgaaagggaaatatttaaaattaaagag

SEQ ID NO: 1371 - DNA, 508 bp, Homo sapiens
gtaaatgaaggactggactcgtttgtgggccatatttggaggtgactttgtaaactctaacagcatgggattttaataagctgtcttcatagcttggaccatgaacaaacacagatatgcatgacagcagaagaaaagagaggaagatggtgaagaactatgagaccagatattgaaaatcagaaattcactgaaacatatccgttaagttcaaggtgacgagggaagaaagagatcaagtgggacaaaagactgcctaatacacacattccagagtccatggaggtggggaggaaaaagggtaaggattctctttagaaagaatggattaaaattgtgccaagaaataatctgttgataactaagagtctttcttctttccagaacttgtctgaggcaacaaagagagcaaagagaaagataaagatggagtcctcaaagaataaacatgattaagagcagagcccacagctccagatgtgaaaaccatgactcgattgtcagtgag

SEQ ID NO: 1372 - DNA, 295 bp, Homo sapiens
cagagaagaggatattttcagcccacatctgctgcagatcctgctcaaaaaaggtttcaactgcttaaccaagtacagctcattcttccaccttcttactctgcaaccaaaccaagtgccccatactacaggtaggtgccgagaaattccgcagcctgaaaaaataatccatgcaggtcaaaggcagaaatttactccgggatgagagatgctgtcccctagaactaaattaaacacttacagaaaatccaaaatcatttctgaaacctccttgctaacaaaagttctttttttc

SEQ ID NO: 1373 - DNA, 1223 bp, Homo sapiens
ctaattttttgtatttttagtagagacggggtttcaccgcgttagccaggatggtctcgagctcctgacctcgtgatctgcctgcctcgtcccctcaaagtgctggattacaggtgtgagccaccgtgccatcccgacattttaagagagctcaaatttgtgaaaaacagatctccttaattttagtgcttcacaaaacctttacgtaagtcctaagcgagaatattcataaaatcataggtttggcatctgagtttgcttttctatttcacattataatatataaatttttaaaaaaatttgtctataaaacacctcaattcatcagcaatactgctctacgccagggattttttgtttttttgatggagtctcactctgtcgcccaggctggagtgcagtggcacaatctcggctcactgcaacctctgcctcccgggctcaagtgattctcctgcctcagccttccgagcagctgagattacaggcacacaccaccacgtctagctaatttttgtatttttagcagagagggggtttcaccatgttggccaggctggtctcaactcccgacctcaggtgatcctgtctcagcatcccaaagtgttgagattacagacatgagccactgcgcctggcccagtaaactttttatttttttttttgagacggagtcttgctctgtcgcctaggctagagtgcagtggcatgatctctgctcactgcaacctccgcctcctgggttcaagtgattctcctgcctcagcttcccgagtagctgggattacaggcgcccgccaccacacccggctaatttttgtatttttagtagagatggggtttcactatcttggccaggctggtctagaactcctgacctcgtgatccgcccgccttggcctcacaaagtgctaggattacaggcgtgagccaccctgcttgacccagcaaactttttttaaagagccaatacttcaaatggaaatagccagatttggtccatgggctgcagtaagcaatccctgttctatactataagttgaagactgaccaaaacaccacacttctcagtccaaacaacattgttacatgttttctgcatacatgtccttcactagccaaatatgcaacataagcactctttggctgagcaacagtggctattacttttttttcttttgagacggagtctcactctgtcactcaggctggaagaacgagac

SEQ ID NO: 1374 - DNA, 938 bp, Homo sapiens
ccctagtcttttagctttgtttatggtggcaattttctttaaatcattgtatttttaaagaaaggaggttaatttcacaggaagtggaggcaagatcatatgtttgaaaggcctttagaagtcagttgaacacacatggaaactacaaatgcccttgaacaaagcatctgcaagcgtgaattttccttcattgtaccacacagttgcagcagcaaacattttaaaaaggggagtcttctgttctaattcaatgatctgtgaaatggcacattatactttatttccctctacaaacatttccgttcactttcagcctccttcaccaaaacagaagtcatttttacatcattctaagtcaaaataaaagtcttgaacaagtagttgggtcagggaggccccagaaatcataaataagaatggatacttctttggctccagcaaaatggtagccatcctttgagaaatgccattttttaaaccctttacaatgattacaaattcaatacatgcttcttacaaaaagcttagggtgactccatttttttgtagtgaaagtagccagtcctcgaagtgtggtgtataccttttccacataattcagaccactaagatctagaactgtaatctatagttgtgatttttttttttttttttgagacagagtttcactcttgttgcccaggctggagtgcaatggtgcgatctcagctcactgcaacctctgcctcccgggttcaagcgattctcctacctcagcctcctgagtagctgggattacaggtgcccgcaaccacgcctagctaacttttgtattttcagtagagacggagtttcaccatgttggccaggctggtctcgaactcctgacctcaggtgatctgcccgccttggcctcccaaagtgctggggttacaggcgtgagccactgcacctggccc

SEQ ID NO: 1375 - DNA, 565 bp, Homo sapiens
ggaaattttaaggaaatgtctgctttgaatactcaataaaatataagacaaaaccaaaaatgatacagtgtgctgaaattctgacagcaatgataaaagaattttcaaggaactgaaatccagtgacaaaaatgaaatcgatcaaggctgtagttgcacacctgagacattcctcgagaaggcagaggagaaaggtgtgaaaaacagtgaaccagagaaggatggccagggacaacaaagattggagctcggaagttgaatgacagatattctggagaaacacaccagagatgacaaaagggtttgtcaaacacagcccaactcaactggagtcctgagaaggtgaccagaccaggatggaggcccagggaactcaccagaagtccccatgcatcagaacaaggtcgaagcatcctgttctagaaactgagaaaatcaagataaagacgccagcagactcgaggccaggtgtgatagctcatgcctgtaatcccagaactttgggaggctgaggtgggtggatcacctgaggtctggagttcaagaccagcttgaccaacatgga

SEQ ID NO: 1376 - DNA, 602 bp, Homo sapiens
aagacaaaaccaaaaatgatacagtgtgctgaaattctgacagcaatgataaaagaattttcaaggaactgaaatccagtgacaaaaatgaaatcgatcaaggctgtagttgcacacctgagacattcctcgagaaggcagaggagaaaggtgtgaaaaacagtgaaccagagaaggatggccagggacaacaaagattggagctcggaagttgaatgacagatattctggagaaacacaccagagatgacaaaaggtgggtcttgctctgtttaccaggctggagaacagtggtgcagtcttggctcactacaacctccatctcccaggttcaagttattctcctgcctcagcctcctgagtagctgggattgcagaaccttccaggtctgagctgaggtgtcatctctgaacaccaggctgctgcactaaccagaagacccctccccacctgcagtggcctcgctgcatcgtaaggatggaggagctgttgtctccacagctgacaggtgcttagtggttagaagtctggttttcgcgcggcttagatctttaacatctgaactagtcctgtcaacatattttgttatatttctggtggc

SEQ ID NO: 1377 - DNA, 729 bp, Homo sapiens
gtgctgaaattctgacagcaatgataaaagaattttcaaggaactgaaatccagtgacaaaaatgaaatcgatcaaggctgtagttgcacacctgagacattcctcgagaaggcagaggagaaaggtgtgaaaaacagtgaaccagagaaggatggccagggacaacaaagattggagctcggaagttgaatgacagatattctggagaaacacaccagagatgacaaaagcccaactcaactggagtcctgagaaggtgaccagaccaggatggaggcccagggaactcaccagaagtccccatgcatcagaacaaggtcgaagcatcctggtgagtagataacacgtgcccatgctttgtgggaggaagtcctccagcagtttctctccttccccttggctttgactcagcctacctgggattatgcagttggttctccactccagatgcctcagggaggtgacccttcctgttctgggttctgcagaaaccaacagctctgggcttgtgcccatcaagcactcttctgcccattttatactcttgtggacgcatggtggtgttgatacaagccccgaattaaaggatccatggctgcccgtgacaagacaaagcaaaagcaggccagagttaaacaggccccttgggtcccttccttcatttcataaatgggaaaatcaaggtctgggcagggaaagggactcagccaaggccacatacacagcac

SEQ ID NO: 1378 - DNA, 356 bp, Homo sapiens
caatgataaaagaattttcaaggaactgaaatccagtgacaaaaatgaaatcgatcaaggctgtagttgcacacctgagacattcctcgagaaggcagaggagaaaggtgtgaaaaacagtgaaccagagaaggatggccagggacaacaaagattggagctcggaagttgaatgacagatattctggagaaacacaccagagatgacaaaaggtggaggagtgctctgtttaccaggctggagaacagtggtgcagtcttggctcactacaacctccatctcccaggttcaagttattctcctgcctcagcctcctgagtagctgggattgcaggtgtgtacgactacacacggc

SEQ ID NO: 1379 - DNA, 1180 bp, Homo sapiens
tgtaaatacaccactcagcactctgtatctagctcaaggtttgtaaacacaccaatcaacaccctgtgtctagctcagagtttgtgaatgcaccagtcagcaccctgtgtctagctcaaggtttgtaaatgcaccaatcgacactctgtagctaatctaatggggacgtggagaactttcgtgtctagctcagggattgtaaacacaccaatcagtgccctgtcaaaacggaccaatcagctctctgtaaaatagaccaatcggctctctgtaaaatggaccaatcagcaggatgtgggtggggccagataagaataaaagcaggctgctggagccacccgtaacaacccgctctgattctcttccaaataatgggaaggtttttccccccgtttttacagtaagttttgctgctaatcactttggattttcactgcatttatgagctgtgacattcactgtgaaggtttaaggttttgctgttgaagctggcaaaaccacaaaaccaccaagagaaactaacagttccacaggcactgtcttaagagctgtaacacccaccatgaaggtctgcagtttcactcctgagccagcgagaccatgaacccagcgcaaggaaaaaagtgcaagtacatccgaacttcagaacatcagaaagaagaaactctggacaggccccctttaagaactgtgacaccacctgcgagggtctgcggcttcattcttgaagtcagcccaagaacccaccgattttagacacactgggttcaagcgattttcctgcctcagccttccaagtagctgggattacaggtgtccaccaccacgccggggtggaggagtgctctgtttaccaggctggagaacagtggtgcagtcttggctcactacaacctccatctcccaggttcaagttattctcctgcctcagcctcctgagtagctgggattgcagaaccttccaggtctgagctgaggtgtcatctctgaacaccaggctgctgcactaaccagaagacccctccccacctgcagtggcctcgctgcatcgtaaggatggaggagctgttgtctccacagctgacaggtgcttagtggttagaagtctggttttcgcgcggcttagatctttaacatctgaactagtcctgtcaacatattttgttatatttctggtggc

SEQ ID NO: 1380 - DNA, 703 bp, Homo sapiens
gtaagttttgctgctaatcactttggattttcactgcatttatgagctgtgacattcactgtgaaggtttaaggttttgctgttgaagctggcaaaaccacaaaaccaccaagagaaactaacagttccacaggcactgtcttaagagctgtaacacccaccatgaaggtctgcagtttcactcctgagccagcgagaccatgaacccagcgcaaggaaaaaagtgcaagtacatccgaacttcagaacatcagaaagaagaaactctggacaggccccctttaagaactgtgacaccacctgcgagggtctgcggcttcattcttgaagtcagcccaagaacccaccgattttagacacactgggttcaagcgattttcctgcctcagccttccaagtagctgggattacaggtgtccaccaccacgccggggtggaggagtgctctgtttaccaggctggagaacagtggtgcagtcttggctcactacaacctccatctcccaggttcaagttattctcctgcctcagcctcctgagtagctgggattgcagttctagaaactgagaaaatcaagataaagacgccagcagactcgaggccaggtgtgatagctcatgcctgtaatcccagaactttgggaggctgaggtgggtggatcacctgaggtctggagttcaagaccagcttgaccaacatgga

SEQ ID NO: 1381 - DNA, 504 bp, Homo sapiens
gccagatgcagtggctcacacctgtaatcccagtgctttgggaggctgaggtgggaggatcacttggggccaggaattgaagattatgctgggcaacataccacatcattttctccaccatcctcctcagaactatctttgacccctggtgctcctaccctttcctgatgccactccacctacgccttacatcagtcaccaaatctcagcatcacagtctgaccaaaagggaaacttctcatctgactcctctgatgcacagagatggagctgagccctagagatagggagtgacttgctggggtcacatggtgatttcatggcgagactggaccacagcccaggcccctgggatccactcctaccctgactgcccatcggcaaaatgcttcctgaggacaaggctctctccatccttctgtcccttcctgagccctgcccttgcctcccctccttgggaggctgcggaagcctcgtgggccttctccagccagccactctggc

SEQ ID NO: 1382 - DNA, 544 bp, Homo sapiens
ggtggatcacttgaggccaggagttcgagaccagcctggccaacatggtgaaaactcgtctctactaaaaatacaaaaattagccaggtgtggtggtacacgcctgtaatatcggctacttgggaggctgacgggggagaatcacttcaactggggaagcagaggctgcagtgagcagggattgcgtcactgcactccagcctgggcgacagagaccctgtctcaaaacaaaagaaaaaaagatctggaagaaaatccccacccaaatcaagttggagctgtccatgagacccagggaaacccaggtgaaagagaaatgtgcgtccaccaaccagtgaattttcaattagttaatttcataagctacagcagaggcgtggaccctgccctctccacacttgaagagataagcccctgggatccaagtcccagcaaggttggtgccacccatcttggtgaaagatgctgttgttcctgtggaaaccatcaccagaggtgtaacaccaccctgtgccgtggacatcgcatcttaggaatgaggaag

SEQ ID NO: 1383 - DNA, 1644 bp, Homo sapiens
ggtggggggagcacgctgagcttcccaacatttcagccccagatctgcccagagtgagaaagcaacacgcagtccacgcttggtacatacccaaaaatacatcatcatttcggaaccgcggctccacagcaggctcccggggaggaggggaggagacccaatcagggaagcggccgctggcggcaggttggtgggggtaggggcttggtcccccaacgctggcactcagtttagctgtcacttgcagctgtcttaggaagtgcggctctcctctctgcctcccgctcgctcctgctcactccaggtcctctctccctctccctgtgtctctgcctctcgctttatttccccaggttgctcagctccgtgcctgctctccgctcgcccatcgatggggtcctgcccggcactgccctgtcgcagtcactcctgctgcctggatctctgttcagagttgaactacagcgtcctgattccagcgctcatcaagcaggggacccaggggagggtgtgtgtgtgtgtgtgtcggggggacacaaaaccttccagcctagcagatctcacggataccggaatggggaggacactttactgaaggttagaacaattctcataaggtccctcttggcttcagagggtgggagatgagatttggaagggccagagaggtgacactgcctggagaccccagccccaagttggagcagcagggagggaggagaagcagctcctgcagaggcggggcggctctccaggcctggagcgtgggccaatcagagacgaggcgcagaagttgaatgtgcattgggtgcagcaggggtgagagggtggagtgcagggaggtggggccaccgcctgcaggagagcctgcatctaacgtctgtcctgcctcagcgttttccaggacaccccatccatgagggactccgataccttctccactaacccaccctgctgggggctaggacctttgaggactcactgccctgcagccaggatttccgctcagccctgccgaaaagccgatgccggctgagcgctgttgacagaggcctctcagccgacctgcctcgctgcccatcatctctggccagtgccacccatgggctgtatacagccagggacccaggcccagggcccggtcgggagcctgctccaccatcggcctgaaggccagagcccacccgggcggttgcctgctctttgaatagacaaaagagacttctttctatggttctcagagtttcttccaatgagcaacaatgaggcccagaggccggttagtgttggggtggctgcaggcgggtggctgcgtgaggtctcatgtgctggctctgctctcatgcttccactctttcctctggagagtgagagagtgatgcaggttggggggcctcttgtcccccttgggcctgcattggtggcctcaagggccagccctagactaaacacccaggactttccttccctggagggtaacttgggtcccccaacccaactgtgtccagctgtggtaaggtggggtccgggcgaattcatgatcgtcttcagtgagagcccacccagacccacagaggtcttcccaccctgtcactccttccatggggacctggctgagtggaaggagggctcgggggaaggagg

SEQ ID NO: 1384 - DNA, 1372 bp, Homo sapiens
cccaaatggggcatttgtctcccggtcccccaccgcccctgcagtgccctccagggaatacatggggggtggagggcaccttccctgctgcctcttcctcctctttccttttcttcttcttttttaatctgagggcttcattttccagaatctgtcattttatataaacctcgcactgaggcacatccgttctcactgccaaatctccacatcaaacgctggtgtccaccattgaactgacagccctccccagcatgcctgggccttgccgagacctggaaggacagaccccccatggtgggacgatgcaggccaaacccacatgggggtattgggttgtgtggagggtgtcggggtgcatgtgacccctcttcactgccgttctccagggtcccttccagggggtcccagctcctccccgtgcatttctggtacagcccccagggcgtcccagggaagctccaggagcctgggcaggcagcagggaggagattgggagggaagaggctacccattcgggctgaatcatgtcctcccaaaaagccatgttgacgtcctaacctccgggacctcagaatgtgaccttagagacagggtcttctcagaggggatggggggccctaatccaacaggactggtgtccttatctgaagggtaaatcaggacacagaggcacaaacaggggacggtgatgtggagagacagggagaagacagcacttggctggggtgagccagccacaggccacggacactcaggagagcacctaaagccaaggagagccctggggcggatcctcgctcagagcccccagaagaagcccacctgcggagtccacacccagactcagacggcagcctgccgcagcgcaagaggattcatgctgttgtttgtggccgccagtgtgcagtcctgtgttatggtagccccagctctaatgccccctcccaggcagttccttaagttccccacccttgagcactgctatgccctgaaagaactgtccaagctcaggacggggtctcactatatggcccaggtccaagctcaggacggggtctcactatatggcccaggtccaagctcaggatggggtctcactatatggcccaggtccaagctcaggatggggtctcactatatggcccaggtccaagctcaggatggggtctcgctatagggcccaggcccaagctcaggatgggatctcgctatattgcccaggtcgaagttcaggatggggtctcactatatggcccaggtccaagctcaggacgggatctcgctatatggcccaggtccaagctcaggatggggtctcactatattgccgaggtccaagctcaggatgggtctcgttatatcacccagg

SEQ ID NO: 1385 - DNA, 590 bp, Homo sapiens
gcctcccaaagtgctgggattacaggcgtgagccaccacgcccagctggctttctttttttaagtacagagtttaaatttgtaatgttgtcacacagtggaagttccctgctttcagtccctgaatagcaaaggctatgccttggccatcgctgctggaagagacacggctcagtgttggatgaatgtcctgactgttttcgccccagagaatgaaaggcgccaaccgtcctgggaaaggtgagaagtcagcgtggacaagctggggtgaccatcactgcagagctacaggccagcgtcctcttcgtgtcctagggctcgttttgttcctggtcctgcaggacagcctggggtcaccgtcactgcggagctacaggccagcgtcctcttcgtgtcctagggctcgttttgtccctggtcctgcaggacagcctggggtcaccgtcactgcggagctacaggccagcgtcctcttcgtgtcctagggctcgttttgtccctggtcctgcaggacagcatggcagcgattgaccgattgaccattagctgttggtacaagtggctctggcacccctataaggaaatcccacc

SEQ ID NO: 1386 - DNA, 690 bp, Homo sapiens
cgggaagggagatgtttcctgcttccgtccgtgctcctgacctggcggtggccctgtccctgctacctgcgtggacagagtctccaacacgcggcagccaccagagccaggcccgagcgcacagccgtgcattgcgaaagcaaagccgaaacacgaggtcgccgtatgtcagcctggggagtacagagccccaaggctgggtttcttgagttgtgtggaaagctccgtgtacatgtcccgagttctcacgaacgaaggggaggaagccacgaaagcagaggccacgacgaacatcaacgaagcacgaggcaggaagaggacgaaacaggaacagcagacgaggaggagctgaggaggcccctgtgcctgcagcagtgaaaatggatcccgaggctcctcgtgttggggaagaggacgtggggtcccccgcaagccagtccatctccgtgtcgttctggggacgccggacacatactggaaatatccgagtttcgggagaagagcgggtcaggcccctcgccgtcccctggactcactttgcatggctgcaccttcctccccaggaaggggccccgtggctcctgtctagcgtcccgggagccggccacaccctgccgagacacaccttctttctgcgtggtctgggccccttctccgtgtgtctctgtccttcctgtctgctcccagccc

SEQ ID NO: 1387 - DNA, 1759 bp, Homo sapiens
atctgaaagcacagagggactgggctctggacacagctccgagactcctcggtcaagggaacagctggaagagagatagggtttcaccaagttgatcaggctggtcttgaactcctgaccttgtgatctacccacctcggcctcccaaagagctgggattacaggcatgagccactgcaaccagccgatacaggtcgttttaaaaacagtattatttgcacaccatacaatttactctactaattctctaagaaacttgggatcacttaactgccctgcccttgaatcttcaacagctcttaaccccccacatagaggacttcctagcctggtgcctgcatatctgtttcttcattcaggcacctcttctcactgagagacctgagcactcgtatggttctctgtgtgacgcctaatatctgactgtagactcatgagttgtatgaagaaaaattacaaggggctttgaggcagtaacagagaggactgactctagaccacagtgttggaattccaaaaaagagaaccaagaatacagagggagaacgccatgaagggctaaaagctgtcccaggattggaggacccaccagtcctgttcaggggatgacaggagactcaccctgacacctccctggggaatttttcactggtgtcacagagaagaccctaaaagcctgcagagatagaacagtttccacacaaagaataagaactgaaatggccataagcttctcaacatcaaaactggagctggcagcttcttggttcctaaagaacatggtctgatctccaagctggaatttgatacccagccaaactgtcaactaggaagaaagaaatttacagacgtacgagagctcacactggcctgtcaggaaccttctgtcaagatgcgatagcagggtgggcttcagatgagaaaaagccagggactggcacatgccctttctgcagacaccacagtcatcctcctgtcctacctgctgttctgcggcagccctgccactcctgtcaagaggtggctgcttggccgggtgccatgtgtaatcccagcacattgggaggctgaggcaggcggatcacctgaggccaggagtttgagaccatcctggccaacatggtgaaaccccgtctctactaaaaatacaaaaattagcggggcgtggtgacgcgtgcctgtaatcccagctactcaggaagctgaggtaggagaatcgcttgaacccgggaggtggaggttgcagtgagccgagattgcacttcagcctgggtgacagagcaagaccctgtttcaaaaaaaaaaaagaggtggctgcggatccccttgccttgattgcggctttggagaccgatggaaggaggtggaaatgatggtgtgtggcttctgaggccaggtcagaaaaggcctttgcttctgccagctctctgggagctctggctctcccagtgctcactcttggaacctggcctccatgttcagggaagctcaggccacaccaggaggccacatggacatgtcctgcttgacagtgaccgctaagcccaggttccagtgatcctggccgaggtgccagatgtaggagttaaggagcctcccgatgaccccagcccagctgagcaagtgggcaggaccgcggggataggcagctcccaaaggctccctccccgcggcaggacccctgcatctctgtgggaaaagacaattgttggggccctaaaaaaaacagatttattgattaaaacctcatgcatggccg

SEQ ID NO: 1388 - DNA, 1533 bp, Homo sapiens
gcccctgtaggcagagcctagacaagagttacataacccaggtgatccgtgcagagtgatgtcacaacgccctctgtaggcagagactagaaaagagttacattacctgggtgatctgtgcagagatatgtcacaatgtaccctgtaggcagagcacagagaagagttgcatcacctgggtgatcagtgcagagatatgtcacaatgtcccctgtaggcaaagcctaggcaagagttacatcacctttgtcatcagttcagggatatgtgaaaacgcccctgcaggcagagcttagacaagagttacatcacctagttgatcagtgcagagatatttcacaatacctcctgtaggcagatcctagtcaagagttgcatcacctgggtgatcagtgcagagatatttcacaacgccccctgtaggcagagggtagacaagagttacatcacctaggtgatcagtgcagagatttgtcgaaattccctgtaggcagtgcttataaaagtgttacatcacctaagtgatcagtgcagagatatgtcacaaagctcctgtaggcagagcttagatgagttacatcacctgggtgatcagagcaaaggtatgtcacaaagccccctgtaggccaaagcctagacaatagttacatcacttgggtgatcagtggcgagatctctcacaattcccctgtaggcagagcttatacaacagttacatcacctgggtgatcagtgcagatatatgtcacaatgcccccataggcagatccaagacaagagtccgtctcctgggtgatcagtgcagaaatacgtcacaatgcccccttaggcagagcctagacaaaagccccatcacctggatgattagtgcagagttatgtcacaaagtccctttaggcagatcctagacaagagtcccattacttgggtgatcagtgcagagatatgtcacaatgccactgtaggcagagcctagacaagagttacatgacctaggtgatcagtgcagagatacatcgcaatgcccctgtaggcagagccttgacaagtggtacatcacctgggtgatcattgcagggatatgtcacaaagcaccctgtaggcagatcctagagaagagttatatcacctgggtgatcagtgcagagatatgtcacaagccccctgtaggcagagcctagacaagagttatatcacctgggtgatcagtgcagtcatatgtcacaatgctgtgtagccagagcctagacaaaagttacagcacctgggagatcagtgcagagatatgtcacaatgtccccagtaggcagagaccaggcaagagttggatcacctcgggatcagtgcagagatatgtctcaatccccctgtgggcacagcctagacaagagttacatcacctcggttaacagtgcagagatatgtcaaaatgcccctgtaggcagagcctacacaagtattacatcacttaggtgatcagtgcagagatatgtcacaatacccccttaagcagagcctagacaaaagttacat

SEQ ID NO: 1389 - DNA, 3296 bp, Homo sapiens
gtcacaatgccccctccctgtggatcctagagaagatttgcaccatttgggtgatcagtgcagagatatgtcacaatgtcccctgtagaaaaagcctggaaatgatttacatcacctcggtgatcagtgcagatgtgtgtcagatctccctagtaggctgaacctagacaagggttacatcacttaggtgatcagtgtagagatatctcacaaagccgctttaagcagaaccttgacaagggttacatcacctgtttgatcagtggaaatatatatcacaaagccccctgtaagcaaagcccagacaatttttacatctcctgagtgagcattggagagatctgtcacaatgcccctgtaggcagagcttggacaagtgttacatcacctgggtgatcagtgcagagatatgtcaaaacgctcctgtaggctgaacctagacaggagttacatcacctgggggatcagtgcagagatatgtgagaattcccttgtaggcagagcctagacaagtgttacatcacctaggttatcagtgcagagatatgtgagaattcccgtgtaggcagagcctagacaagtgttacatcacctaggttatcagtgtaagtattagtcataaagcctcctgtaggcagagcgtagacaagagttccctccccagggtgatcagtgcagagatgtgtcacaaagcccctgtaggcagagcgtagacaagagttccctccccagggtgatcagtgcagagatgtgtcacaaagcccctgtaggcagagcctagacaagagtttcatcacttggttgatcagttcagagatgtgtcacaatgtccatgtaggcagatctaagacaagggtccatcacctgggtgatcagtgcagagatatgtaccaatgtgccctgtaggcagtgcctagacaagagttgaatcacctcagagatcagtgcatagatatgtcacaaagccttctgtaggcaaagcccatacaagagttgcatcacctgggtgatcagtgcagagatatgtcacaatgtcccctgtaggcaaagcctaggcaagagttacatcacctttgtcatcagttcagggatatgtgaaaacgcccctgcaggcagagcttagacaagagttacatcacctagttgatcagtgcagagatatttcacaatacctcctgtaggcagatcctagtcaagagttgcatcacctgggtgatcagtgcagagatatttcacaacgccccctgtaggcagagggtagacaagagttacatcacctaggtgatcagtgcagagatttgtcgaaattccctgtaggcagtgcttataaaagtgttacatcacctaagtgatcagtgcagagatatgtcacaaagctcctgtaggcagagcttagatgagttacatcacctgggtgatcagagcaaaggtatgtcacaaagccccctgtaggccaaagcctagacaatagttacatcacttgggtgatcagtggcgagatctctcacaattcccctgtaggcagagcttatacaacagttacatcacctgggtgatcagtgcagatatatgtcacaatgcccccataggcagatccaagacaagagtccgtctcctgggtgatcagtgcagaaatacgtcacaatgcccccttaggcagagcctagacaaaagccccatcacctggatgattagtgcagagttatgtcacaaagtccctttaggcagatcctagacaagagtcccattacttgggtgatcagtgcagagatatgtcacaatgccactgtaggcagagcctagacaagagttacatgacctaggtgatcagtgcagagatacatcgcaatgcccctgtaggcagagccttgacaagtggtacatcacctgggtgatcattgcagggatatgtcacaaagcaccctgtaggcagatcctagagaagagttatatcacctgggtgatcagtgcagagatatgtcacaagccccctgtaggcagagcctagacaagagttatatcacctgggtgatcagtgcagtcatatgtcacaatgctgtgtagccagagcctagacaaaagttacagcacctgggagatcagtgcagagatatgtcacaatgtccccagtaggcagagaccaggcaagagttggatcacctcgggatcagtgcagagatatgtctcaatccccctgtgggcacagcctagacaagagttacatcacctcggttaacagtgcagagatatgtcaaaatgcccctgtaggcagagcctacacaagtattacatcacttaggtgatcagtgcagagatatgtcacaataccccctgtaagcagagcctagacaagagttacatcacctgggtgatcagtgcagacatatgtgacaaggcccctttaagcagagcctagacaatagttacatcacctgagtgatcagtgcagagatctgtcacaatgcccctttaggcagagcttagaccagagttacatcacctgggtgatcagtgcagagatatgtgacaaggcccctttaagcagagcctagacaatagttacatcacctgagtgatcaatgcagtgatatgtcactatgccccagtaggcagagcctagtcaagcgttacatcacctgagtgatcagtgcagagatatgtcacaaagcccccatacacagagcctagacaacagtcccatcccctgggtgatcagtgcagaaatatgtcacaatgcccccataggcagatccaacacaagagttacatcacctgggtgatcagtgtagagatatgtcacaatgcccccataggcagagcgtagacaaaagtcccatcaccagggtgatcagtgcagagatatgtcacaaagcccccataggcagagcctagacaagagttacatcacttggttgatcagttcagagatgtgtcacaatgcccatgtaggcagagcctacacaagtgttacatcacttaggtgatcagtgcagagctatgtcacaatacccccgtaagcagagcctagacaagagttacatcacctggttgatcagtgcagagatatctcacaatgtccctgcaggcagagtgtagacaagagttacatcacctagatgatcagtgcagagatatttcacaatgcccccttagacagagcctagacaagagttacatcacctgggtgatcagtgcagaaatatgttgcaatgcccccataggcagatccaacacaagagttacatcacctgggtgatcagtgcagagatatgtaacaatgcccccagtaggcagag

SEQ ID NO: 1390 - DNA, 1473 bp, Homo sapiens
ggccgcggagtccgcgggactcgcaccaggagtaataaaacagacccagagatcaaggagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctggagctcgcaccttcagctcccacccttgaggatgtactggaacagcccaagtttttgtgttcttgttttagatggggttttgccatgttggccaggctggtcttgaactcctggcctcaagtgatctgcctgcattgacctcccaaattgctgggattacaggtgtgagccactgcacctggcc

SEQ ID NO: 1391 - DNA, 334 bp, Homo sapiens
tcctccttttgatcttccttttgttccccagtgccagaatttccagagccttcttgctcagatgccatctttttgtatgccatttcgaagagcttcagtgatgcctgctgaagagaggatgctgtttgtccaatgttttctcccgtttcgctgtcttttctatccagaagccccttcattttggaaatctcttcttttagcttttgcacttatcagcagtgtggtgaggagaaaggaagtgccagatttatcccatgatctgaaattcgaccacgtatgagcaactgtatatgagaaagagctactaaataagacattctgtttcctggtgagg

SEQ ID NO: 1392 - DNA, 268 bp, Homo sapiens
agggcttttgcaatcaccataggaagaagattccacagtagcctgtgattccagaagaatgaaagacatgtggagcagctatggaccaagttaactagaagccaacttagattagccattcttcagccacagacatgcagcacgtggttgggtgcagcttgcaatcacaaatcaaaacggaagaggaagaggacaactgtataaagcagcgtgatttaagttgatctgtgggacaaagagttaagccacaaatatttggggagagagg

SEQ ID NO: 1393 - DNA, 1804 bp, Homo sapiens
tgaaaatgttaggtaaatcaaaattatttaggagactgggtgatttagtttttgcaataattagatgcttcagagaattcattccttagtattttgataattgttttgataacacactttctttgttgtggtttacctgtcagcaggaaatgataatccaggaactccataactgtccatcagtctagtacagacttgattggagctcactatgatcaatgatgggctaccagccatctatgccatcctccctgccccaaggagctgccagtgctgggcaaggcagatgcatgcctgtgatttaaggccaaacatggaaatacatatttgggcacatagagaaggatgaagtttcttctcatcaggagatcgatgaagacctcctgcaggagtccacatctggataaagtgttgaaggagaagtttgatcttacaagccaggactgtgcctaattcctaggaggtgtccgtgcctaattctaattaggaattaggaattcctaattccacaaatgtttgctggcagtctgaaagaggacagtggcattctgggcagagagaaagagcaagaaacaggagagcagagagggcaacgctcatttagggttgagtgagtcgtgttttcaacctgaagctgaagcctgaggtgtctgagccaatagttggggacaaatctggttggttggttggaggctgagtgtgaaagtccttgaattaagctgaggattttagatttcaatcagaagccaaaggaactccctgaacgcgtgggagcagggacaggacatgctctgagctgtgcttcaggaaggccaggctgacattgcatggattcaccagcctgatttgctgcttcttcctgcatccagcctgctcctgggtctccttccccacctcacagccatggcaaccaaatgcacgggcttgtgaagaccagcagcccaacttcagcaaggtctcgctggcctggacagaagagccaaggtaccagatccatttccaaggcaaaagtccccaagtttacagttaaactcaacttgcttatttgtggattttgctggggcacagtagccccacctaaagggagtcacatgaaatcttagccttttacttgtcacagagtataagaataaaacctttgatgattgaacggattatcctcaggataacatctgtgattcttcatgagagttatgtcttcttaaacccttggaagctgtcaacactacagatttcccaaagcaccaagctgcaaacagcagattgctctcaagcaatgatgctgaagcatgaagcaagaatcatgttcccatatcagtgttttcactgctctgaacccagcacctagcacagctcctgatagagctgtgtcaaacatgacagaactcctgatagagctgagagtcaacatgtccgttcaatgagtgaataggagtgggctatcccaatgcaaatttcaaagctctcagcaagacaaggtggaggtaagttctttgcccaattgttagctgatttttacatgattagccatatctcatcatttccccaaataagtgggtgtgatttggataggttgtggaggaaggaaaggacaatggtggtcgttgaagaattctacaaaccaaagataggagtgggaaatgagcgtggcatgctcaccggacaatgaaaactctaccttaatttttattaaactagaagaccagatattaaactttctctaattgagtcacttgttttatctgagactggattgagttttaagaaaaccatatgaatattcactcctcctctttctcctccc

SEQ ID NO: 1394 - DNA, 1263 bp, Homo sapiens
gttttccagttccaggggccatcctggagctgctcaaaccattctagagagacaggatggcctgagctgagaagggtgggagcaaacccagggtcctcgtggctgagagtaagtgcaggctgtcatgggaaaagttctcatccctgagtctgcatttgtaactcagtcacccagcctggctcagcacaatgcaaaccatttccagctgctttgtgtaaggaataaggactggcttgagaagaagggaagagatctgcccctaatatccctgattatctcagcagcatggattcaccagcctgatttgctgcttcttcctgcatccagcctgctcctgggtctccttccccacctcacagccatggcaaccaaatgcacgggcttgtgaagaccagcagcccaacttcagcaaggtctcgctggcctggacagaagagccaagatgaattaccatgtgcatggagagaagccatggcccaaggatgggaattgcagatctggaggctgaagccccacattggcatcctggctctactcccactggttctgtcaccctgggcaaggcacttctcccaagctgcagttctgccaactgagaagcagagacaatgacacttgttccgctcaccttgcagggttgttgtgagaaggaaataaagtatttggaagcactttataaactgtgtaattctattcaagaaatacttatgaggccactaagaccacttcacctgctttgggtgtaaatatgaccattttgactttattttcctgatcaatcacttaagacctcaactgcttttatcgtcaggaagtccagcttctcattttgtttcccccatttgcattcccccaaaagcagagggagaagaaactgaaagccccctctgtttatgacactgctacttggtggtgggggaggggtgtctttgctgcattctggtccacagggcctgtgatgtctgtgggctcctgcctggcaccctgatcatgctcttgtgggtgcaagtccctgtaccagcagctactcctgtgtttcccatgcttgggtcctcactcacacactctcatgtgctaggccactgtttccctaaagcttctccagagtgactgggtcctgaagcatttcccatttctaccatgtcctgtgtcagaatcgctttgtccctataaaatctcatggcccccaggcctagtcacaagttcacatccccttttcactctttggaggtcccctttggggccccagttatcgttactcgg

SEQ ID NO: 1395 - DNA, 2775 bp, Homo sapiens
agttaccaagtgcataggtctccccatatctggaagaactatttaattggcccaaatagatagttttcttattgagcctttaatgtactcatttggaatgttttttgtacaactacatactctgttctgtataggaagcccaagagaagaagaagaactcgttccttgaggacctacgcttctccataggaaacaatacagcatgccagagataaattatagttgggagctagaccgtgtgctacagaagtagctgcacaatgatgttgaatgaagcaggtacagatggggctaaggttagctctgtggaggacccaatatctgccctggattttcactcttgaaattgcccagatgaggttgatatgattaaatatcagaatgaatagtacagaataaatattgcaaaaggagaaaatgggtgcactgcaggaactggagaaaacaaaaggcttgtgtgaaatagaaggaaactggtggattctgtgatagtgatgcaaagagaaagtcctcacttttcttcccctacctagctgtctgactttattctttattagcaatgtccatcgctcatttgaatattctagctcctgcccaatttccccactaacttttcgggaaggtataatgctctgcctacacatagcttaatatatgtattgaataaattaacaaatgaatcataaatagtattgaacacatctgctaggttgagctacttaaggagcttgactttgattttcctggactaaagttgctttatcccaaatctgaagctggaaaggaaaggatatcctaatagcaaatgctacattttgatcactggtcaatcttcccattctctgtctgtctcttgtgagcgttcacatggcctcattcaaactcagtcagctgcagcaatgattcttccatttacatggctagatgctgtgagacaaccaagccaaaaagatgccacccttgccctctaagaacataaaattagtagttaattttatattatgaaaagtgaggaatttcctcaggaaaagaggaatttagatctagcctataataaaattagtcacccaacaggcattcaactctgatttctttatacgtgtcaatgccggggctcctcgttagattatattctcttggggggtgaatcagctgagaaagaggactagatatttctaacctgctcttaataccctctgtggccatgggctcctccatctggcagagaatgtgctcttcactataacgcagataccacgatctctgtgttagggatgcaatgggcccaaccttactatctcccaaagccctggcaggtgactgaatgtgcagtccacagcttataaaaggccggatcagtgggtccataggctctagagatcagtttctcattctggagatccccttggtgtccatccatatcctggatcaggagtcctgtttcacagctcagttcccagacatgtaagaggattctgggactgggaccaacactatgatgcttttctaatctgttcttctctccactgtctttcctgtctccacccaaccaggaaagcagaatatttaaacttctgccaaactcccaagaagctgactttgcaatgtgcagtgtcattcctcaggttgtttcccgcccatcaaatgccagtggcctggattgaccgttgccactgtgcctggagagcccaggaaatacactatggtgatgaaaacgactgtggcaatccagcagtctgctctaactggatgattgtaagagggtaaagaagatagtgctgaactttgtgatggttttatattccagtaaacacccagtaagacaacattggaggcagcagggcccatatgggtattggagaagcaacggacaaagtcagacccagcccagtggatgagggcagggtctcactagtgttggtctcaccagtgttgagtagaagatgcccggagtgagtgagacaacttccaggactagaactgtgcgtggagtccaaaccaggagagttggaggaaagagggcagctgaacatcatctttgtggatggaatcttgccagtaactaatgaatgcttcagtagctctactggatcttgggacaatctggtaaacagacaagatactttcttggagcttggaagggaatatattaaaactgataaacaaatacataaaatgatcacaaactgctaaaagaactatgaaggaaacaaagagtgctaacaaagaactaggaagcgttggagaacacagttgagaatgaatggttaagaaagccaagactcgaagaatgagatggagccagccaggttcagaacatagcagagcaatgcgtaacagagagcaatgcacagcatgtgcgaaggtcctgagtcagaaaagtgttggcttattgaaggaaataaaggcatctgtatggttggagaatgggcaaggtggaaacaagttacagaagaggggcttattgtgggaactgtattagttagcttttgctacaaaacaaacaaccccaaaacttagtgcttaaaacaatagtgatttattatatctcatgattctgtgggtttcttctcatctggtcttgcttggatagggctggatgatctataatgatctcacttacatgtctagggcctcagctaaaatggcaagcatggtgggaatggctgggcctctcttggggtctcttgtcattctatagaaagctcaggcttgtttagatgatggttggaggattcccagcagcaagagaaggcaaactccattgagtaagag

SEQ ID NO: 1396 - DNA, 1024 bp, Homo sapiens
gctctctttcttattccaggaagtgttccctgtgaacccatgagacttcatccctgcgttggtctggctggctttccctgtgagatacaggttcctcctgaagagctgaagctccattccagctctagacttctccttgctttcagacttcaagatgagaagcatttttccagtccacaagtgttagaggacactgccgatgatgtgtgttttgcccaggctggactcagcttctttgtctcgttttgaaagaagagtcatgcttcaattaataacagacaacggagtcaatatgaagggagcagagacaatgatgtgatcaaatgccaagaaatgactgacagcagaaaaaatatcatgaccactgtgggaggaggtactttctctttgtcagaagaacagaagcaaatggtctgcttatagccttttatgtgacgatgtgccctttctgccactgcaagggaaagagtcatctttgctcctccattttggtttatcctaagaaagaccaacactatgtctagcccagagagagaaacacataaaataaatacaagttaaatcttcaatgggacatcaagttccatgtacaaggctaacctagactataaagtccttgaagtaagtgaatttattatatatctctatcactggacacactgtttgcatgaaatgaagagaagcttaataaaagtgtcttcataatgacaaagacagggatgattatttgtagatacaacatttaaagtataaatacagttcaagaagatttgattctaatcgaaacacttccacctaaataagaatcctgatgcaaataatgactagttttaaaatgacaccttttttcagacattacaagcaatgcttagtcgttaaattaaaaaataaataccccgtacgatttaagaagaaaatagaacacatctctattcccaccacttagctaacatttggtgtgcttattctctctgtctctgtctgtctctgcctgtctctctctttcattctcattcactcctgc

SEQ ID NO: 1397 - DNA, 1261 bp, Homo sapiens
ggagcttactgtgggtagacaactcgagccaggcttttagaagctttgaagatagagcaatttactgcctttaatgacattcattttggtgtctttcatatttataaaaaaggaacaaccaaatagaccaggggagtgctgacttgtacatctgttgggtctggcacctcctggtcttgctctaggtagggggtgccttctggaaccaccagtctagtggtcttctccccacccacatccctctccattttgccatctgctttattcacaacataatatgtacggtctatacttatctgatatatgcacttcttgcttgtcctccccctccagaatgtacacttgataagagtaggggtcttgcctgccttatccactgcatagctccagtcaagagaagtcattgccacggaaaaggcacccaacaaacatgcctttaacttgttgaatgaacccatcaaattcctgatagtggaagtttggacactggagtcgcaggtggggaaagaaaccatgatgcaataggaccccaattacacgtgggttctgcttatgttagaaaagcttcctgactttgtgtgcagtcaagtcctgtggcttgtggccaagggaggatcttttcttttttacccatggaagatgacattggtatgttggagtaatgatccagaagataaacatgaatacagacaaattctgaatttggattcaaataacaagttgcacaaaaacaaggtactcagttatttctgagtattgctctgtgcgtggcactgtgctgtacattgaggatatgaagatgagtaagtctcagtctatatctttagagacctcacagcctggaaagagagttaaaaaataattactattcaacatggcaatggttataaaggagcagattttccaaactggtgtttcaaggaacattctttggcaggatgttaaaaacaggaaacagcaagcctgaaaaaggaaattgacgaagaaacaatttggttattcttgactcagtggccaaggagggaacacagatgcaaggaagactgggaaatgcagtatacagctggagacatcattgccctaaataaaaataggactcttaccaagaagggagaggagaatggatattgggtggcatcacagtctctcacacctgagcatctgattctgtcagaagttaaatgatgacctctcctgtggatccctgggttcttatgaagcatgagtataatacaagatgtcaacaggtattgcaaaggta

SEQ ID NO: 1398 - DNA, 616 bp, Homo sapiens
cctcagcatacgtgtggatgccctctgtacatgcactctttgggacctcagtaaatggaaacagaacaactgcctcagaaagatccagtgtctatttcatccatgagggaacgtttggctgtgacaacattgatggcatgtggttgggcacaatgagagagaacaagaggcaaaaagacacaaggctaccttgtgaaggggcctcatgtctagttcactctcagcaggtgagataatgaatctctgtctcagcctgagcctaaagccatagccatatttataatatctctgcaaaatgtgctgaagaataaggaaattgctcttttgttggtccctgatgtgctcaggttggcccttggcaaaatccatcacactcacctcctccctgcttcctctttcaggcctcctctgccccagattaaatgtgaggacctcatgggcatgcctctgattgcccgggtggcacatcattagtcctctgccacccctagagcaccagagcattttgcttgcatctttcttatggagttcacacaaattcctctctgtgggggccagtcctcctcctggagctttctggcctcatgactaatgagaattgcctcctccccaggcc

SEQ ID NO: 1399 - DNA, 415 bp, Homo sapiens
ctttctccatttcccttccccactgtctgtttctctcctttctctttcctgcctaccccctgcacagtcacagttgtcagtggcacacacacattcgaccccttttcaggctgcgctgctagaatggagtgaatctgagacctcacaggagttgctatgtctcacaggatgacttctttttcattccgggaaaatggaaaagcaaaacaaaaacaaaacagaacagtaactcagggctcataaggatggatcttcagtgttattgaaataacagccggctaacaggaattgttcagctcactagacagttgcaggtttaacataggggggtaattgaattagatcattgtcatatttggacaaggctcatgcttgtttacgttaagttattagaaacaacttaaatcacaaggac

SEQ ID NO: 1400 - DNA, 1586 bp, Homo sapiens
gctacttgggagactgaggcagaagaatcgcttgaacctgggaggcggaggttgcagtgagccgggatcgcgccactgcactccagcctgggcgacagagcgagactccgtctcaaaaagaaaaaaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaaggacggcgcgccgctcctgcatgctgatggcctgcggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagccggcagccttcggggaccacagtccccccaaagctttaggaagccagttactacatccggaaagattcgtgcttcagaacgcaagccagggagaataatcacagaaacgcaatgcgaatgtcgtgcctctcagaaattcttagcctgaaataccgtccccaccccccaacccggccaggcgacagtcctgtcatcctaacaccgcagaggctccaagcgctgggagtcgtgtgcccgcggcgctcgccactgaggccggttggaagattctagggtgccccttcccaggttccagcaggcactccgggatgttctagagtcaggccagggattcaacagcgaacctgaccgaaactcaaacctcagcacaagaactttgatgggggaagtgcccagactccaatactctcgaccttggcatttagtagtttcttctttgaactggaaagatcaaataatgcacagtaaaatctcatgataagggttccaccaagaattcgggatttgtgttaattcataaggcagaagtggcccctgtgctatccatgaagagtttctgtatttctctgcaaggtcacaggtaggctttttaaccaattaaagaaaaactccaacatttagagggcccattattataataattcctgtatttgtttgctgtctggcacataaaaacgtgcttcacttgcatatattaatgaattttcacctcctagcccctggctaacccattttacagctgaaaggactaaagcaacagatgcccaaagtaactcacctagcaacaagtcttgggattctgagatgaggttctttctcccacacacacaggcaggctggcttcttgggagtgggacttgttcatttgtccccaccaccaccattgattttgactgattgctccactcttgctgtcttcaaacttttgaacaagggggtttgcatttctctttgcactgggccaaattatgaggtaggtcctacacacaggctccaagatgacagtactaatttttcactaatttttctctacttggtgctcaagtgtagagtttgag

SEQ ID NO: 1401 - DNA, 329 bp, Homo sapiens
cctggtctcaaggagtctacaattgcagggggagggttcacagaggttttcttatttatttatttatttatttatttatttatttatttatttatttattttgagacagggtcttgctctgttgcccaggctggagtgcagtggcacaatctcggctcactgcaacctctgcctcctccccagttcaagtgattctcatgcttcagcctcccaagcagctgagattacaggtgcccgccaccacacccagctaatttttctatttttagtagagatggggtttcaccatgtcggccaggctggtctcgaactcctgacctcatgatctg

SEQ ID NO: 1402 - DNA, 310 bp, Homo sapiens
attgaatcccgggggcggttagccccacgctgctgttctcgtgatagtgagtgagttctcatgagatctggtgcttttataacaggcttgtttcccttttgctaggcacttcttgctgctgccatgtgaaggatgtgtttgcttcctctttcaccatgattgaaagtttcctgaggcctccctacccatgctgaactctaaagccaatatcctgtgttctgcttcatagtcgagacctcagaaatagtaatgagatgactgaacacacagcaccattgtactagatgagacgtaagtgtatgccatcctc

SEQ ID NO: 1403 - DNA, 572 bp, Homo sapiens
ctaacttaattctaagaaatgagaggattacagatcccagaagataatcaagtgcttcaagacagttgattaagccaaattatatgtggtagagaaagatttgtggagcagtttcagaatatatacacatgtctgtctgttgaatgtattccttcctcttacaggaaggaattccttccagggtcattgtatgtgataaagatcacttgtaaatgaaaactttggaggttacagaagaagtaaatgtcagaaatgaaggaaaataatagcaggtaaaggaaagaaagggaggaatcgcagaaatgagaaaaactgaaaagggaagaaagcagagaccactaattagaagtcgagcatcttggaggatgaaattatgccataattttcttcccttggtcgtttttgatgtcttgaggggatcctatcagcaggagatacagagagactcctactgacatcagccttcatgcacacatatgaaaggagaaaccatgtagctgatccagcctggagaccatcgatgacagcctggatgatggacacaggtgaggggactccatcaaagaacagac

SEQ ID NO: 1404 - DNA, 922 bp, Homo sapiens
ggcaacttcccaactcaaagtaaacaaagccaatacctaccctgcgttcctggaatttacaatctaagacagcattgatgtgaaggggcatgtaaggcttatggacaactaaacaagcctttcccattaaaactggaacccattaaagaaaaaggatttgctatctgcagggaaagtattctttggaagggcttcctgctgattctgaatctcaaagttggtgagtgagaagagcaggctgagccctcttcactgctatctgaggaccaacaccgtgcaacgggcaggatgctgagtccaggaggaatgggaagtcccccattagtgggaggaccaggtctgtaacagacacacagatgtgcacacacacaaacacacagttaaacacacgaggaagtgttagaaggtgctggaggagggaggagtcaagtgaggccccaggaggtggtactggaggtggtcttgaaggatgagcaggggcccaggaacaagggaggatcaagacttccagtgacaaatatcgaggagcagatggagaccatggggattggagacttgtgcaggaaagggcgggaattgcaccggctgggagcagttaacagggcaatcaaaggaccctggttggtttccttttccaagaaaataactcatagcttgacagaggcaggattagaagaggccagcctagagtctgcggcccacgtctacagagattacaagggagctgagcaaatggcagcctttggggagaggaagagatgttgtcatagtggtctagataggacttgcacactgggtacgaggcctgagaggccagtgaagatctttcttttgtgtcccaaagtgctgaatgatggcagtgatcccccaaaactaagtcaacacaaaaataattctccaccataagtcacatgcaagggag

SEQ ID NO: 1405 - DNA, 655 bp, Homo sapiens
cccgcctcggcctcccaaagtgctggaattacaagcgtgagccaccatgcccgacctcttttttttttttttttaaagacagagtctccctgttacccaggctggagtgcagtggcatgatatcagctcactgcaaccttcacctcccaggttcaagcgattctcttgcctcagcttcctgagtggctgggattacaggcgtgcgccaacacgcccagctaatttttgtatttttagtagagatggggtttcaccatgttggccaggctggtcttgaactcctgacctcaggtgatccacccgcctcagcctcccaaagtgctgggattacaggtgtgagccaccacgcccggcctcactataaatctttaacccagaaccaaatgggggtctcaacaaaggaagaaattttctatgaagcaagaaaggatgtcatgcttttctcccggaaaaacacacctcaatccatttcccaaatgcgctctccaaaccacgtttgcccaccctcaacacacggccctcctaagacagcactggaaaccgaatgcgggtcagagtcggctaaaaacgactttctcactatttcctgcgctgaatcgggtggccagggccccctcactgtgaccttggaacctcgacttcccacagggctgtt

SEQ ID NO: 1406 - DNA, 287 bp, Homo sapiens
gggagaaagggaaggaagggaaggaagaaagggaaggaaggaaggaaatgaggttgatggatggcactttgtccattctaggcttttcttatatctgtgtctgccttccccatggcgtgtgaagctgcctgtctccctgaaatctggaggcgcactgacccggaccctctccctgagactaatgagttgttcgctctggaccaattctgaccacaggagaccagactactcacccccatggaagggcacccactggtaggtcttctgggtgcccaggacagggcggc

SEQ ID NO: 1407 - DNA, 667 bp, Homo sapiens
ggccactctcactgtttctattcagtattgttattgcaaattcaagccagggcaactgggcatgaaaaggaaatgaaaagcatccagattggagcaagagaagaaaaaccatctctctatttgcaaacggcctgttgtggtgtaaaaggtccccgggtacaatttgtgcagcagaaatacggcacttcacaggctgcttagaaacctagcaagtcccttgagcacaaactattttcctaagcttggtgggggcgtgagagggtggccggggactggtgacaatgttgtttgtgcactgggagagtccggctgaattgcaactggcctttacatcctaatcagctccctgaggacaacccgaaagacatcagattaaaaagtcacaatgagataaaccagcacgacgcggctctctgcaaagcgacaggctgcagagagggagctgatgccagaatgagggggaacccccggagcttctcgcatcgggtgggaccggcatccggtgagaccgcggtggctctctggggctgaaaattccaagcagagtagcccgaggaatccagccatccccgagggttcagaaatgcaaatcagggctgtgtattcacagcctggactggagatcgaccaaaaactatgcagggctcacccttgcggggcggcggct

SEQ ID NO: 1408 - DNA, 287 bp, Homo sapiens
gcacctgccaacatgcccggctaatttctgtatttttagtagagatggggtttcgccatgtcggccaggctggtcttaaactcttgacctcaggtgatctgcccacctcagcctcccaacgtcctgggattacataggtgtgagccaccatgcctgcttttttagtttttacttttcatagagataggatcttgctatgttgcccagactggccttgaactcctgggctcaagcgatcctccctgctcagcctccccaagtgctgggattacaagcgtgagccacct

SEQ ID NO: 1409 - DNA, 3364 bp, Homo sapiens
ctccaggaaggctgcttcaacttaaataactttttaaaataaaactgcaaatataaatatctttctttctcaaaaaataggatttttgctttttttgttggtttttaatatttttttttcttctgtttttcctttcattctctctgtcttgcctccaaccattctggttgccgggcgggagggggcaccccgaggcccctgcctcagtgtcaccacctgtgaggtgaccgctcctgccacggccccggggtctgaatcgtgcaaagacccctgtcccccaccttccctgcagccgcccacttccaggggaagaccctggaagaggctgggggacccccctcggaaggaagcaaaaagacagtgacaggactgcatggccacaatggtgggggggcagactttggtatcgcccgctcgagcctgcctggctgcaggtccacacccatgccaggccgggcctgctccggcattttacattcactggtttataatttttttttttcatttttaaaaacttttttgactttttttttttttccttaatctcaaaaggcggggggcgtcggggggcagaggcaggtagcagcaacagctagtagcaaagatgcttctctctctctcctgggcccggcaggctggggggcactgcagacgggggctccggcccggccacctccccggcccccgggcgcccccgcctgaagccccccaaccccagcctggacctcactcccgctctcttgcacacacgcacacacgcgtccacgcaacttcaccatgagaatggaaataacaatttcgcattgtttttcttttttttttttctctttttttttttgtaccaggcagttaaaaaaaaaacaccccaaaaaaagaaaacacaaaaaaccccaaacaaccaaacaaaaaagctttgagctgtgtcctttcatatggagtcaacacgaccctcctcaaatatcatttttttttgtttgtttgtttcctgaaacgcgagaattcagcaggtatctttggcaacactttatcacgaccttaatttaaagaataaaaataaaatcgattcacgtctatatacagtatgtgattgcgcggagtctggggagggcggggctgggctgggggggtcccggctctgggcccatgcagaggctgtggcccccaggacgggcgggtagttaaggcaaagtgggcgggcaggacaggcgaagctgagtgcggagctaggaacgagggtttagtgcaatccccgaggtctgtgtaagtgtcgcggtgggccgcagcccttgttcctacggaagtcccagagggctccaccccccaagtccggtcgcccccactggctaggacgacagctgtgattttagagttggttttattgcgagggggtgcatggataggggaaggtggaaagagggctcacccctcagggggcctctctgggagctggggaggggtgtccctggcctgggtgttcaagctccccgctcagccacgacagatggttttctctccagaacagctcgccctgtgacactggggtgtgaacgcagccggggtgctgtcacccagccccaggggagaggggggatcctgagacatttggagggggctgacaggcttaagggggggtgggaagggaagggaaccaaaaccatcctgtagaaacaatatgaaaattgccttcttaaaaagcttccctttaacaatgaaagaaaaagagacgagaagatgtgtgtgtcacagagaagggggtatgggggggtcgggggcagggagacacccccccgccggttgggcattgacaagaagtctcagtgcagcagagcgtctattttcggggtcccatgctagcattgcatatgcaaacggggtgagggcgtcctggcatctggcgacatagtctccccaaccccggcccctgtccgtggcctgtggctcggtcaacaccgggccttgtgggagccagaggttggggggaggcaggtcccagtccccctggattacagtcagtgcctttgagtaaaaagaggggtgcctggggtggggagaggggcggtggttctaaggccctggaggtggggggcccctgtcacccacctcagcagggtaggcgcatccaaggtccagctccttggtggccatgcgggagggacaggcgtgttgggggattggggggtgccggatggggatcggggtgctccggctggaaggcccatccctgagctagggaggaggaaggagagaccccgtggacagaagcgggcgctaagacctcttcacgtcagaaccaaaaaaggggacagaaagggggagcggggggaacacagcacgaacaccccacagtcctgccttcgaggctgacgtctgggggtgaagcacaaacacctcggggcgtctcccaggtcccctgcgatggcttcctcctgaaccccccttctcgctttttggggaacagaagtggattctacgtttgtggtgggtttttttttttattattttgtacaaaaataaatcgacttttaggaatttcttctgctctcgctctctctctcgctctctctctcgctcgctttttttttttttttttgtcttttcaacttttcatagaagttggttgtaacttgtaaacatgtttttaaattaagaattaagataaagtgtagtacccgttccgttacaaagtgccaagacttctaatgtggttggttgcctttttttttttccttcctttcattttgtaaaaccttttttttttctagtttgttttattgcttttgtgacattggaatttgtggattttctctctctccccccatccctgccatcaccagaccctggggttcctctgatcgtgactctgtttatcccacactgttgcctgctcctctgaggaaaagtatattatttatatatatatatatatctatatataaattttgtttttaaggaggaaagagaaaaaaaaatctaaaaagtgctttaaaaatttgggagagggggctcgggggagaggacgaagacagaagttttgaatctccaaacgtgggggtctaggtggaccgggcgggggtgggggggcgccctgaggggtggtccctgggggtcccgccggttgtaagtgccgtgaaggaaggcggcaggagcacccccaggagccatcctggcgccccaccgggaaccccagtccgatctcctttctccaggcctagaaataaataggtttgttaagtgccctgaggaaggagggtgcgggtcgggggacgggggcccattttaacgtccgctcagagcagacagaaatcatttaaggtcttgtctgaaagactcatagaaaccagcgaggggaggaaattaaaagccc

SEQ ID NO: 1410 - DNA, 564 bp, Homo sapiens
tcggctcagaggcagggaggagtggaacggcatgggagggctgcgggaggcacggcaggggggtcaggggcaagtggcaggagggcggatggggggcagcggtgggcaccggggcagggcgcgctgacctgtcctggggcccgggttgggggcagaaatgagcctgcccacgctgtcccgccacggcaggcgccacgcatcctcgacacagccgccatggcaggccttcgggctccgtctccgggacaggcggtgcagggcaaattggtatgcagcgtccgccccgtgggcccgggagagcctgccccgcagggaccagagcccaaggacgggctcaacactcagtcaaggacgaggcgggcatgcggctgtaggggtcgagcaggatgcgcacgcagcgcaccatcaacagcaccagcaccacgagcaggcagagcacgaaggcgaacaccgtgcgctgctccgcgtccaggcccgcgcccaccgggggccccgtcgacggcggcaggggctccggcgacagcgtccacgtcgcgctcatggctcacatcgccgcgcgccctg

SEQ ID NO: 1411 - DNA, 371 bp, Homo sapiens
ggaacatgccggaagagataggttccagacgcgggagaatgcggggccagagccaacctcaccagaagggcagaaatccttttcctttcggaaagaaaaaaactcccaaaggttgctttccaagcttttcaagagaggagcacagcggatgaaagtactcaagaaaacacccggcggaggcggaacaaacacacttcccgacgcagccagacggactgtgcggcctctcggaactggccagaggccgcaccaggaggactgacagcccctagaaaagcgagtgaaactaggcggatctgagaggctcctgggcgaccacgcccaatccttcctttgccgccccgctggcatgagcaaccacgcacagccac

SEQ ID NO: 1412 - DNA, 567 bp, Homo sapiens
ctcgccacagtcggttccggtcggtccaggcagcccctcccccgtctcacgacacccggccccagacacgcaccatttcctggctttcagatgtcccggggtcctctctacacctcctgtgactacagcagggcatagcgtaggtgacagagtgacagaagcctgggcagaggaaccaggtccctctcggggctggaaagaccggatcccagccgcagcccgcgcagggacaaaggtgaggatagatgaaaggaggagcagcacacatacttttacgggagagtgactggtggtgattccctgaacatttcacatagaggaaaggagaagcgctcaatgacgatttcccaccaacatggcattgtgtcccctgtgtacccccaggtatattttgcttttgcaggctattgttccaccctgttgaagtggcctttcctcttcttttgggatatttctctcttcacagttgagaaaatccagaagacaggaatcatttctgttttccctcaatagcaacatccaattggctgaccagccatgtgtctccaattaatggaaactggagtt

SEQ ID NO: 1413 - DNA, 804 bp, Homo sapiens
gccctttattctgttgaaatgatacatcacattgattgatttgcatatattgaaccatccttgcatcccagggataaagcccacttggtcatgatgaatgatctttttggtgtattgttaaattcagtttgctagtattgagttgaggatttttgcatcaatattcatcagtgacactggcctatagttttctttttctgacatgtctttgtctggttttggtgtcaaagtaatattggctttgtaaaataagtttggaagtattgccttctcctctgttttggaatagtttgagtaggattggtattagttcttttttaaatgttagtagaattcagcagtgaagccactgggttctggggttttctttgctagcagactttttattatggctttgatctcattatttgttattggtctgttcaggttttttatttcttcatggttcaatgttgctatgttctatctgcctaggaatttatcaatttcttctaggttttccagtttattggcatatagttgttcttagttgcattaatgatcctttgaatttctgcagtatcaactgtaatgtctcctttttcacctctaattgtatttatttgggcctggttttttcttagtctacctcaaggtttgtcaattttgtttgtcttttcaaaaaaccaactttttgtttcattgttcttttctattgtttcttcatttcaaattcatttatttctactgatttttattatttcttttcttctactgattttgggtttggtttgctcttgcttttctaattctttaagatgcatt

SEQ ID NO: 1414 - DNA, 1774 bp, Homo sapiens
ctctagacaaatatacaaaaatcacacacgttatcactgtacatacaggtggacagacacaaattcacaaacccacaggtgtaacagcccagatactaaaagattctcccaaatagaaggaccccaggtgttctgatctcttctccaggtttctctggctcctcgggaataaccaccacagtgccttatatatccttgcttgctttcgtgtcttccagaatgccaggatcaaggggacagagatattagcacagctttgttgactacacctattagagggagttacacagaggaaaatacttactgaatattaggactcacacagacacatacacaaaagggttttacaaaaacatcatcatagacccacatatacttgtccttcaaaaagtgaatgttctcactcccattcctgtagcagagataccccttagttccccaatacctatcacaaaagatggctccttgagcccattctgacagtgaaggaatctcgaacttcctgacctcccacagtacaataatcatctctctacaaaagcacaacatggcagctcaagaatgtgaaaggacctgaaatgggttgagtaataatgttccaacccctcatactaccataaatgttcctggtgagagaagcgaatgtgtgcatctcctggctcagccaccaggtcctccactgcatctccacagtagccgtcacttccactgaggcctcatctgccagcaaaccttgctccagtcggcctctggaccctagtatcttcaccgtggttttggatgctgccacctgacccatccctgctgttgggggagggtggaggccagaggcctaaagagttccgacccgagcgacacaaagatcacttctgggacccacccagggagactgttgttacgagggtggatggtgacctggtttccctcaatgctgccacctcccttctaaaacacactgacttgctaagaaaaggggggactgactccaacaaaggacagacccgacccctatcgtgcctatgcaattcagaaaacggagaattcggaggctccagcaagcagtttattgggagttgagttcaccttgccttgtgatgtgaagcaaggtagttccatggcttgtgaaccctgacaccagcacctcccatacacaacagagctggagcgctgcagggtgggtccttttccaagaagagctaagtgctagtcttagcgggaggctaggaaaccagtcctggagcaggatgcatgtgacatgcactgacgtgagaaggccggagcatcatcagtgcatatgccgctgaatatctcagggtagaatgtgccagaaaacagggaaagcaagttaggggaggtaagaattctgagtgtcctacagctaagacatggcagagtgtgtctgtgactccactagcagttttgagattattctgactgtggtggttggtgcagggctggtaaccgcaggagagtggatgctgtgtggtcaaggggtgtgtgtcccatgatacaggctctgcttcttcagtctctcacctcagagccacctgcggttgccacagagaaattcagatgtgaatgtttaaacaagtgtccaaagtgtaggtttgagatgggaaatggagctggagatgacctcaaaacagccctggaataatgcaatgctgacaatgtctgtgaattaggatgtgcataggcagatcccacttggggaaaaactgtaagatgcgaacctttgtcttagaagtacagcattcccacagtctgacccgag

SEQ ID NO: 1415 - DNA, 329 bp, Homo sapiens
gccgccgcccggtgtgcgcgccccgcccccgcgcccagcgcgaacgagctctggagagacagtggctgcgagaatattgaaatttgtgaatatcttctggctcctaattttgcacccctggcaattatgcagaagatgatcagaaatggaaaaagagcaggagggtacccagggctttgtgaataggtattaacaactggtttgttgttactgggttttttgtttgtttgtttttttaaggaaaccagaatgtatctattttaagctctccttccctatagttatcttgtcttgctgcattatccacttaatttatcattgttggccag

SEQ ID NO: 1416 - DNA, 238 bp, Homo sapiens
cctcccatctcagcctcccaagtagctgggactacaggcatgcgccaccacgcctggttaatttttgtatttgtattttgtttgcctgtttgtttgtttttgagacagagtctcaatttgttgcccaggctggagtgcggtggtgcgatcttagctcactgcaacctccacctcccgggttcaagcgattctcctgcctcagcctcccgagtagctgggattacaggcatgtgacccc

SEQ ID NO: 1417 - DNA, 2104 bp, Homo sapiens
ggctgggtgtgcctgagtgtcaaaacctcaactgtacaatgagcctagttagaacattccctgtaccaaccgaggaatttataaggttcccatgagagtcgcaatcttttgtgactgggagacaattgtaatggtatcgacccataatcgtacctgtggctctatgcccagatatgagagttaacacctctataatgactgggtccagatatgagagttgttacctccctataagctaggcttactaatgagtcaccacctcagctgttgcctgatgttcacatatgacagtcacaatttcaactctgcactgcatccacatgtaagatttaagacctctccagtaggctttgtccatggatgagggtgacaatcttaacaattggcaaagtgtgcatacataaatcacaatcccatctgttttctagagccgttatgacactctgtataccacttgaggactttatacaatatgtgagagagtgtaattttctctgaccttcctaaaaagagaagagtgacaatcttacccatgtacctaagcccacatatgagagatagtatgtctcctattgactggtttcagatatgacagccaacattgtgcctatgatctgaaaaaagatgtcacaatctccactgtggatagggagtgagcaggagacttatatcatctgggtaataggccagggatatgtcacaaacttctctgagagaaggcaccaggcagaagaattaaaacctgggtgctcagtcagggatatgttaaatttcctcctgaaaccagggcacagacagtacagtcacatcacctgggagctgagacgagtgatatgtcacaatgctccctatgagcaaagctcaggcaggagaaacacatcacctgatttctgggtcagaagatacgtcacaatctctcattgtggggaaaccttggtagaaaaggagagtcacatcaaatagttgatgctcttaaagatatgtcacaatgctctgttgtcatggtccatacaggagactcatgtcaccatgttgctgggcccagcaatatgtcacaatgccttttgaggtccaggccaaagcaaacagtaatgtcacattggcatagagctccacaatatgtctccatctcccttgccagcagaacttatgatggaagaagaaccacacttgttggtactgagccaagggatatgtcaaaattccctctgtgagcagggaccaggcaggagaagagagtcataacacctgggtaatgaatggaaatatatgtcataatgctcctttttggcagtagagttacattaccagggtgtcaaacccagcaatatgtcacaattgcttatgtggtcggggaacaggcaggagagtcacataacctgggcatagggctcagagacatgtcccaacgccttccgtaggcagtgccaaggcaggggaggagactcaaatcatttaagtgtaaggtccagcgatatgtcacaatgtcccctgtgagcagcaccaatgcagaaaaatagaatcacatcccctcagttctgggttcagctatgtgtcactattccatctgtgggctggtcttaggcaagagagtcagatcactcaggtgctgggcagagaaaaatgttacaattaaacctgtgggaaggtgcagagatgaaattaacaatcccacacatgttccggttttaggtaaaggaggttaacccttcctatatgttgtgtctaagaacaggagttacaatgtcaacagtgaactaaatttgtacctgacagcctatactcctcctgtggactttgtctaattagtgaagtcacagcctcatacgcatgctgaatcttgctctgagtgtcaccaactcacctatggactggatccatatataagagtcaatttttccacctttgacttcctctaggtgtgatccagaacttcaaaagtgggctgtgtttatgtgagaatatgatgatgtatactttttgatgggtgttcatataacagtgaaaatctccaggccggctgcagtggctcacacctgtaatcccagcactttgggaggctgatgcaggtggatcacgaggtcaggagatcgagaccatcccg

SEQ ID NO: 1418 - DNA, 782 bp, Homo sapiens
ccttgcttgcaggaggtctaaggtttcaactcacacactggatcttactgattgaaagcagcaaatatgccatgattgactaatgatgtctgccatgggtgtggaatagacaaatgaagacaaaaattcaaatacctcactgagcagcagagtcttaatccatcaggaaagcctatgaaaaaagaaaaacagtcttcatttacacattttttctctgtaacaaaatatgttttatgttgaagagcggtacgtaatttctactggggttgatcagatgaaaagagagagaaatctgaagctggtggtagccgtcttgcaccaagagaagagaagctatctgaaaatgaagaccaagctattcttttaggattgcagtagaaaccagccgagacaaaagatgccggagttcttggaaaaatgaagagaagatttggacatgacacatacagggggaagcccacagggagaagatggctgtctgcaattcagaagagcagcctcagaagaaaccaacctgccaacatctttatctgcgacttgcagcctccaaaactggtgtgtgctgtcagagatgggcaaggatgggtgccagccattggagagctgttccagggagggagccggaccttagccagcccaggcagcaccagagaaagactcatccaacactgaaatagacggccccagtgtgcgcgttacaatagcagtcgagatactaagaaaatgagacgtgcttcatctacaccacacacaacagtaaccaggacagacttggaaatgac

SEQ ID NO: 1419 - DNA, 686 bp, Homo sapiens
ccccaccacccttgcacccagcaaaacccagtccctttggcttcctgacatccgtggcagccagaagattcagtgctagaagcctctttccccaggagcagaggaacccgatggccctcaagaatcagagaggaagtgcaggtggcatgccacaccgcctttcctagaaggcaaatgtcaggaacggtcgggttgcctcccgctcttcctggaccgaccacggggcaacagagacccagaaagcttccctgtcccagacagctatggaagcccagagctccaggatcaccacacctgcccaattatgctgaaagaggtttggagaaggaaacaatcatgacaccgacccccaggaactttctcccggatggactgggaagtcttctgggttgaagacattgagccagactaacaagcccctaggcctctcagaaacagggcagacagagcaagagggaggacagagcagaggccagagcccaggcaggattggcggcaatgccaccaccacggccatccggggaggagtgccaaacgggtgacttggccacgaaggccagcgttggagccacagagatgtttgccccatcccgttgccggcttccttttccgtccctgtatcgagctgtggctagatttctcagtgagggcacacgcgagaggattgagaggagtgaggtcgatgg

SEQ ID NO: 1420 - DNA, 415 bp, Homo sapiens
aggcgtgcgcggacggtgtgcgggtgagtctccccaaaagtggagcccttgtgatgacgagcacaggtccgcctgcgtgcccgtgggctgctctctcaccggtggctctcagtcgcggagagcagaacccggcagcttcaggggctgcctgcgggtgggtgttccctgctgtacgtgtgtgttcgtcatgggtgtgtgtgtgtgtgtgttggggggggtgcgtctgtgtgtgtgcgcgcgcagtgcctgtctgtgtgtcgacttctgtctctctctcacgtctctctctctctctctctctcccttctcgctctttccgtggccctctctttctgtctctgtccgtctgtgtgtgcgtgcgcctcgggacacatgtgccctgtgcgccggagggtgggtttcttgcacgtcggcc

SEQ ID NO: 1421 - DNA, 1437 bp, Homo sapiens
ctgtaaaagatggtttgcaggccaaggaagaaatctgaagatggaatgatattacagaattatgaatattttccttaagggtaattatggtactatggttatatgatattgtctttatgtttgggtaacacacatgctgatgtaacaaggagtaaagtgtcatgatatctaaaacttattctcaatggtctaaaacttattctcaatggtacaacaaatatacaaaaaataaatgtggcaaattgttaacaattttgaatctaggtgggggggatatgtgtatatattttactattctttcaaaacccacaacaattatcaactaggttcaccatcttttatgggcaggatttgtggtatccccaaacaattacactagtaacaattacactagtaatcaaaaaacactggtcacagatcaccataacagatttaacaatgaaaaagtttgaaatattatgaaaactagcaaagtgtgacacaaagacatgaaatgtgcatatgctgtttggaaaatggtgctgatagacttattcactgcaaggttgctgcaaaccttcagtgtgtataaaatgcagtaactgcaatgcacaattaagcaaggtacgcctgtatccagtaaaatatttcacgggcagtaaactgtgaacatggcagctactctacattcctcacatcagtaactttctcaccaaaattatcttctctgaactctaaggcatttagtgtggctataaaatatcccacattctttacactcaaaggagttctcagcagtatgaatactctgatgttgagcaaatcccaggccacgatgaaagttcttcacacattcttttatgttcacaggatttctcatcaatatgaattctctgaagttgagcaaatcccaggccatgatgaaagttcttcacacattcttttatgttcacaagatttctcatcaatatgagctctctggtgttgagtaaatttttcgtacacagtgaaggcttgtccacactccttattgtcacaaaatttctaactattctgaattttctgatgttgagacagctgatcatccacagcaaatgctttcccatattccttacattatagcgtttctcaccagtatgaattttaacatgttgaacaatgtttgagctacaactaaaggtcttcccacattctgtacattcacagggtttcataccagtatgaattctttgatgtgcagtcaggaccaaactaaatctgaaagttttcccacactccttacattcatagagtttctcaccagtatgaatactctgatgttgaacaaggtttgagccactattgaaggccttcccacatttctcaaattcaaatggcttctcgccagtatgaatgacctgaagtccagcaagctgtgtcagaaaactgaaggcctttccacattctttacattcaaag

SEQ ID NO: 1422 - DNA, 2866 bp, Homo sapiens
ctggtctcgaactcctggactcaagcgatcctcctgcctcggcctcccaaagtgctgggataacaagcctgagcaactgccccctccgccctgccccacctcctttgatgacttcttaatgagctatcctgcggaccccacaccctgcccctgctggactcagttggctgacctcgccccaggggctgctcatgatttgaaagttgtcattgataaggcggataatggtgagcagacgctcatcatcatagtcgaagcggctgccgaagagcacggaacagataatgttggaccgtgagcgactcagcacaaacgtggggtcaaagggctcgcctgagggtgaagaatggaatgggtcaggaagacgcgatgtgcagcacaccagacctcatgcagcaacaccattaatttgcacaacatccgactcaaccatggcaacgtgtcttacggtgcaaacacgggcacatggtcacaacatgctgcttaacaacaccccaaaagcatctgtcaatgccacagacagcaccgaacccacagcttcctgcagcacatcgacagcaacaacgcccaaccacagaacaggttggcaacacacacacagcacgcgacatagcacaaggcaatcatcaggcatcacggaacacaacaacacagggcaacagaacacccagcaaatacgatcacagtacatgccaacacacgacacgcagtgacctaatagccagcccggaaacatcccaagacacggtaaccacacaccaacacgtaatgccagcataccgctacataatcctgccacacaacacacgctagtacacagcaacccagcagacagcacagaacacacgatgtggcatcacaacacatacagtcaaggcagcagaacaaaggacacactatgcagcaacgcaacaacgttggcagccagcagatgacacaatgcaaaatcacatgcagtgcctgacaactctacaatctcacccagaaatatctcaacacaacacgtagcatctggccgtccaacagctgaacagaccatagtaaatactgaacaacacatttctttctttccttttttcgagatgaaatctcgctccgtcgcccatgctggagtgcggtggcacgatctcagttcactgcaacgtctgcctcccaggttcaagagattctcctgcctcagcctcccaatgagctgagatcacacccggctaatttttttgtatttttagtagagatggggattcaccatgttgtccagactggtctcgaactcctgacctcaagtgatgtgcccaccttggcttcccaaagtgctaagattataggcatgagccaccgcgcctggtctagtttttgtattttttgtagatacagggtttcaccatgtcgcccaggccggtttcgaattcctgagctcaagtgatccaccaccttggcctcccaaagtgctaggattacaggcgtgagccaccatgcccggccaaaacagcatatttcaacacagcacccaggacacaatagcacagcccaaaaaaccagatctggagttagatggacgcggtttgaatcctcgttggtctcttagccttggtgtgacttgggcaaactgacttcctttttccgagcctcagtcttctcatctgtaaaatgggcctgatggcactcctctcatcctggggctactataaggagtcagtgagtgtgtgactgggagtcagtgaagggcctgacccattgcaaggctgttacagatcatggtgttgtggcaggttgtaatgccccccaaaagatgtccaggtccttatccttacaacctgtgaatttgttaccttacatggtaaaaaggaccttgcaggtgggattaagttgaggattttgagatgagaagtttactctagactgtctggctgggcctaatgtaatcacagggatcctttttagagggaggcaggagggactgagtaagaaaagataatgtaggctgggtgtggtgggtcacacctgtaatcccagaatatattgggaggttgaggaaggaggattgcttgagcacaggagtttgagactagcctgggcaacatagcaagactccctctctataaaaagttaaaagaatgagttgaatgtggtggcacatgcctgtaatcccagctacttgagaagctaaggcgggagaatcagttgagctcaggaggtcaaggctgcagtgagccaagaccataccactgcactccagcctgggcaacaagagtgaagcttcatttcaaacaaacaaacaaacaatcaaacaagtaaacaaacagaccccaaactattattttacttctggggcccagaattccaaaatcagcttcactgggataaagtcaaggtgtcagcagggctggtacctcctggagccttgataagaggatccatttcctcgccttttcagcttctggtcgcccctttattcctttgtgcgaagccccttcatccatcttcaaagcacatcactccagtctctgcttccatcctcacattgtctctctctggctcttcctgcactcctctttttttaaaattaatattgccacattattttaaattatgtacaaagacctaacatgtcactcagggaccatttcacccactgctctatttagccgccagtctcttcagcaatggtgagggtttggtgtacacattatttcatcacccaggtaataagcatagcacccgacaggtagtttttcggtcctcaccctcctcccatcttaccctcaagtaggccctgctgtttgttgttcccttttttgtgtcaatgtgtagtcaatgttcagctcccacctataagtgagaacctgtggtgtctggttttctgtcc

SEQ ID NO: 1423 - DNA, 918 bp, Homo sapiens
cttaatttcccttattccagctttaaaatactatctccctcatttaaaaatagtaatttagtttctcaaaagaactttccttttgaagcttttcaaattcatatctcagttccactttgctgtatctcattgcacatgatttgatgagaaacatgcttcatgttgtctttaattaggtttttgattacttaggtgctttgaaagaattaagaattaaggtttttttttttaatccatgtaatgttctgtatttgcttttggaatctcttttcactctgattaagtgaatgactattattccacaataatctgtgattctgttttaattaaatgttttaaccattttgacatttttggcaggtctctccaggatcaaagttctaaattaagtctttttgacctataattaactgagagattttccagttgggcccctggagaaccttaaaggaggtatcatcttgtagagatgttaaactaatttggcttatttgattaattgtatgggaatcaatgtcaaataataaagtgatgctatattttctttaagttacatggatatgttattgatgtatattaaatattatgtgaaatttaaaaaggtctgatggtcctgatgtaatgctatcaaccacgattctggttgttaccttaaaatgctaaatacaatagaaataattgaatttccttctcaactgctgaactcccatcagatttttaatgatggttattctaagtctttgacatccatagttttgatttttctctaaaggtatctgcaatcagattcatggaaaagactctaataagtactcttaaatacaagtttctaataacttcaagattaatgaactaaataaaacttttcacaactgcagtgaagaaactgatgaatttgtgaaactgctaatcaagatc

SEQ ID NO: 1424 - DNA, 363 bp, Homo sapiens
gcgtgtgtcaaaaattcacagaactgtgtaccataaagagaatttaccatatgcaaaccatctatctttgcgtgtgtgtggtttttttttttggtctgttttcaggtttttttttttttttttttttgagaatgggtcctaaccactttgcccaggctggtcttgaacccccaggctctagcaatcctcctcccctggcctcccaaagttctgggatttacaggcgtgagccacaatgcctggcctcatttcaaatttctgacctccagaacggtaagacagtgagtttgtgttgtttggagccactgagttcgtggtaatatattacagcagcaacagggaactaatacaagggaagagaag

SEQ ID NO: 1425 - DNA, 347 bp, Homo sapiens
cgttaattacatttgcaaggtttctatccagtatgaataatttggtaaagcctgaagacacactactgattaaaggtccttccatgttaagcacactgatatgacttttttcctgtataaattctctcaaactccaaaaacatgaacatttgatttttttatttttttgagacagagtctcactcttgtcacccaggctggagtacaatggcgcaatctcggcttacagcaacctccacatcctggattcaagtgattcttctgcctcagcctcccaagtagcgggattacaggcacctgccactgcgcccagctaattttttgtatttttagtagagacggggttt

SEQ ID NO: 1426 - DNA, 1102 bp, Homo sapiens
catttcatctgtacggtttctctccagtatggattctgtgatgatttgccaggtttgaatttcgagtgaagtccttaccacattcatgacatctgtacggtttctccccagtatgaattctctcatgtttttttaggtataacttgtggctgaagaccttgccacattcattgcatttgtaagacttctctccagtatgaatttgcctatgtcgtgcaaggtgtgaattgtgactaaagactttgtgacattcactgcatttgtaaggtttctctccagtatggattctgtgatgatttgcaaggtttgaatttcgagtgaagtccttgccacattcatcacatctgtaaggtttctctccagtatgaaatctctgatgattgcttagggataatctatgcctgaagaccttggcacattctttacatttgtaaggtttctctccagtgtgaattagtagatgggcagtaaggcctgaacagtctctaaatgctttgccacattcattacatttgtaaggcttctctccagtatgaattctttgatgtcgtgcaaggtttgaattgcgattaaacaccttgtcacattcactacatttgtaaggcttctgtccagtatgaattctccaatgttctacaaggtgtgaattgcgactgaagaccttgccacattcagtacatttgtaaggtttctctgcagtatggattacttgatggttagtaaggcttgcacggactctaaaaacttcaccatcttcactacattcatattcataagattttcctctaatgtatgctttctcttcttgtgggagtaatgggaaatcaataagatcatttctatatttattaaaaatgtgtgttgtgaaactagaagaaattttttgaagtggtgaaactgaggaacgatggtttgtaaacttttcaacttgattacttctgtaaattttccttccggcttgaaacagctgcaattcagacagatgtgcctcaagggttaatccaagttgatttttaataggcttgttttctgcattgcttcccaatacacagctcctccctagaaaagaagaaagagtagaacatgaacccatgattctggc

SEQ ID NO: 1427 - DNA, 1273 bp, Homo sapiens
ctcggggcttctcagcctcacccctctcccgttattttttctgggcttccttcgggtgcatccccagtctctgtgtctgcctctgtttctctggatctctctctcttcctgtctcagtccctctccgtctgtctctctctgggtctccctcttttcctgcacttgcctttctttccccaggtaccttctgccatccaggcccttctaccctccatttctttcatttactatcttgctcccccgctccctctccgcatcttcttctctctttaaagcttccttctctctagcaagaccttgcccccatccccaatttctctccctacccgctctccatttcattccctctcccccctctctcccccatcctctcagtctctctctttctgtctgtctctccccatctgtccctcctccctcctctctggatgactctctccctctctcttctttccttctgtttcccagatcctgaccccccccacacacacacttaccccagccctcccccaccccctcccccccagcccctgcgtttctctctttgagtctctgtccctgtccccttctctctctggatatttctctgtgtgtatctctccaacttccttctgcttccagccgctgcctcccccaaatttctccctcccccatttctgtttcgcggtctctgggtctctctctttccgtttctcctcgtctctctctgtctctctccctccctctctggatctctctcttctcctccggcttccttctgccactcgaccctgcccccctctttcccttcccccatccatctcctctccgaggctccccatccctcagcagctcccctccccctccctccctactccctccctctcgtcctccagctccgcactttacccagcgacacgagaaccaaattgtctcctcaccttttttttttaatatatatatcccgaccctcactcccttggggcccaggctcagagctgccccccagccccagcctgacctcagcacccccattccccatacgcctcctcatctccactccccgaaccaggtcggacgcctgggtccctcactgctgggggagggggaagcagcgagaattgggagccaaaaggtttttctggggggggtgccaacagggggggctcgacgtcccctcctccgtgcatcggagagttgacctatcattaacagagccgccgaccatggccgcgctctgaccccctccccggccgcagcctcctcctcgccgcccccctccccagccccgccg

SEQ ID NO: 1428 - DNA, 404 bp, Homo sapiens
ctgggcaacagagaaggactccgtctcaaaaaaaaaaaaagaaaagaaaatgtgagggcgcggtggtggctcacacctgtaatctcagcacttcgggaggctgaggtgggtggatcatgaggtcaggagttcaaaaccagcctggccaagatggtgaaaccccatctctactataaactacaaaaattagccagccgcaatggcaggcacatgataatttggtagatagggggccatgaattggggaatgctgattggttgggttggagatgaaatcatagggagtcaaagttgttctcttgtgctgagtgggttctgggggagagggaggcacaagaccagataagccagtttacccatctgagtggtgccatcagatccatcaagttcagggtctgaaaaat

SEQ ID NO: 1429 - DNA, 2151 bp, Homo sapiens
ctgctgagccgcctgggctcccttagcccttctctccacaggacaaataaagggtgagtttactgagttcatgtctgtgaacataagtaattgagggggatgctggcagcagcgagggtgggtggatgacgcagtggaggaagcccaccacccagggctgtgggcacgtgtgtgctgtgcgatttccacctaatgcctttctttctggcactgcagcctggaagagcctcttgtcttcactgaaggtctacccatttgttctctcctgaagaatgtggcccaagcatggggtctacaagaggtgaccagagattcaagactcgagaagggccagggtcccctcgaggcagagatgagcttggaatccaggacagcaaagagctgagctctaaggcggaagaaagggagactggaaaggatcagcagacagagctgcccctgtgcttgcccctgagggacttcccggactccgctccggtcatgtcctcagactcgggacatgcgacggagtctctccaccttgcatgtgggtttgcgcgtacgggtgtggggaggcaaaatttccaagtgcacggtgggagggggctgtccctattgggaaaaagcaggaggctggctctggaaagagccttctttgtctctgagcccagccttgcccgagccacctgtgctgtgaactctggagaaggtaaagagccagccccgcgtgggacctgcaggcgacgtccctgtcagctgtggggtgggaaagtcactctccctgctccctgcacatgttctggggattttgcccatgtcagctgctctttctcagcggccctctctcctgccagccagcgattccaagcccccaatgcccacacccaacgagggccctggaagcaccgtgggacatgcgggccctccgaggacagtgaaggctggtgggggtcacccttctctgagagaaccagaatcctttgcttcccacacatattcccctattatcttcctaatgtgttccttattctggagaggtagaattaaaaaataagaaggggaaaaagaaaagagaaatgttttgccttagttggacttcgtttaaattgtctccttccaagatgcagaggagggttcaccatgatcatcattattattagagtctgctctagaggggaaggggaggatggaggggagccagccagggctggagcgttctcctgactgtgaccttggcacagcctggctgtgaagacaaggaccagcccacaagtctaggcctgaaggaggaaaaaaagttgcctggcaaggaccgtacgtctcagagtcttcccacatattttgccagatagtaaaactgagtccaaaaaggaaagtgtcttgctcccaatctcaaagcctgttaataacagggcaggatttttataaaggctgcaacaaaatcagccaagagaatggaccctaaactctgaagtggattatttattattcacaaaaccgtaggcttaaaggcatgcatgcagataaccaattaaagagccttcgctggtgttttatcatcctgcgctccccaggtgctgggggcccagccaggaggggctcaggtctgcagtggccctctctgacccagcccctgtttcgttcagcattgaggtctcacaccactgcctctgtcacagacctatgtacagaaccccagctggctttgagagggctccaggtgtctttgccgcgtctacacctggttggtgttatctatgcagaacaccaggtaggaaatctgggtttccatctaaagtgcttaacggtgattatgtgatcacggtgcgtctgattcattatctgattttcatccccactccagccgcatgagatgagcatttcttttccttttctttttgcttttttctttttttgagatgtagtctcactctgtcacccagactggagtgcagtggcgtgatctcagctcactgcaacctctgcctcctgggttcaaacaattctcctgcctcagcttcctgagtagctgggattacaggcacgcgccaccacgcccagataatttttgcatttttagtagagacaaagtctcaccatgttggccaggctggtcatgaactcctgacctcaagtgatccgccctcctcggcctcccaaagtgctgggatt

SEQ ID NO: 1430 - DNA, 1134 bp, Homo sapiens
gggccggccacgggccatcgtcaaggctggctcttatcactgtgaccaagctgtgcatcctgggacatcctccgtgttcatgctgagccgggattggaactcagagctcatgtctgctgtgtacacccaccatgcaggcccccaaagcaccctcctcatgagggggcctgcttctgcgggatcctgaagtgaaactggggtgcacagaagaattttggttgactgcaattcaatgaacattctgagaagcagaatgttttgaaggcctaagggttgccagtgaaaaaaaatgcattttttgctattattgaaaatttttataaactgcacatgactacggtaaactggctcacataaagcagtacttgtcatctgctaggctggatgtgatgggcgcactgttgaatttagtcttcatggaatttcttctttttatttttacaggaaaaccaagacctgaagaggcaccgatggtgatctcatggaagaggagtgtcatctctgcgtgggatgcaccacccagacacggccaccgagcatctgcgtgggatgcaccaccccagaaagggccaccgagcatctgcgtgggatgcatcaccccagaaagggccactgagcatctgcatggaatgcaccgccccagaaaaggccactgagcgtctgcatgggatgcaccacccagacagggccaccgagtgaagaggagtgtcatttctgcatgggatgcaccaccccagacaggaccaccgagcacacacattgggcggttgctcagggtcacccaccgaggggcagaatagagcctggagccgctgtttgctcccagccacagacaccgggcaatgccgcctctcacactgtcctgaaagtggatgggtggctgtcagacttcagtggatctatcctcccactccccgacataagcaaaacttcctcccctccatgcttcctcagctctaacagttctcagcatcctctcagctgtgcaaactgaaaactgcttgtcattctcaggttaaaatgcatccaccattcctgtgacacctgccgccaatattctaggtcatcgtctcatcttttatccatctccacagccaccctttgcctaaaccaccattgccactgtctgactga

SEQ ID NO: 1431 - DNA, 3469 bp, Homo sapiens
cctacaggaagcacgcattctggttggtatccccgtgccgtaagtcctgcaggggccggtgaggggaggcctgggggctggctcgtgtttgggtctggggctcagcctcagaggcccatcgctgctgcttccccatcctctcccccagcctgctgcgtgtctgcctggctccccgttggttctggagctcctgcggaaggagaggtgctgattttcaggattcctaaagcagcctccgcccgtgccaggggattcccatgccctgtgccacgtgtcccagcctctggtgccatgcctcacaatcaaccacttgcaactcttttaggcttttttctttgtatttatctttatgttcctaataatatgctgttgtaattagcccttatcaatgagctatgatctccggactcaccacatggcagctcaggcttcgctcttcacagtcctccttgctctcttcgccctagcgatgcagcgatacgcggttaagtgaagacattgtcaagtgcctgtggctgcccctgcctcctggtgacatctgttcccttgtgagcagcggagctctcggggcgcgttcccttcctgcacggcgccctactaggctgtgctgtggatggattgactttactggaggattctgagtgattaataagtcatcgcatttatagactgaggagcaaatcccgtgacatggacagatcataaggctcagaggacgacacgccgggtgcaccgtcagcacagcatccatctcagccagcggccctgccggcttcccagtttccgcaaccgaaggtgcggtatccccctcggttccatgcctaccccatcaaggctgcagtagagcccactgtggccccacctccagattccttgagtgcacccaactcctttctgcttccagtctcagcctcatcaactctggatcagtccttgccccagccgctgctgtagtcttagaagtctttctgcttctatgtgtcacagtgatcctgtaataccataaaggagatcgtgtcccatctctccctaaaattaaaaaatggtgagattgaagaaaggatgcagggctggcagagtctggatcctacccaccagtgccctgcgtatgttctccaggacacacagtcatctgtatctttccccttgtgtgtgcatgggactctccactgctctggatcacggatgagctcttaaacctgcgttgtctggctcccccgactcaagtctctttcacccccaccagcctgtttgcttcgcctcctcagggtgccaagctgtttcccaagtgtccccagctttctctcagctttcacctttgcctctgttgctccttcctgggattttcttttaccagttagtcgcaggactatttcattatttattatctttatgcctcagcaccagtgtcactccccagagatgtcacctccctgagcccacatcacccccgtggccttccctgaccacgttattctcgactatctcagctgcctgcccttcccctctcccccttcccctctgtcttacaaattacaagctcacaacttgatgtagcttgaggcaaatggggattcactggctgctgtgattggggagttggagtggactgtaccaaagatggccgggtactgagactcaagtgtggccctaggaagctcccttccccatgtcccagaagtccccttgcactggcgtatatttccttctccttgggcttccatattccctgagacacagcaatatttaactcaggcccattacaaccctgtaatggcctctaggtgttcaagtgaaaggaagagtttcacatttctcactttaaatcagaaattaggaatgattgagcttagtgagaaagtcatgtcaaaagctgagataggctgaaagccaggcctcttataccaaagagttgatcagcttgtgaatgcaaaggaaaagttcttgaaggaattaaaagtgctagtccagtgaatacataaatgataaaaaaaaaagtgaaacagccttattgctgttattgagaaagtttgagtggtctggatagaaggtcaaaacagccacaacattcctttaagctaaaacctaatccagagcaaggcctctaattcttttcaattctatgaaggctgagagaggtgaggaagctgcataagaaaagtatgaaactggcagtggtttgttcatgaggtttaaggaaagaaaccatctctataacatagaagttcaaggtgaagcagcaagtggtgatgagaagctgcagcaacttatccacaagatccagctaagatcattgattaaggtggctacactaaacaacagattttccatgcagatgaaacagccttctattggaagaagatgccatctaggactttcagagctagagaggaaactcaatgcctgtcttcaaagcatcaaaggacaggctgaccctcttgttaaaggctaaggcagctggtgactttaagtcaaggccagtgctcatcaaccattatgaaaatcgtaggacccttaagaattatgctaattctactttacctgtgcactataaatagaataacaattcctgggtgtcagcacgtctgtttacagcatggtttactgaatattttaagcccactgttgagacctactgctcagaaaacaaaagattctcttcaaaatattactgctcattgacaatacatctagtcactcaagagctctgatggggatatacaaggagatgaatattgctttcattactgctaacacaacatccattctactgcccatggatcaaggagtatttttgactttcaagtcttatttaagaaatatatttcataaggcattagttgccacagatactgattcctctgatggatctgggcaaagtcaattgaaaaccttctggaaaaaatgtatcattttagatggcattaagaacatttgtgattcatggaaggaaggaggtcaaaatatcaacatgagcaagagtttggaagaagttgattccagtcctcctggatgattttgaagagttcaaaactccagtggaggaaatcactgcagatgtggtagggatagaaagagaattagattagaagagaagagtgaagatgggactgagttgctgcagtctcatgataaaacctgaatggatgagaagttgcttcttatgaatgggcaaagcaagtggtttcttgagatggaatctactgctgttaaagatgctgtgaacattgttacattgcaacaaaggatttagaatattccataaacttagttgataaaactgtgacagggtttgagagtactgactccaattttgaaagaaattttactgtgggtaaaatgctatcaaacagcatcactgttacagataaatctcttgggaaaggaagactcagtcgatgtaacaaacttaattgtcttattttcagacattgccacagccaccccatccttcagcaaccaccaccct

SEQ ID NO: 1432 - DNA, 794 bp, Homo sapiens
agagggacgaccacctgaggatccctgagaagatggcatctggaaggtgaggagagaggcctcagaaggaatcaactctgctgatacttgatgccaacttccagcctctgaaactgcgagcaagcagagacctgggctgctgagaaggggccggacttggagatctgggaaaaagcatctcagttgagggagaaatggagcaagcctggagccctgaagagcctgaggactttgagaccagggagcaggtactggtcatggggcatgggagactggctcaggcaggaccaggcagggtctctgtccctggtaaagaatgtgggtattattttgagtgacaggagtggcatactcagatctgctttgggatgatccttcctgctgctgtgtgaatgctgcagccagaaatggtgctgggggtgttattaggatgctgccatgacccattcagagatgatcgtggctggaccacagtggggagaagagggggatcatcataacctgttcctggaagccctgctgggcgtgaggggagtggaggaattaagaatggctcccaccacttgataaatggagaaacccaaagcagtcgtgtggtttttgaggtgtgggggaagtgaaggactcctctttgtataacgtgtgagcttcctgacatgtcttcatgggaatagaaggttggccttgggatgtttgcatctggagctcagaagaacaatactaacctggagaaacatgggtgccatttgcttagggtgttgttagaatgcatagaggatgagcataatttgggg

SEQ ID NO: 1433 - DNA, 366 bp, Homo sapiens
caggagccaagcaaagtgttggtttccgggagaaggactgaggcaccctcaatgctgcagatggggcgtcagatgtgggggagaacgagctggagatggacacggacatggaggtgtggatggccctggggaggccccctggcagctggtggatggcaggagcggcgtggacagcaggagcagcatgaactgcaggagcggcacgggataagagaggtccctttaagacatggcagtgaaacgatgaaacaggcaaaagctggttggagaggagtcatcagagaaggagctttaagtgaatttcttgacgatggtgcgcggatggatggaggaagcctccttgctgatatagagttgtgatccggg

SEQ ID NO: 1434 - DNA, 532 bp, Homo sapiens
tcaaagagatgtgcctcctaaaaagaaaaatgcattactacatatgtgagtagttcaaaagatgaaagattaaacatgttgaatatttggaagaattacgtgagtctgagcgaatttgcatcattttactaatctgaaagtttgctattgtagaatcacaagtgaacatgtgatgtcacacttttcatgattgctgtgtatacaacaagagcactttaggctcagggcattgtacagagccttagaattgagagattgtggactcagaggagataaagtccttaactgagaatgcttatttgctgaacagatgcattgagctacttacagaacatatgcggggtgaagatgggggcagaggccaagaaaagtgtcttagtgcacaaagttgtgaaatctcaggcagttccttgtagcagtgtgagaacggactaataccgcagccaactcttcaaaccaggttgaaataaggcaaatgcctcactgcatccaatctagctgtttctgttcctcacttttgttttctgtccac

SEQ ID NO: 1435 - DNA, 588 bp, Homo sapiens
gctgaaacgtggtaacatagttttgatgtctggtagctcttcaaagagaaaccatctaaatgcaagggtgtgtactgcagcagagtggttttgtgtgcaacttctcagagggcatggacacaggtgtctgcatttgggccaggtggctccacccttccagagacagctgattaccaaggtttgcacacacacaaatttttctctgtcaagctaagtggcaaacaagaatggatcagatggggttgagccctggagttttaagataaggcagggtcactgtcatggcagctcaagacacatctgagcaaatgctgtggaaagcaagagtgaagaaccctggggagaagctgggagccagagagggaaaataaagaaagatgccgtggaacatccgtggaaaaccgtgtcatcctggagaaaggtggagttacgcagaggagtgcgttccctgggattcttctgatgttaccggacaacttgaagagaaacttaaaagagctgctccctgtctcacctcagcaaacatccccttgtgtgtggctgggcctggcagctaaaagtggaatatgctaaaaggtaagatggacc

SEQ ID NO: 1436 - DNA, 1964 bp, Homo sapiens
ctcagacagacgctgctcactcactgactgaactgctcggggacaccactagcatttaagtcacggctacctcattatgagttgcttatgctgggctgcagtgtagctttcctttggattagaaaccccatgaagacaagactgcacacagaaagaggtgcacttcagaactaaagtgcacctcttcctgtttcgcctgcaaagaaagggaactttcttttccctccattttttaatttgcacagtattggtttccatcttagaatttgcaactgttttagcctcagaatagtcttgtactccttgaagtccctggaggtttcccagagcctaatcctcctcctcctcagttggtaactgggacctgagatttgtttcatggagtctgtgatagaacttacatgaatgtgttgatgtctatgctccagaatcattccagagcaatggcccgggccactgagtttcaggtagcaggacaggtggtcctggggagggtgacaggcccttcagctcacacctcttcaaataagtggctcctcaggttgccctccacacatctttctcaatggcgtcattttctttccagtgacagtgacagggactgggaacctgggagcttctcagcatctccttttcacactctgcctctgagcagctgggaatccttacccctccaatctcctgactgctcatctccctggagccaggaccctgaatcagtattcacggcctgttagtggcttgcaaggcagagcagacagatggacgtgctcgggaagcctattgatcagcccttggtgtgacctgcccagacctggttctgtttcaagcactgatcacgtggacaaggagtccttaattcctctcagcaccatttgagatgagcaactacacaagacaaagacgaaaggctttttcagctcaaaaatcctgtgattctttgattctaagaagagattttcttacaaggagtttgcctaagtgtccacacggcttgtgtctcctcccagcagccggcctgctggtgtgtgtgctgtgtgtggagagtggccttaggcctgtgttgtgagtgatgtctgcagagcatggggttgatttggaagaaggtgtgatccgaagttgtgtttgacctgagctcctgtcacccctgaaggcagcagaggatctcctgtcagtgacccaggaggacagctttctgaaggacattctgcccattgcacagaggggcttttgtgattggtttgcccagatgtgactttttcccctacctttgaaggcctagattgggtttcccatttcttggccctttggaaaggccaatggctccctgtctgacaggctgccctgagcagcaggtgctccatttagacccaggctgccccaatcccagctctgatctgactctcagctctgaggctccattgagtccctgggcctcagggaccctgttcaggctttgctgatggtggcatcaagtgacctccgagccacctccacgttggctcagactgaggaaactggtgatcttgtcttgctgtttgcaatacttgaagacaaaaacagaacttgtgctgcattctcaagaaagaagagacaactgttcctgtacctcactcttgtagatatctgtatgaagaagcagtgatgggtgcatgcaagctagggagcatcaaggctcccactgcgtgggcgccagctgacccctgacctcgttttcatctgttgctctggtcatggctctgagatctgggcaacctgagccagcttgtgcattccttacccttgtgcttttgcactatccatccctgtcccctagaactccctccagtacagtctgctccaccccatcccatcccatcccatcccatgccatcccatcccctcacctcactccatcctaccccatcctaccacatcccaccccatcccattccatcccagcccacaccaccccaccccacccc

SEQ ID NO: 1437 - DNA, 2583 bp, Homo sapiens
aggcagcaaagcaccccaatacgaagagatgaatgataatcaaggaatgagtgaatttgtccagtcgcgtaaacattgacagagacaaagcagcatcacacttcttcattcacgattgcaagtcctgtgggtcgttaacttttttgttgttattgatgttgatggtgtgataggctgggccattcccacaacagcattgcttgtttcggactcttattagcttgatcaatgcgatcgcctcttcctactgatcctccgtgccagcgtctcctcactgtgttctgaggctcctgtaatctctccccatgtcaaccactgcctctgtgctgacaattctccatctctaacctcgatttctaggtggcctacctggttgggtggtccagacttccacgcctgagagcccgagcccttggtcgtcacgtcctcctttggctttggctgctgctcttgtccattcaccatcaaatatggatgaaagagtccaaggcgacaccttgatggatctcctgagtgccgaatggagtcagtagcttcattgtgcagtagcttcatcctcctgagaatccccctgcgattccccagtgacagtgacagggactgggaacctgggagcttctcagcatctccttttcacactctgcctctgagcagctgggaatccttacccctccaatctcctgactgctcatctccctggagccaggaccctgaatcagtattcacggcctgttagtggcttgcaaggcagagcagacagatggacgtgctcgggaagcctattgatcagcccttggtgtgacctgcccagacctggttctgtttcaagcactgatcacgtggacaaggtatgtgcaaggcccagaaaacaccaaagggcaagtgtgaggcgctggatcaagtcccttgaggagagcagggccaggcgggctctggccagagccccaccccacgctgtcttggggtgtctcactggctcacaggaacctcctgggcaggaaatgtctgtgtttgaccctgcaggcctggccctggagcttggaccctggtagggcctgaaggaattaggttggattgaactgggttccaggacctcacatctccatttcccatagttggggggcagggaggagacccctggttctggagcgtcagatctgcaaggcctcggacctctggctcaacacccccttgagaggcttctggcctcctggctctgctggagaaggcatggcctgtggacctcctgcattcccgaggcaggctgcgtggctagcatttggaggctggcagagactggctgattcctaaccaaagatgctgttggtgtcttctgatggaatgtgactttctttgcctagtaggtgttattcacagggatcctttagttaagcaaatttgcctaggccccctgttgggtcgtatttttcttttttcttttttttcctttcttttttttttgtttcaggagtccttaattcctctcagcaccatttgagatgagcaactacacaagacaaagacgaaaggctttttcagctcaaaaatcctgtgattctttgattctaagaagagattttcttacaaggagtttgcctaagtgtccacacggcttgtgtctcctcccagcagccggcctgctggtgtgtgtgctgtgtgtggagagtggccttaggcctgtgttgtgagtgatgtctgcagagcatggggttgatttggaagaaggtgtgatccgaagttgtgtttgacctgagctcctgtcacccctgaaggcagcagaggatctcctgtcagtgacccaggaggacagctttctgaaggacattctgcccattgcacagaggggcttttgtgattggtttgcccagatgtgactttttcccctacctttgaaggcctagattgggtttcccatttcttggccctttggaaaggccaatggctccctgtctgacaggctgccctgagcagcaggtgctccatttagacccaggctgccccaatcccagctctgatctgactctcagctctgaggctccattgagtccctgggcctcagggaccctgttcaggctttgctgatggtggcatcaagtgacctccgagccacctccacgttggctcagactgaggaaactggtgatcttgtcttgctgtttgcaatacttgaagacaaaaacagaacttgtgctgcattctcaagaaagaagagacaactgttcctgtacctcactcttgtagatatctgtatgaagaagcagtgatgggtgcatgcaagctagggagcatcaaggctcccactgcgtgggcgccagctgacccctgacctcgttttcatctgttgctctggtcatggctctgagatctgggcaacctgagccagcttgtgcattccttacccttgtgcttttgcactatccatccctgtcccctagaactccctccagtacagtctgctccaccccatcccatcccatcccatcccatgccatcccatcccctcacctcactccatcctaccccatcctaccacatcccaccccatcccattccatcccagcccacaccaccccaccccacccc

SEQ ID NO: 1438 - DNA, 1955 bp, Homo sapiens
gaaaatgttgaactcttcgctgaccatcgacatggggaagaaccccactgagctcatgaaatctccttgtctgctactttggttggccatgtctgctctgatcttggacagcaccatttccctttctttgtgtgttttccaaatgggaggcggaggcaggcgcagggccatctccccagcctggtgcttttcctgtgtctttgtgagcggggagtcattgcggcaataccccggctccactggtcacagctcacagtctttgagtgtggtggaggccaggcaagacagcaggcatccaggccaggacccagccttaggttacactttgcagggaacgtccagaggaactttaaggggtgctggactccggcgggccttccctggggaatggccctaagagagccactagagccgctgactttcctggtctccataaagcaggggcccctcttcctgctgcagtggccctgctcacccatgtgaggatgcaccatggtgctagggtgtctcaagactgggcgacaggtgaatggaggaaagagaagagcgaatcttgtgatccactgggtgtgcggtgtgacagtgacagggactgggaacctgggagcttctcagcatctccttttcacactctgcctctgagcagctgggaatccttacccctccaatctcctgactgctcatctccctggagccaggaccctgaatcagtattcacggcctgttagtggcttgcaaggcagagcagacagatggacgtgctcgggaagcctattgatcagcccttggtgtgacctgcccagacctggttctgtttcaagcactgatcacgtggacaaggagtccttaattcctctcagcaccatttgagatgagcaactacacaagacaaagacgaaaggctttttcagctcaaaaatcctgtgattctttgattctaagaagagattttcttacaaggagtttgcctaagtgtccacacggcttgtgtctcctcccagcagccggcctgctggtgtgtgtgctgtgtgtggagagtggccttaggcctgtgttgtgagtgatgtctgcagagcatggggttgatttggaagaaggtgtgatccgaagttgtgtttgacctgagctcctgtcacccctgaaggcagcagaggatctcctgtcagtgacccaggaggacagctttctgaaggacattctgcccattgcacagaggggcttttgtgattggtttgcccagatgtgactttttcccctacctttgaaggcctagattgggtttcccatttcttggccctttggaaaggccaatggctccctgtctgacaggctgccctgagcagcaggtgctccatttagacccaggctgccccaatcccagctctgatctgactctcagctctgaggctccattgagtccctgggcctcagggaccctgttcaggctttgctgatggtggcatcaagtgacctccgagccacctccacgttggctcagactgaggaaactggtgatcttgtcttgctgtttgcaatacttgaagacaaaaacagaacttgtgctgcattctcaagaaagaagagacaactgttcctgtacctcactcttgtagatatctgtatgaagaagcagtgatgggtgcatgcaagctagggagcatcaaggctcccactgcgtgggcgccagctgacccctgacctcgttttcatctgttgctctggtcatggctctgagatctgggcaacctgagccagcttgtgcattccttacccttgtgcttttgcactatccatccctgtcccctagaactccctccagtacagtctgctccaccccatcccatcccatcccatcccatgccatcccatcccctcacctcactccatcctaccccatcctaccacatcccaccccatcccattccatcccagcccacaccaccccaccccacccc

SEQ ID NO: 1439 - DNA, 595 bp, Homo sapiens
cctggatattggtgttctgctgatccttcatacttttcactgcattgattacctgaactctgcaagagattttggactccaaatcaaagatcaaagcgtcttggattagtcatttgatcttggcttctgagggctcatttgtagagtgggacggccatattccttgacaactccatgctgaggcacagtaacaaagatgttctgctgcccattagaggcacccagcgaatggcaggggtggagacacaggtttcagaagtgcatgcacacctgagaggagtgagctgacagaccctgataacggaggcagcaattgtcaacgaagagatggcactaatcgttatttggttttgtcagcaacactgggatatttgctgaaccgctcaggagattttctttccccccagcttagaagaaacaaatttgagcactgtttggaagaagacgacagcagagagatggcaggaaaagtaagagcaggtggagagagaggatacaggcctgggaaactttcctagtcacttagaagtgtggtcttccagtcaacacaaggagttaaagaaagctacagccactgcagtgagtacttttcagt

SEQ ID NO: 1440 - DNA, 1806 bp, Homo sapiens
gttagtgagcccaggcaagaaactcatcagccgcatccttcagaacacactgggcgtcctgaacttaggcttctggggacagacacctaccctcgatattgttattccaacgagcccaagagtgcacttgcaaaaaaacaaaacaaaacaaaacaaaaacgggagcacgtgccagatacagtggttggaagtgatggggttaacccgggagagcttcgcggaggaggtgaggcttaaacggattaggaaagctgggcggcgggctggctgttccggcgggggagagtgtggcttggcccgtgccaaggtgtgcgggcggcgcgtgcgaagggactgtcctgcgccgctgctgcagagcggcacgggagagccacaggggctgcgcgcgccctccgcgccgtccccacccccggctgcgccagcctctcctccgcgccagcccccagcctccccagtccaaagcccatgaggggtgagggggtaagggagcgagggggtcgttctccctctaacctccctttaaggcgcgggacttgacggacctctgtttctcctcgggtcacagggaagcaaattgaggcggcgagagcaggaaaccaccggccaagttcaccttttcgggctacttatcagagccaaggtggaacccaagtccctgcttagctatgccagggctctgggtacgtcgggcccggcgccgtcggttttctaagcgtcgcacccatcctagggctctccccaattctgagaaccctggagctgggatgcgcagcggccaccgcgcactccgcggctcggatgcggcagcctggcccgtagtgaccctggcgggtgagctcgagaatggggagaaactgcggggtcctatgcggggaaagggattcttggcacggctcagccgatgacgacaacaggggacataacaacaatggcttcctccgggatttcccttcccgggcagcccgcgcggccagcagcaccgagtgccaggagggggcgcagacgccctcacgtgccctgcccgcccctgccgggagccaccaggcggggaaggcagaggcgcctcgcagcgcgtggccaaacgtgccgcctccagaaaccgagggcgccggcggtgggaataccaaccttcacttgaaaatttatgtaaggaaagcttggcggcgaaacaggatgcttccacctgttcctcaaagagctatcaaatggccctgtgaacatctttgcaaagggtcctcgcgaatgccaggcctcaagtgcgattctctgcactgaggtcaggatttaatctgggctggagatttcaggcaaattttaaaatgtaagcatgtggacaagagttaacacctgacaagtgcaagccaagctgaagagcatggacagaggaggcaacctggaggtccaacttctactccatgctccactcagatgtcacctccaggaagcctttcctgacttctcccagactgggttgtggaggtgtttccgggtggaagagaaggagggaccaagcggagagccctaagtcctgaagacaactgggaaggtaacacacctcttaagaagggcatgcagcagccatacctctcatccgccacggtcagcaaacccattgtgtttcctggagtgagttgggccatcaagatgggtggtgccctcctgctggggaagaggggctcggtgggaatccctgccccaaggcctggcagcaacgctcctacgctgccttgggccgcaggcctgctaagccctccgctctcgcttccctgcgcgcgaaataagtcccagggccaatgtggcctcccc

SEQ ID NO: 1441 - DNA, 232 bp, Homo sapiens
cggctcactgcaagctccgcctcccgggttcacgccattctccttcctcagcctcccaagtagctgggactacaggcgcccgccactacgcccggctaatttttttgtatttttagtagagacggggtttcactatgttgcccaggcacccagctggtctcgaactcctgacctcaagtgatctgctcgcctcagtctcccaaagtgctaggattacaggcgtgagccacag

SEQ ID NO: 1442 - DNA, 1020 bp, Homo sapiens
tacaaattgactgatgctttctcagacctgcctaaaccataggagccatgattggttatttgaacccttgtgttgagtggatatcccttgaagcaataatgtgcccagattttcatggagcatgaagaaggaattacttggagtattctacaaagcaactggcctgaacacttcaaaaataaaatatcacgaacagaaaaaggagggaaagggcaattttggatcagaaaagattgaatgaaacacaacagtgaaatgcgatgttacaaaccttgattggattctgggtcaaattttgaagaaagcagtggctcacgcctatggtcccagtgatttgagaggctgaggcaggaagactacttaaacaccggagttcaaggctgcagcgagctatgattgtaccactgcactccagcctgggcaacagagcgacacactgtctggattaaaaaaaaaaaaaaaagaaaaggaaagtaaagcaggtatttgggggacaactggaaagatttaaatatggagtataggccgggtgcggtggctcatgcctgtaatcccagcactttgggaggccaaggtgggtggatcactagaggccaggagttcaagaccagcctggtcaacatggtgaaaccccatctctagtaaaaatacaaaaattagctaggcatggcagcacgcacttgtaatcccagttactcaggaggctgaggcaggagaatcgcttgaacccaggaggcagaggttgcaagtgagccaagatcacaccactgcaccccagcctagagtgaggctttgcctcaaaacacacatacacacacaccaggcggcagcaaatatcttacacacacacgcacacgcacacacacccggcggcagcaaatatcccgctcagagagaagggcacactctgaagtgcaaatcctcaatcttcatttacaacagaagaaacaaggatatattagctggtggcaggagcttcccgggcctgtttggttctgagaagcaggagagccagggcac

SEQ ID NO: 1443 - DNA, 530 bp, Homo sapiens
gaaatacaaactctttttttgttgttaaatgccagatttcagctaacatcttgataagaattacaaagcctgtcaccaagagctcaagagattggatactccgggataaactgtaaggtcacttctaaatcagtgatcctgtgatttttcctccttgccaccggaaaggccaaagctgtagtcttaataataatatgcgcaatcttcaccccatcttttctctaagtatgtgggcatgggaaagaaaagctatggacgcctctagggatgcaggtaaaggtatcaacagcaggatgaactacaggagttcagacagcctttcaggtttgggtgatgagggaggactacaggtaagaatgacacggggcaaagatggaaaaggaaagatgatacagttggatggggaagaggagagccaaaaggtggtgtgagtgcgtttaacagtgtagtaggttacttccaacccatgtgaaaaagtttagctgtgatgctcacataactaaatcttatgaaactaatttcagtaaatg

SEQ ID NO: 1444 - DNA, 657 bp, Homo sapiens
gcaaatttaactttccaaaccttgattttctctcctgtaaaaaggaagccgtaatagtatcctatgagaattaaatgagaacacaggtgaagtgcttaccttatctcccaaacagttcaaggcaaatcccattgctttgtgttcctgaatcttcaccagcattctctattagctccttcctcaaaggctcttagtaagtttttgtcatctccaagcaagaagcaaaaatgtcttacccaatcttgaatctcttttttgcctcagcactatctcttttcccttcctttccaagcttctagaaaaaaataatctgagcaaaaaggtcagcagcccttgctattcttacttttcccatgttcttccatcttctactatcacaataaaactgctctgacatagtgaccaatgaccccttagctgccaaacttaacacttttcaggccctttgacttttctatagcctggtatgatcaatgactctttcttttctttctatttttgtttctttctttttctgagacagggttttaccctgtcacccagacggcagtgcaatggcacgatcatggctcacctcagcctcaacatcccaggctcaggcaatcctcccacctcagcctcctgagtagccaggaccacaggcgcccgccaccacac

SEQ ID NO: 1445 - DNA, 840 bp, Homo sapiens
aggctcaaaaatcaagtttaatatcaaaagaagttacacataaaggtttttacatttccgaaaatctgatagttaaaatatcccgtctggtgttgattgtgatacacttaagtgaacccctgaaaacctttattttgaaattgaagtttttgctcagaaactgggcagaacttttcacattctgacagaagataaaacttaagtctaaaaaatattcgataacttttttctcaaaaacattaagtactttagaatataaagcagaaactcttaccaagcatgtgtacccatcagccacacctcctgtctttgggggaatttggttacttggagctctgtgggtgctatatgaatcctagagacagcaaacttctgctgtacagctaacttacaagggcctgaacccggctgatggcagcaagcctgctacagtccagaagagtgcgacttcttatatttacatatgaacgcatctgtctttccaaggctaactttgtagcattccactggtaccaaggagccaaatggtgacattctgtctaagaatttgtggttactggcttcgaatgaagttgacgctgtcttgaatgcaccagttttttcttcaggattcaagcactttttaattccaggttcatctgtgtgactgtccttggaattgaaagggatgttgctctctttacaatctgtaaggcgcctgtggtgatcttcactaagcaacaatacaatggttccgccaacatgaagcactctgtgacaaaaaaaaaatgagatgagttcttgctatgttgtccgggctagtcttgaattcctggcctcaagtgatccttccaccccagc

SEQ ID NO: 1446 - DNA, 229 bp, Homo sapiens
cagagagttcgctgatcttcagaggctccccaatgtgcattagcaggaggaggtgacttcagggtcatgaaaaagatttgcagaaggaatggacatggcgaccagctgctgatactcaagggtctggttgctcaagatgttttctgagactgaagacacacagacttttcccctcgcttccctgaaactccccctcccttaactctctagccacataaaaattccccgc

SEQ ID NO: 1447 - DNA, 227 bp, Homo sapiens
gcaagctctcattgtatcaaggcaaactggcggtcatactcttctctaaatgagccaacactccctaggagacctcagtagaactccctcttctctgctggaaaggttttgcctccccaggacccatccctcaccatccatgcatgacattctggcctcaagtatccactcctcaaaggaaaagaaattggagagattcgccttgaaaataagccttcatattagtg

SEQ ID NO: 1448 - DNA, 208 bp, Homo sapiens
agtcagcattctgccctttcatgggtgtcagttgtctcgtccataaaatgggatgatgttcttgttccagccggcatactggatgactaaatgagggaacagttttatgctctactggtctagaggtcttagttccagagaaagaaatgcttccacgaggagacacaacaacgattccattgaaccggaggttaaaactaccactcag

SEQ ID NO: 1449 - DNA, 846 bp, Homo sapiens
ttcatttggggctgacctcctttcttgcaggccctagattcgtgaaatctatattaatcagcagaataatattagccaattccttacctcgtttttccttcccctcatttggacagctagcctggtttgtactccttatctcagagatgagatgtgataataagaggcagagaaataaaagtatgttcctggcttttggattcagaagttgcccttatgggaaggaaaaaacaaacaaatgtggcatagataaaatatttggaagaaaagataacaagagtagaaaagagtttcttagggggaggaagtgaattcatgggaaggtacagagggcagagatgtttctggatcctgtgtgctacttcaccctgggaaggtgacacaattgcagatgtttttgtgagacttgggagcagaaaagacatgttctttgcatcctcagtgaagccccagaggagaaatgggtgcataatgggtccccactgaagagaacgtaggcagatgtgcaaagtttcccatgccccagtgagaaagaagcatgtctcttcatgcccaagagcacatcagagaaatggagagtgctcctgaatccgaaagggtcacacagacaagagtgaagaatgtctcaataaataccagtgtggaagaatgatcttgaggaccacatccttcactctctctccttcccccctccctttctgcacatcttgcatctcagaagccccctcccggaaactagatacaactccaggggaagacggaacatgcacgctggtttgcagatcccttgcagtgactctacagctcccaggaatctgaggttcacaaggtgaaacctaccaggcc

SEQ ID NO: 1450 - DNA, 374 bp, Homo sapiens
ggtggacaacatctaggttttagggttaatatactgtttcatatactgtacaaagtttcatcattgcccccaaccttggaatttcagagtgagagcatatacaattcaaaacacttgctttgtcccttttctcagagctctgatattttcctaactcttacagtctctagaatgatctgtcagattttcactcaacaacactggatcagatctcttctatacatgacctcatccttctcatgtctcctctgtttgcagagagccggtcaaagtcttggaggtggaaacgaactgccaactgattaaccattttccttaagatgaagtgacaagtgagccagattttggatgatccaaggaagttatgggtggcg

SEQ ID NO: 1451 - DNA, 301 bp, Homo sapiens
aggttcttcatctataaaatgaaggggtggaaccggattcttcaaattctacaattgtgtaactttaaggaaagaacaaaggcaactcagaaatcaaagaaggagagaagaaaggaaaagaactttagtaaataatccagtaattaatcactagtgctgatagccactccaggttgaagtaacactctttggaaacaccatatcaaggggccagggatatggttggcacatatttcaaaagatggcatctaagaggtctcatccaactaggcaagctctgggttaggaggcagatcaaggt

SEQ ID NO: 1452 - DNA, 327 bp, Homo sapiens
ggattctgtatctttgatctgtgtataagctgtcaatctgctatgctggtctccagaaatctagtcagattcaaatctgctccatgtgtttcatcattctggaacctgggacctggaagtgctcttcttatgaagatcacaggaaagcagatgagtaaaccaaactgtgcaagcacatttaagccctgtgctgcatcatgtttgctaatactcaattcaatattattgaaaatgaataaggaaacaagatgacagaataagatttgaatgtttggaatcttgggatctgaccaaaatgctttaacaaaattagctattttactgaag

SEQ ID NO: 1453 - DNA, 515 bp, Homo sapiens
ctcctaaacaattacagaaagactcagatttcctacagaggaggaataatgagactgaaggcatacttctcttaaacatcaagaggacaaaggaatacggaataatatctttaaagtgttgaagaaaaatcagctgtcaacctaggcagtttaaagaacttgaaggaaaaagaaaaatgtcattttcagacagcccaagtttgccaggcaggatgaaaggaattcaacaagaaatattttaataagaagatgggacttagaaacaaagtatgaaacagaagaagaaaatatgagcaaagtgatttttgttcaatctaatttcagcagggagacagattcacttttgccacacacagtgctatcactaattggaggattactgctccatctggaaaccagaagagaactgtcatcccagggctcggtttccatttcaggtatgtgcttaaaaagagcattgtttttctagagatgttaaaagaagatgacctaagtggttagtgagtatgaactct

SEQ ID NO: 1454 - DNA, 1100 bp, Homo sapiens
tgcagagattggagtgatggccacagtggaagcaaggcagcttgcaggcacctaaaactcagaaaacagatccccaccaagtggatctgccagcacagcaggtaggcttcagacaaggaggaactgcagactgacctctgaccaccactccttgttataaatttcttcctcccaggcctggagaaactcacccccacaagccagagctaacattcttctttgcagaccccaaatttttaaatcaagcttttcttccttaaccttttgtatatcagaaaatcttttaatctacctgtgacctataagacccctcttcaagacatcccacacttttaggccagcaccactgtgtaacctccatgtattgattttaagtttttcctgtaacttctgctttcctgaaatctacccatgactttaccccttatctgcaagccactggggaggttgggacataagtgtaagctgcctgattctccttgcttggtgccctgcaaatatatgctttcctttttcctgctgcaaaggtcagcgtggatatctggtcttactgcaccaagtaagtggacccctgttcacttccataacacattctcaccaccagccaggggcaaggagagttaatcaagtgcagcccacttagttttcagaagagaagactgaagcccaacaggtttttaccccatcagctttctctgccacctagattgtgaatactatttactatcacttgttttctgggcttagaagcgtgacaacccaactttaaatctaattcctatgtcccacatcaactttctatcttcttctatttctcagaaacttctcttatatttgtgtgtaaaccagaaataaaattctaagacccctcaactgactgaacagatcccccttttggccaagggcattccaaagtaaacctgaaaaacaagtgcagttcatgatgggaagggggaatcggacatgtctcattatgccttcctccctttggaattcaggcacaactgaccagcattaagattaagacagatatcttaagactgacaaaacactttgtaacaataagatatcaagttccaacctgactatagtatagcatc

SEQ ID NO: 1455 - DNA, 634 bp, Homo sapiens
tctattccattccattccattccgttccattccattccattcctttccattccactcgcggttatccaattcctttccattcaattctattccattcctatccatatcgttccattcctttcaattctattccattccattccactcacgttgattccattccattcagttccatttcattccattccattccattccattccattccattcccttccattccattccattccattccactcaggttgattccattgcattccactccattccgttccattgcattgcattccaattgattcgattccattgctttccattccactggggttgattccattccattccattccaatccattccattccattccagtccattccattccagttgattccactcgggttgattcgattctgttgaattccattccattccattccattccattccattccattccattccattccattccactctggttgattccattccttttcattccattccattccattccattcgggttggttgattccattccattccattcaattccattccattgcactcgggttgattccattccattccattccattccattccattccactcgggaagattccat

SEQ ID NO: 1456 - DNA, 691 bp, Homo sapiens
tctattccattccattccattccgttccattccattccattcctttccattccactcgcggttatccaattcctttccattcaattctattccattcctatccatatcgttccattcctttcaattctattccattccattccactcacgttgattccattccattcagttccatttcattccattccattccattccattccattccattcccttccattccattccattccattccactcaggttgattccattgcattccactccattccgttccattgcattgcattccaattgattcgattccattgctttccattccactggggttgattccattccattccattccaatccattccattccattccagtccattccattccagttgattccactcgggttgattcgattctgttgaattccattccattccattccattccattccattccattccattccattccattccactctggttgattccattccttttcattccattccattccattccattcgggttggttgattccattccattccattcaattccattccattgcactcgggttgattccattccattccattccattccattccattccactcggttcccttccattgcattccattccattccattccactcgagttgattcctttcctttccattccattc

SEQ ID NO: 1457 - DNA, 206 bp, Homo sapiens
ggaatggaatggaatgcaatggaatggaatggaatggaatggattggaatggaatcaacccgagtggaatggaatggtatagaatggaatggcatggaatggaaacaacccgaatggaatggaatggaatggaatgaaaaggaatggaatcaaccagagtggaatggaatggaatggaatggaatggaatggaatggaatggaatg

SEQ ID NO: 1458 - DNA, 1958 bp, Homo sapiens
gattacattagattccattcgagcataattcctttcaagtccattcgatgattccattcaattccattccatgatgattccatttgattccattcaatgatgattccattcgagtccattctacgattcctttctattccattcgttgattccattcaattccattcgatgatgattgcattcgactacattcgatgattccactcgattccatccgacgattggagtccattcggtgattcctttacattgcactcaaagacgattccattcaattccattccatgataccattcgattccattcattgatgattccatttgattccatttgatgattccattttattccattcgatgatgattccattccattccatttgatgattccattccattccatcagatgttgattccattcgtgtccgcttgatgattccattcttttccgttcgaccatgattccattcgattccattcgatgattccattcgagtacattcgatgattccattcgagtacattcgatgattccactcgattccatacgatgattattccattggagtccatttggcgattcctttagtttccactcgaagatgattccgtttgattccattcgattataccattcgattccattcattgatgattccattcaagtgcatttgatgataccattcgattccattcgatgatgattccattcgtttccatttgattattccattctattccattcaatgatgataccattagtgtcaattcgatgattccattggagtccatttgatgatgattccattcagtgattccattcaattctatttgataatgattcccatcgattccattcgatgttgattccatgggattccattctatgatttctttcgattgcattagacaatgactccattcgattccatttgatgattccattcgattctatttgatgatgattccattcgattccatttgatgatgattgcattctattcaattcgatgatgattccattcgtgtccattagatgattccatacgattccattcgatgacgattccattctattccattgaatgatgattccattcgggtccattatatgattccactcgattccatttgatgatgattccattcttctccattcgatgatgattacattcaagtctattcgatgattctattagagtccattgaatgattgcttttgattccattcgatgctgattccattccattccattccattccattccattcgatgatgattccattcgataccattctatgattcctttagattccatttcatgctgattccattcaatttcattgaaagattctattcgaatccattcaatgatgattccattcgattccatttgatgattccatttgatttcatttgatgatgattccatttgattccatttggtgattccattcaatgatggttccattcgagtccattcaatgattcctttctactctatttgatgatgattccatgcgagggcattcaatggtgattcctttggataccattcgatgattccattcgattccattcaatgatgattgcattcgattccattcgatgattccattggattccattcaaagatgattccattcgattccatttgataattccatgcgattccatttgatcgttccaatggattccatttgatgatgattccatttgtgtccattcggtgattccattcaattgcatcagatgatcattccattcgagtgaattcgatgtttccaatcaattccattcaatgatgcttccattcgaggctgtctgatgactctattcatttccattctacaatgattccctttgagtccttttgaagatttgattcgagtccttttgatgatcccgttcgattccattcgatgatgattccgttcgagtccatttgacgcgtccct

SEQ ID NO: 1459 - DNA, 17068 bp, Homo sapiens
ggaatctgcaagtggatatttgtctagctttgaggatttcgttggaaacgggattacatataaaaagcagagagcagcattctcagaaacttccttgtgatgcttgcattcaagtcacagagttgaacattccctttcatagagcaggtttgaaacactctttttgtagtatctggaagtggacattgagagcgctctcaggactacggtgaaaaaggaaatatcttccaataaaagctagatagaaggaatgtcagaaactttttcatgatatatctactcagctaacagagttcaacctttcttttgagagagaagttttaaaacagtctttttgtggaatatgcaagtggatattaagccagcttggaggatttcgttggaaacgggaatgcatataaaaagcagacagcagcattctcagaaacttctttgtgatgtttgcattgaagtcccagatttgaacattccctttcttagagcaggtttgaaagacgccatttgtcatatctggaggttgtccatttggatcgcattccggcttgtgttgaaaaaggaaatatcctcccataaaaactagatagaagcattctgagaaacttatttgtgatgtgtgtactcaactaacagtgttgaacctttctgttgatagagcagctttgatacactctttttgtcgtatctggaaatggacatttagatctctttgaggtctatggtgaaaaaggaaatatcttcgcataaaaactagacggaagcagtctccacaacttgtttggaatgtgtgtactcaactaacagagttgaatcattcttttgatagagcagttttgaagcactctttttgtagaatctgcaagtggatatttggatagcttagaggacttcgttggaaaccggaatatgtccatataaaacctagacagaatcattctcagaaaaaactctgtgaggattgcattcaagtcccagagttaataattccctttcatagagccggtgtgaacacaagattttgtagtatattgaactggacatttggagtgctttgtgacgtattgtggaaaaggaaatagattcccatataaactaggcagaatcattctcagaaaccagtttgtgatgtgtgtactcaactaacagggttgaacctttcttttgagagagcactcttgaaacactctttttgtagactctgcaaggacatatttggatagctttgaggacttcgttggaaacgggtatatcttcatataaaatctagacagaagcattctcagaaacatctttgggatgtttgcattcaagtcacagagttgaacattccgtttcatggagaaggtttgagacactctttttgtggaatctgcaagtggacatttggatcgcattcaggccaatggtgagaaagggaatatcctcaaataaaaacttgacagaagcattctcataaactagtttgtgatgtgtgtgctcagctaacagagctgaacctttcttttcatagagcagttttgaaacactctttttgtagaatctgcaggtggatatttcgaaatctttgaggatttccttggaaacgggaatatcttcaaataaaacctagacagaagcattctcagaaacatcttaggggtgttagcattcaagtcacagagttgaaccttccttttcatagagcaggtttgaaacactcattttttggaatctggaggtggacttttggatcgctttgtggcctgtggtgaaaaagggtatatcttcgcataaaaactagacagaagtattctcataaagtactttgtgatgtgtttgctcaactaacggagctaaacctttcttttgatagagcagttttgaaacactctttttgtagaatttgcatgtggatatttggacagttttgaggatttcgttggaaacgggaaaatcttcatacgaaatcgagacacaagcattctcagaaacctctttgggatgttagcattcgagtcactgatttgaaatttccctttcatagagcaggtttgaagcactctgtttgtagtatctggaagtggacattttgatcactttgtggcctaaggtgaaaaaggaaatatcttgccacaaaaactacacagaagcattctcagaaactacgttgtgatgtgtttactcaactaacagagttgaatgtttcttttgatagagcagttttgaaacactctttttgtagaatctgcaggtggatatctggatagctttgaggatttccttggaaaagggagtatcttcatataaaatctagacagaaacatttgcagaatcatctttgtgatgtctgcattgaagtcagagagttgaacattccctttcatagagcagctttgaaacattctttttgtagtatctggaaatggacatttatatctctttgaggtctatggtgaaaaaggaaatatcttcgcataaatactagacggaagcagtctccaaaacttgtttggaatgtgtgtactcaactaacagagttgaatctttcttttgatagagcagttttgaaacactctttttgtagaatctgcaagtggatatttggatagcttagaggacttcattggaaacgggaatatgtccatataaaacctagacagaagcattctcagaaaaatctctgtgaggattgcattcaagtcccaaatttgaacattccctttcatagagcaggtgtgaacccaagattttgtagtatatggaactggacatgtggagtgctttgtgacatattgtgaaaaacgaaatagattcccatataaactaggcagaagcattctcagaaaccagtttctgatgtgtgtactcaactaacagggttgaacctttcttttgagagagcactcttgaaacactctctttgtagactctgcaaggggatatttggatagctttgaggacttcgttggaaacgggtatatcttcataaaaaatctagacagaagcattctcagaaacatctttgggatgtttgcattcaagtcacagagttgaacattccgtttcatggagcaggttggaaacactctttttgtggaatctggaagtgaacatttggatcacattcaggccaatggtgagaaagggaatatcctcgaatgaaaacttggcagaagcattctcataaactagtttgtgatgtgtgtgctcagctaacagagctgaacctttcttttcatagagcagttttaaaacactctttttgtagagtctgcatgtggatatttggaaagctttgaggatttccttggaaacgggaatatcttcatataaaacctagacagaagcattctcagaaacatctttggggtgttagcactcaagtcacagagttaaacgttccttttcatagagcaggtttgaaacactcattttttggaatctggaagtggaattttggatcgctttgaggcctgtggtgaaaaagggtatatcctcgcattaaaaactagacagaagtattctcataaactaatttgtgatgtgtttgctcaacttacagagttaaacctttcttttgatagagcagccttgaaacactctttttgtagaatttgcatgtggatatttgtacagctttgaggatttcgttggaaacgggaaaatcttcctatgaaatagagacacaggcattctcagagacatctttgggatgttagcattcgagtcacagagttgaacattccctatcatagagcaggtttgtagcactctttttgtagtatctggaagtggacattttgatcgctttggggcctaaggtgaaaaaggaaatatcttgccacaaaaactacacagaagcattctcagaaactacgttgtgatgtgtttactcaactaacagagttgaacctttcttttgatagagcagttttgaaacactctttttgtagaatctgcaggtggatatttggatagctttgaggatttccttggaaaagggaatatcttcatataaaatctagacagaagcattcgcagaatcacctttgtgatgtctgcattgaagtcagagtgttgaacattccctttcatagagcagctttgaaacactctttttgtagtatgtggaaatggacatttagatctctttgaggtctatggtgaaaaaggaaatatcttcgcataaaaactagacggaagcagtctccaaaacttgtttggaatgtgtgtactcaattaacagagttgaatctttcttttgatagagcagttttgaaacactctttttgtagaatctgcaagtggatatttggatagcttagaggacttcgttggaaacgggaatatgtgcatataaaacctagacagaagcattctcagaaaaatctctgtgaggattgcattcaagtcccagagttgaacattccctttcaaagagcaggtgtgaacacaagattttgtagtatatggaactggacatgtggagtcctttgtgacgtattgtgaaaaaggaaatatcttcacatataaactaggcagaagcattctcagaaaccagattgtgatgtgtgtactcaactaacagggttgaacctgtcttttgagagagcactcttgaaacactctttttgtagaatctgcaagtggatatttggatagcttagaggacttcattggaaacgggaatatgtccatataaaacctagacagaagcattctcagaaaaatctctgtgaggattgcattcaagtcccaaatttgaacattccctttcatagagcaggtgtgaacccaagattttgtagtatatggaactggacatgtggagtgctttgtgacgtattgtgaaaaacgaaatagattcccatataaactaggcagaagcattctcagaaaccagtttctgatgtgtgtactcaactaacagggttgaacctttcttttgagagagcattcttgaaacactctctttgtagactctgcaaggggatatttggatagctttgaggacttcgttggaaacgggtatatcttcataaaaaatctagacagaagcattctcagaaacatctttgggatgtttgcattcaagtcacagagttgaacattccgtttcatggagcaggttggaaacactctttttgtggaatctggaagtgaacatttggatcacattcaggccaatggtgagaaagggaatatcctcgaatgaaaacttggcagaagcattctcataaactagtttgtgatgtgtgtgctcagctaacagagctgaacctttcttttcatagagcagttttaaaacactctttttgtagaatctgcatgtggatatttggaaagctttgaggatttccttggaaacgggaatatcttcatataaaacctagacagaagcattctcagaaacatctttggggtgttagcactcaagtcacagagttaaacgttccttttcatagagcaggtttgaaacactcattttttggaatctggaagtggaattttggatcgctttgaggcctgtggtgaaaaagggtatatcctcgcattaaaaactagacagaagtattctcataaactaatttgtgatgtgtttgctcaacttacagagttaaacctttcttttgatagagcagccttgaaacactctttttgtagaatttgcatgtggatatttgtacagctttgaggatttcgttggaaacgggaaaatcttcctatgaaatagagacacaggcattctcagagacatctttgggatgttagcattcgagtcacagagttgaacattccctatcatagagcaggtttgtagcactctttttgtagtatctggaagtggacattttgatcgctttggggcctaaggtgaaaaaggaaatatcttgccacaaaaactacacagaagcattctcagaaactacgttgtgatgtgtttactcaactaacagagttgaacctttcttttgatagagcagttttgaaacactctttttgtagaatctgcaggtggatatttggatagctttgaggatttccttggaaaagggaatatcttcatataaaatctagacagaagcattcgcagaatcacctttgtgatgtctgcattgaagtcagagtgttgaacattccctttcatagagcagctttgaaacactctttttgtagtatgtggaaatggacatttagatctctttgaggtctatggtgaaaaaggaaatatcttcgcataaaaactagacggaagcagtctccaaaacttgtttggaatgtgtgtactcaattaacagagttgaatctttcttttgatagagcagttttgaaacactctttttgtagaatctgcaagtggatatttggatagcttagaggacttcgttggaaacgggaatatgtgcatataaaacctagacagaagcattctcagaaaaatctctgtgaggattgcattcaagtcccagagttgaacattccctttcatagagcaggtgtgaacacaagattttgtagtatatggaactggacatgtggagtcctttgtgacgtattgtgaaaaaggaaatatcttcacatataaactaggcagaagcattctcagaaaccagattgtgatgtgtgtactcaactaacagggttgaacctgtcttttgagagagcactcttgaaacactctttttgtagactctgcaaggggatatttggatagctttgaggacttcgttggaaacggttatatcttcatataaaatctaggcagaagcattctcagaaacatctttgggatgtttgcattcaagtcacagagttgaacattccccttcatggagcaggtttgaaacaatctttttgtggaatctggaagtggacatttgtttcgcattgaggccaatggtgaaaaagggaatatcttcgaataaaaactagaaagaagcattctcataaactagtttgtgatgtgtgtgcttagctaacagagctgaacctttctttccatagtgcagttttgaaacactctttttgtagaatctgcaggtggagatttggaaagctttgcggatttccttggaaacgggaatatcttcatataaaacctagacagaagcattctcagaaacatctttgcggtgttagcattcaagtcacagagttaaacgttccttttcacagagcaggtttgaaacactcattttttggaatctggaagtggacttttggatcgctttgaggcctgtggtgaaaaagggtatatcttcgcataaaaactagacagaagtatactcataaactagcttgtgatttttttgctcaaccaacagagttaaacctttcttttgatagagcagctttgaaacactctttttgtagaatttgcatgtggacatttggacagctttgaggatttcgttggaaacgggaaaatcttcctatgaaatagagacacaagcattctcagaaacctctttgggatgttagcatttgagtcagagagttcaacattccttatcaaagagcaggtttgaagcactctttttgtagtatctggaagtggacattgtgatcgctttgaggcgtaaggtgaaaaaggaaatatcttgccacaaaaactacacagaagcattctcagaaactacgttgtgatgtgtttactcaactaacagagttgaacctttcttttgatagagcagttttgaaacactctttttgtagaatctgcaggtggatatttggatagctttgaggatttccttggaaaagggaatgtcttcatataaaatctagacagaagcatttgcagaatcacctttgtgatgtttgcatggaagtcagagagttgaacattccctttcatagagcagctttgaaacactctttttgttgtatctggaaatggacatttagatctctttgaggtctatggtgaaaaaggaaatatcttcacctaaaaactagatggaagcagtcttcaaaactagtttggaatgtgtgcactcaattaacagagttgaatctttcttctcatagagcagttttgaaacactctttttgtagaatctgcaaatggatatttggatagcttagaggatttcgttggaaacaggaatatgtccatataaaacctcaacagaggcattctcagaaagaaatctgtgaggattgcattcaagtcccagagttgaacattccctttcatagagcaggtgtgaacacaagattttgtagtatatggaactggacatttggagtgctttgtgacctattgtgaaaaaggaaatatcttcccatataaactaggcagaatcattctcagaaaccagtttgtgatgtgtgtactcaactaacagggttgaacctttcttttgagagagcactcttgaaagagtctttttgtagagtctgcaagaggatatttggatagctttgaggacttcgttggaaaggggcatatcttcatataaaatctagacagaagcattctcagaaacatccttgggatgtttgcattcaagtcacagagttgaacattccctttcatggagcaggtttgaaacactctttttgtggaatctggaagtggatatttggatcgcattgaggcctaaggtgaaaaagggaatatcttctaattaaaactagacagaagcgttctcataaactagtttgtgatgtgtgtgcctaactaacagagctgaaactttcttttcatagagctgttttgaaacactctttttgtagaatctgcatgtggatatttggaaagctttgaggattttgttggaaacgggaatatcttcatataaaacctagacagaagcattctcagaaacatctttggcgtgttagcattcaagtcacagagttgaacattccgtttcatggagcaggtttgaaacactcattttgtggaatctggaagtggacttttggatcactttgaggcctgtggtgaaaaagtgtatatcttcgcataaaaactagacagaagtattctcataaagtactttgtgatgtgtttgctcagctaacggagttaaacctttcttttgatagagcagttttgaaacactctttttgtagtatttgcatatggatatttggacagttttgaggaattcgttggaaacgggaaaatcttcctatgaaatagagacacaagcattctcagaaaccactttgggatgttagcatttgagtcagagagttcaacattccttatcaaagagcaggtttgaagcactctttttgtagtatctggaagtggacattgtgatcgctttgaggcgtaaggtgaaaaaggaaatatcttgccacaaaaactacacagaagcattctcagaaacgttgtgatgtgtttactcaactaacagagttgaacctttcttttgatagagcagttttgaaacactctttttgtagaatctgcaggtggatatttggatagctttgaggatttccttggaaaagggaatatcttcatataaaatctagacagaagcatttgcagaatcacctttgtgatgtttgcatggaagtcagagagttgaacattccctttcatagagcagctttgaaacattctttttgtagtatctggaaatggacatttagatctcttttaggtctatggtgaaaaaggaaatatcttcacctaaaaactagacagaagcagtcttcaaaactagtttggaatgtgtgcactcaactaacagagttgaatctttcttgtcatagagcagttttgaaacactctttttgtagaatctgcaaatggatatttggatagcttagaggatttcgttggaaacaggaatatgtccatataaaacctcgacagaggcattctcagaaaaaactctgtgaggattgcattcaagtcccagagttgaacattccctttcatagagcaggtgtgaacacaagattttgtagtatatggaactggacatttggagtgctttgtgacctattgtgaaaaaggaaatatcttcccatataaactaggcagaatcattctcagaaaccagtttgtgatgcgtgtactcaactaacagggttgaacctttcttttgagagagcactcttgaaagagtcttttggtagagtctgcaaggggatatttggatagctttgaggacttcgttggaaaggggcatatcttcatataaaatctagacagaagcattctgagaaacatccttgggatgtttgcattcaagtcacagagttgaacattccctttcatggagcaggtttgaaacactctttttgtggaatctggaagtggatatttggatcgcattgaggcctaaggtgaaaaagggaatatcttctaatgaaaactagacagaagcattctcataaactagtttgtgatgtgtgtgcctaactaacagagctgaacctttcttttcttagagctgttttgaaacactctttttgtagaatctgcatgtggatatttggaaagctttgaggattttgttggaaacgggaatatcttcatacaaaatatagacagaagcattctcagaaacatctttggcgtgttagcattcaagtcacagagttgaacattccgtttcatggagcaggtttgaaacactcattttgtggaatctggaagtggacttttggatcactttgaggcctgtggtgaaaaagggtatatcttcgcataaaaactagacagaagtattctcataaagtactttgtgatgtgtttgctcagctaacggagttaaacctttcttttgatagagcagttttgaaacactcttttgtagaatttgcatgtggatatttggacagttttgaggatttcgttggaaacgggaaaatcttcatatgaaatagagacacaagcattctcagaaacctctttggggtgttagcattcgagtcactgagttgaaaattccctttcatagagcaggtttgaagtactctgtttgtagtatctggaagtggacattttgatcgctttgtggcctaaggtgaaaaaggaaatatcttgcacaaaaactacacagaagcattctcagaaactacgttgtgatgtgtttactcaactaacagagttgaatttttcttttgatagagcagttttgaaacactctttttgtagaatctgcaggtggatatttggatagctttgaggatttccttggaaaaaggaatatcttcatataaaatctagacagaagcattcgtagaatcacctttttgatgtttgcatggaagtcagagagttgaacattccctttcatagagcagctttgaaacattctttttgtagtatctggaaatggacatttatatgtctttgaggtctatagtgaaaaaggaaatatcttcgcataaaaactagacggaagcagtctccaaaacttgtttggaatgtgtgtactcaactaacagagttgaatctttcttttgatagagcagttttgaaacactctttttgtagaatctgcaagtggatatttggatagcttagaggatttcgttggaaacgggaatatgtccatataaaacctagacagaagcattctcaggaaaaactctgtgaggattgcattcaagtcccagagttgaacattccctttcatagagcaggtgtgaacacaagattttgtagtatatggaacaggacatttggagtgctttgtgacgtattgtgaaaaaggaagtatcttcacatataaactaggcagaagcattctcagaaaccagattgtgatgtgtgtactcaactaacagggttgaacctttcttttgagagagcactcttgaaacactctttttgtagactctgcaaggggatatttggatagctttgaggactttgtaggaaacggatatatcttcatataaaatctagacagaagcattctcagaaacatctttgggatgtttgcattcaagtcacagagttgaacattccccttcatggagcaggtttgaaacaatctttttgtggaatctggaagtggacatttggatcgcattgaggccaatggtgaaaaagggaatatcttggaataaaaactagacagaagcattctcataaactagtttgtgatgggtgtgctcagctaatagggctgaacctttcttttcatagagcagttttgaaacactctttttgtagaatctgcatttggatatttggaaaggtttgaggatttcgttggatacgggaatttcttcatataaaatctaggcagaagcattctcagaaacatctttggcgtgttagcattcaagtcacagagttgaacattccgtttcatggagcaggtttgaaaaactctttttgtggaatctggaagtggacattaggatcgcttttaggtctgtggtgaaaaagggtatatcttcgcataaaaagtagacagaagtattctcataaactagtttgtgatgtgtttgctcaactaacagagttcaacctttcttttgatagagcagttttgaaacactctttttttagaatttgcatgtggatatttggacagctttgaggatttcgttggaaacgggaaaatcttgatatgaaatagagacacaagcattctcagaaacctctttgggatgttagcattcgagtcacagagttgaacattccctttcatagagcagatttgaagcactctttttgtagtatctggaagtggacattttgatcgctttgaggcgtactgtgaaaaacgaaatatctcgccacaaaaactacacagaagcattctcagaaactacgttgtgatgtgtttactcaactgagttgaacctttcttttgatagagcagttttgaaacactctttttgtagaatctgcaggtggatatttggatagctttgaggatttccttggaaaagggaatatcttcatagaaaatctagacagaagcattcgcagaataacctttttgatgtttgcatggaagtcagagagttgaacattccctttcatagagcagctttgaaacactctttttgtagtatctggaaatggacttttagatctccttgaggtctatggtgaaaaaggaaatatcttcgcctacaaactggacggaagcagtcttcaaaactagtttggaatgtgtgtactcaactaacagagttgaatctttcttctcatagagcagttttgaaacactctttttgtagaatctgcaagtggatatttggatagcttagaggatttcgttggaaacgggaatatgtccatataaaacctagacagaaagattctcagaaaaaactctgtgaggattgcattcaagtcccagagttgaacattccctttcatagagcaggtgtgaacacaagattttgtagtatatggaactggacatttggagtgctttgtgacctattgtgaaaaagcaaatatcttcccatataaactaggcagaagcattctcagaatcagtttgtgatgtgtgtactcaactaacagggttgaacctttcttttgagagagcactcctgaaaccgtctttttgtagactctgcaaggggatatttggatagctttgaggacttcgttggaaaggggaatatcttcatataaaatctagacagaagcattctcagaaacatctttgtgtgttagcactcaagtcacagagttaaacgttccttttcatagagcaggtttgaaacactcattttttggaatctggaagtggaattttggatcgctttgaggcctgtggtgaaaaagggtatatcttcacataaaaactagacagaagtattctcttaaactaatttgtgatgtgtttgctcaactaacagagttaaacctttcttttgatagagcagctttgaaacactctttttgtagaatttgcatgtggatatttggacagctttgaggacttcgttggaaacgggtatatcttcatataaaatctagacagaagcattctcagaaacatctttgggatgtttgcattcaagtcacagagttgaacattccgtttcatggagcaggtttgaaacactctttttgtggaatctggaagtgaacatttggatcgcattcaggccaatggtgagaaagggaatatcctcgaataaaaacttggcagaagcattctcataaactagtttgtgatgtgtgtgctcagctaacagagctgaacctttcttttcatagagcagttttgaaacactctttttgtagaatctgcatgtggatatttggaaagctttgacgagttccttggaaacgggaatatcttcatataaaacctagacagaagcattctcagaaacatcttttgggtgttagcattcaagtcacagagttaaacgttccttttcacagagcaggtttgaaacactcattttttggaatctggaagtggacttttggattgctttgaggcctgtggtgaaaaagggtatatctttgcataaaaactagacagaagtattctcataaactagtttgtgatgtgtttgctcaaccaacagagttaaacctttcttttgatagagcagttttgaaacactctttttgtagaatttgcatgtggatatttggacagctttgaggatttcgttggaaacgggaaaatcttcatatgaaatagagacacaagcattctcagaaacctctttgggatgttagcattctagtcaccgagttgaacattccagttcatagagcaggtttgaagcactctttttgtagtgtctggaagtggagattttgatcgctttggggcctaaggtgaaaaaggaaatatcttgccacaaaaactacacagaagcattctcagaaactacgttgtgatgtgtttactcaactaacagagttgaacctttcttttgatagagcagttttgaaacactcttttgtagaatctgcaggtggatatctggatagctttgaggatttccttggaaacgggagtatcttcctgtaaaatctagatagaagcattcggagaatcatctttgtgatgtctgcaatgaagtcagagagttgaacattccctttaatagagcagctttgaaacattctttttgtagtatctggaaatggacatttagatctctttgaggtctatggtgaataaggaaatatcttcgcataaaaactagacggaagcagtctccaaaacttgtttggaatgtgtgtactcaactaacagagttgaatctttcttttgatagagcagtttcgaaacactctttttgtagaatctgcaagtggatatttggatagctcagaggatttcgttggaaacgggaatatgtccatataaaacctagacagaagcattctcaggaaaatctctgtgaggattgcattcaagtcccagagttgaacattccctttcatagagcaggtgtgaacacaagattttgtagtatatggaactgaacatttggagtgctttgtgacgtattgtgaaaaaagaaatatcttcccatataaactaggcagaagcattctcagaaaccagtttgtgatgtgtgtactcaactaacagggttgaacctttcttttgagagagcactctagaaacactctttttgtagactctgcaagggcatatttggatagctttgaggacttcgttggaaacgggtatatcttcacataaaatctagacagaagcattctcagaaacatctttgggatgtttgcattcaagtcacagagttgaacattccatttcatggagaaggtttgaaaaactctttttgtggaatctggaagtggacatttggatcgcattcaggccaatggtgagaaagggaatatcctcgaataaatacttgagagaagcattctcataaactagtttgtgatgtgtgtgctcagctaacagtgctgaacctttcttttcatagagtagttttgaaacactctttttgtcgaatctgcatgtggatatttggaaagctttgaggatttcattggaaatgggaatatcttcatataaaatctatgcagaagcattctcagaaatatctttggcgtgttagcattcaagtcacagagttgaacattccgtttcatggagcaggtttgaaacactctttttgtggaatctggaagtggacatttggatcgttttgaggcctgtggtgaaaaagggaatatctttgcataaaaactagacacaagtattctcataaactagtttgtgatgtgtttgctcaactaacagagttgaacctttcttttgatacagcagtattgaaacactctttttgtagaatttgcatgtggatatttggacagctttgaggatttcgttggaaacgggaaaatcttcatatgaaatagagacacaagcattctcagaaacctctttgggatgttagcattcgagtcacagagttgaacattccctttcatagagcagatttgaagcactctttttgtagtatctggaagtggacattttgatcgctttgaggcgtaaggtgaaaaaggaaatatcttgccacaaaaactacacagaagcattctcagaaactacgttgtgatgtgtttactcagctaacagagttgaacctttcttttgatagaacagttttgaaacactctttttgtagaatctgcaggtggatatttggatacctttgaggatttcctaggaaaagggaatatcttcatataaaatctagacagaagcattcgcagaatcacctttttgatgtttgcatggaagtcagagagttgaacattccctttcatagagcagctttgaaacactctttttgtagtatctggaaatggacatttagatctctttgaggtctatggtgaaaaaggaaatatcttcgcctaaaaactagacggaaacagtcttcaaaacttgtttggaatgtgtgtactcaactaacacagttgaatctttcttctcatagagtagttttgaaacactctttttgtagaatctgcaagtggatatttggatagcttagaggatttcgttggaaacgggaatatgtccatagaaaacctagacagaagcattctcagaaaaatctctgtgaggattgcattcaagtcccagagttgaacattccctttcatagagcaggtgtg

SEQ ID NO: 1460 - DNA, 3097 bp, Homo sapiens
aaagctagattatttttgttagtctgggaactaaaaaaaatggttgtaactttgaagcctttttatggatcaacatgaagattgagggatctcaaatagaaagggcatcctggtggcaaaggataatgattaccagactgcaagagtactttcaatggcaagaaagcaacaacagaatcaatgaaaacaaagcaatgattagaatgccctttccccttctcctcctgacctgtagacgctgattgtcttccttggacttagggaaccctttaagttcttgaaaaattcaatgatcaggctatagtagatagtccccagtacacagcacaagatgttttgataaactggacattttgagacccaaataactaattagaaaaatcaaacatgtgaaactactttatcctatgcataggggttatactggaaataaaatgtacaacattggaatccctaaggagaaaagtcctaaaagtttcaatatcaagaatcccgcacctgctgctacttatctagccttttgcttgatttctggctgacgaagttgcacaactcttgaaaactaaaaaccttgaaaatttgtcacttgaaaactacttgaaccaaactatgaaatctgacctgctatataagatggaattgttacaattattttaaacttcaatttagtgttctgctctatcaaaagaaagtttcaactctgttagttgagtgcacacatcctaaacaagtttctgagaatgcttctgtcttctttttatgggaagatatttcctttttcaccatagacctcaatgcgctccaaatgtgcacttccagatactacaaaaagagtgtttcaaacgagctctatgaaagggaatgttcaaatttgggacttgaatgcaatcctcacagagatttttctgagaatgcttctgtctaggttttatatggacatattcccgtttccaacgaaatcctctaagctatccaaatatccacttgcagattctacaaaaagagtgcttcaaaactgctctatcaaaagaaagattcaactctgttagttgagtacgcacattccaaacaagttttgaaaactgcttccgtctagattttaggcgaagatattccctttttcaccatagacctcaaagagatctaaatgtccatttccagatactacaaaaagagtgtttcaaagctgctctatgaaagggattgtacaactctctgacttccatgcaaacatcacaaaggtgattctgcgaatgcttctgtctagattttctatgaagatattcccttttccaaggaaatcctcaaagctatccaaatatccacctgcagattctacaaaaagagtgtttcaaaactgctctatcaaaagaaaggttcaactctgttagttgagtaaacacatcacaacgtagtttccgagaatgcttctgtgtagtttttgtggcaagatatttcgtttttcaccttacacctcaaagcgatcaaaatgtccacttccagatactacaaaaaagtgcttcaaacctgctctgtgaaagagactgttcaactctgtgactcgaatgctaacatcccaaagaggtttctgagaatgcttgtgtctcgatttcatatgaagattttcccatttccaacgaaatcctcaaagctgcccaaatatccacatgcaaattctacaaaaagagtgtttcaaaaccgctctatcaaaagaaaggttcaactctgttatttgagcaaacacatcacaaactagtttatgagaatgcctctgtctagtatttatgtgaagatataccctttttcaccacaggcctcgaagcgatccaaatgtccacttccagattccacaaaaagagtgtttcaaacctgctctatgaaaaggaacgttcaactcagtgacttgaatgctaccaccccaaagatgtttctcagaatgcttctgtctaggttttatatgaagatattcccgtttccaacgaaatcctcaaagctatccatatatctccttgcagactttgcaaaaagagtgtttcaaacctgctctatgaaagggaatgttcaactctgtgactcgaatgctaacatccgaaagaggtttctgagaatgcttgtgtctcgatttcatatgaagattttcccgtttccaacgaaatcctcaaagcggtccaaatatccacatgcaaattgtacaaaaagagtgtttcaaaactgctgtatcaaaagaaaggttcaactctgttagttgagcaaacacatcacaaactagtttatgagaatacttgtgtctagtttttatgcaaagatattccctttttcaccacaggcctcaaagcgatccaaatgtccacttccagattccacaaaaagagtgtttcaaaccttctccatgaaacggaatgttcaactctgtgacttgaatgataacacgccaaagatatttctgagaatgcttctgcatagattttatatgaagatattcccatttccaacgaaatcctcaaagctttccaaatatccacatgcagattctacaaaaagagtgtttcaaaacagctctatgaaaagaaaggttcagctctgttagttaagcacacacatcacaaactagtttatgagaacgcttctgtctagtttttattcgaagatattccctttttcaccttaggcctcaatgcgatccaaatgtccacttccagattccacaaaaagagtgtttcaaaactgctccatgaaagggaatgttcaactctgtgacttgaatgcaaacatcccaaggatgtttctgagaatgcttctgtctagattttatatgaagatatgcccctttccaacgaagtcctcaaagctatccaaatatccccttgcagactctaccaaaagactctttcaagagtgctctctcaaaagaaaggttcaaccctgttagttgagtacacgcatcacaaactggtttctgagaatgattctgcctagtttatatgggaagatatttcctttttcacaataggtcacaaagcactccaaatgtccagttccatatactacaaaatcttgtgttcacacctgctctatgaaagggaatgttcaactctgg

SEQ ID NO: 1461 - DNA, 1780 bp, Homo sapiens
ggcggagaggcggacagcggcggagaggcggatagcggcggcgcagcggagagtcggtcagcggcggcgcggcggagaggccgacagcggcggcgcggtggagaggcggacagcggcggcgcggcggagaggcggacagcggcggcgcggcggagaggcggacagcggcggagaggcggatagcggcggcgcagcggagagtcggtcagcggcggcgcggcggagaggccgacagcggcggcgcggtggagaggcggacagcggcggagaggcgcacagcggcggagaggcgcacagcggcggcgcaggcgcggagaggcgcacagcgcaggcgctggcgcggagaggcgcaggcccaggtccactccccagctgtgaaaggaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttgggcctgattttcggatagctgccacaggagttgtccttgatctggataaatccataaaaattgtgaagaaattaaagctaactggttttccatataaaattttcaagaacacttcatttattaagatattgtcttcatgcgaacttggtatcctgtttccatcccagccttctataacccagtaacatctttgttgaaaccagtgggtgagaaagacacctggtcaggaatgtggaccacgggccacctcgggctcgcccatggtgtcagactaaagacaaacaaggactctctgtataaggcctcaaaacgatccaaatgtccacttccagattccacaaaaagagtgtttcaaacctgctccatgaaacggaatgttcaactctgtgacttgaatgctaacacgccaaagatatttctgagaatgcttctgcatagattttatatgaagatattcccatttccaatgaaatcctcaaagctttccaaatatccacatgcagattcgacaaaaagagtgtttcaaaactactctatgaaaagaaaggttcagcactgttagctgagcacacacatcacaaactagtttatgagaatgcttctctcaagtatttattcgaggatattccctttctcaccattggcctgaatgcgatccaaatgtccacttccagattccacaaaaagagtttttcaaaccttctccatgaaatggaatgttcaactctgtgacttgaatgcaaacatcccaaagatgtttctgagaatgcttctgtctagattt

SEQ ID NO: 1462 - DNA, 1552 bp, Homo sapiens
agaggttgcagtgagctgagatcgtgccactgcactccagcttgagtgacagagtgagactccgtctccaaaaaaaaaaaaaaaaacaaaaacgaaagagtgtccattatctatactggaaaaattgagattgggatttttgacatgaagtgcggaaatgtggattgggtcaatttagtttacctaaacagatgatgaaatactgttttacgaagcattccctagtgcaaagttttgcctgtgtgtctagtgacgggaacagtaagaatgaggcttggaacgcggagcgcattgtgggcctgtcgtgggtggcgccagcagcacatgcatgcctggctcacagagcagcctttgggtgttcttttcccagaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacaggagaatgggagcagaggaactggaggctgcaactgtggaaaacttttgtggggttttgctgcagagagaagcagagaaatgaagcagtttttggtggaagaagtggaatcaaaaggttttgagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttgggaccctatcactccacagggaactggtttcttggcaatacagtctgtcagtggcataatgcctgattttcggatagctgccacaggagttgtccttgatctggataaatccataaaaattgtgaagaaattaaagctaactggttttccatataaaattttcaagaacacttcatttattaagatattgtcttcatgcgaacttggtatcctgtttccatcccagccttctataacccagtaacatctttgttgaaaccagtgggtgagaaagacacctggtcaggaatgtggaccacgggccacctcgggctcgcccatggtgtcagactaaagacaaacaaggactctctgtataaggtactggtcgtgtgtgtgttagtggagatgaagcctgtgccctacagacagggagtcacgcagacacttttctataatttcttac

SEQ ID NO: 1463 - DNA, 1560 bp, Homo sapiens
agaggcggacagcggcggcgcggcggagaggcggacagcggcggagaggcggatagcggcggcgcagcggagagtcggtcagcggcggcgcggcggagaggccgacagcggcggcgcggtggagaggcggacagcggcggagaggcgcacagcggcggagaggcgcacagcggcggcgcaggcgcggagaggcgcacagcgcaggcgctggcgcggagaggcgcaggcccaggtccactccccagctgtgaaaggaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttggggtaaaatatgattacaataacttgcctattgccgagattaaactttacaggctgcgttattttagctttgtgcttttcctttcataaaattccactcctaagatgtttctgttttctgggagcggggaggtggtttggagtatatatgtaaatctatatccaaatctaaatgtccgtatccagtatgttaaactagaatctaaaatttctggtttgctatatttctttttttccttttcctttaagaccctatcactccacagggaactggtttcttggcaatacagtctgtcagtggcataatgcctgattttcggatagctgccacaggagttgtccttgatctggataaatccataaaaattgtgaagaaattaaagctaactggttttccatataaaattttcaagaacacttcatttattaagatattgtcttcatgcgaacttggtatcctgtttccatcccagccttctataacccagtaacatctttgttgaaaccagtgggtgagaaagacacctggtcaggaatgtggaccacgggccacctcgggctcgcccatggtgtcagactaaagacaaacaaggactctctgtataaggtactggtcgtgtgtgtgttagtggagatgaagcctgtgccctacagacagggagtcacgcagacacttttctataatttcttac

SEQ ID NO: 1464 - DNA, 1762 bp, Homo sapiens
tctatactggaaaaattgagattgggatttttgacatgaagtgcggaaatgtggattgggtcaatttagtttacctaaacagatgatgaaatactgttttacgaagcattccctagtgcaaagttttgcctgtgtgtctagtgacgggaacagtaagaatgaggcttggaacgcggagcgcattgtgggcctgtcgtgggtggcgccagcagcacatgcatgcctggctcacagagcagcctttgggtgttcttttcccagaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttggggtaaaatatgattacaataacttgcctattgccgagattaaactttacaggctgcgttattttagctttgtgcttttcctttcataaaattccactcctaagatgtttctgttttctgggagcggggaggtggtttggagtatatatgtaaatctatatccaaatctaaatgtccgtatccagtatgttaaactagaatctaaaatttctggtttgctatatttctttttttccttttcctttaagaccctatcactccacagggaactggtttcttggcaatacagtctgtcagtggcataatggtaactatcttggacaatttcttttacagattggtttgagaaatatatcctgaatgtgggttattatgtacatgagactttaagttgaaaattactcatttttattattataaagtaaatttccctttgcttttaatctttgtacatccttttcagtagggtgtgggattagaggaggggaggtggaagaattataatggtacatttcctatttttgtgcatcttttgcatttatttatctaagcaagtatttaagcagtgctcaccgtgtgctaagcactatatgaggttatgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaattttctaaacattgcaactgtatttttcttttccatttcgttccaaataaatcattatagtaaaattacattcctctgaaatcactctcaggaaagtactcaagtagcc

SEQ ID NO: 1465 - DNA, 1633 bp, Homo sapiens
gagaggcggacagcggcggagaggcggatagcggcggcgcagcggagagtcggtcagcggcggcgcggcggagaggccgacagcggcggcgcggtggagaggcggacagcggcggcgcggcggagaggcggacagcggcggcgcggcggagaggcggacagcggcggagaggcggatagcggcggcgcagcggagagtcggtcagcggcggcgcggcggagaggccgacagcggcggcgcggtggagaggcggacagcggcggagaggcgcacagcggcggagaggcgcacagcggcggcgcaggcgcggagaggcgcacagcgcaggcgctggcgcggagaggcgcaggcccaggtccactccccagctgtgaaaggaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagctgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatcgctggtataagaaaatcctcaagtcccaagatccaatcatattttctgtagggtggaggaggtttcagaccatcctgctctattatattgaagaccacaatggaagacaaaggcttctaaagtataccccacagcacatgcattgtggagcagccttttgggaccctatcactccacagggaactggtttcttggcaatacagtctgtcagtggcataatggtaactatcttggacaatttcttttacagattggtttgagaaatatatcctgaatgtgggttattatgtacatgagactttaagttgaaaattactcatttttattattataaagtaaatttccctttgcttttaatctttgtacatccttttcagtagggtgtgggattagaggaggggaggtggaagaattataatggtacatttcctatttttgtgcatcttttgcatttatttatctaagcaagtatttaagcagtgctcaccgtgtgctaagcactatatgaggttatgaggagccatcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaattttctaaacattgcaactgtatttttcttttccatttcgttccaaataaatcattatagtaaaattacattcctctgaaatcactctcaggaaagtactcaagtagcc

SEQ ID NO: 1466 - DNA, 1113 bp, Homo sapiens
agaggttgcagtgagctgagatcgtgccactgcactccagcttgagtgacagagtgagactccgtctccaaaaaaaaaaaaaaaaacaaaaacgaaagagtgtccattatctatactggaaaaattgagattgggatttttgacatgaagtgcggaaatgtggattgggtcaatttagtttacctaaacagatgatgaaatactgttttacgaagcattccctagtgcaaagttttgcctgtgtgtctagtgacgggaacagtaagaatgaggcttggaacgcggagcgcattgtgggcctgtcgtgggtggcgccagcagcacatgcatgcctggctcacagagcagcctttgggtgttcttttcccagaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacaggtgatcagtggcccgtgtggcttatggacacaccagagctcccaggggaagtgctctgaaaactcatcctggtcagagttcagaaggacacgtggagtataaggtcagatgcggagataaagggagatggtgtggccctcctgcctggggttgctgagcaggttgctggagacagtgatgtcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctagatcttcatctagtcaaaggactgtttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcac

SEQ ID NO: 1467 - DNA, 671 bp, Homo sapiens
ctccgccgcgccaacgctggccgcctctccgccgctgtccgcctctccgccacgccggcaccagcgctgtgtgcttttgcaagggcggagctgcgttctcctcggcacagacccggagagcattgcgagggcggagctgcgttctgctctgcacagaccttggggcactgcctcgctttgggacaactcggggccgcatcgacggtgaataaaatccttcctgtttgcagccatgtttgtggttggtggcagcgatggacactgcagccagccagagtgtagaaaaaggcatcgggtgaaagaagatggccacggagacagacagcagcgtggtcagagtggtaggagccggccatcagcgagagctgctccatgcctggctgctgggagctagagcctgcggcccactggcttgcctcactgtagttggtggtggcggtgacagagactgcagcatgaccagagtggcttttctggctttgcccacccagctgctccgtgccaggaggaggaggagacacctagagcgtgcaacaccacggctcgcctcgctgcgggtgggtggcagtgacggagactgcagtgcaccagaacggtaggagagcggccgtgctaggagggcaggcggctgcaggcagggttgggagtcaggcttacagcgatggacgggc

SEQ ID NO: 1468 - DNA, 1592 bp, Homo sapiens
cgattcctcagggatctagaactggaaataccatttgacccagccatgccattactgggtgtatacccaaaggactatacatcatgctgctataaagacacatgcacacgtacgtttattgcagcattattcacaatagcaaagacctggaaccaacccaaatgtccaacaatgatagactggattaagaaaatgtggcacatatacaccatggaatactatgcagccataaaaaatgatgagttcatgtcctttgtagggacatggatgaaattgtaaaccctctataaactatcgcaagaacagaaaaccaaacaccgcatattctcactcataggtgggaattgaacaatgagatcacatggacacaggaaggggaacatcacactctggggactgttgtggggtggggggaggggggagggatagcattgggagatacacctaatgctagatgacgagttagggggggcagtgcaccagcatggcacatgtagacatatgtaattaacctgcacaatgtgcacatgtacccaaaaacttaaagtataatgaaaaaaagagtgtttcaaaactgctctatcaaaagaaaggttcaactctgttagttgagtacacacatcataaacaagtttatgagaatggttctatctagtttttatgggaagatatttcttttttcaccataggcctcaaagcgacccaaatgtccacttccagataccacaaaaagagtgtctcaaacctgctctatgaaagagaatgttcaactctgtgacttgaatgcaaacatcccaaagatgtttctgagaatgcttctgtctacattttatatgaagatattcccgtttccaaggaaatcctgaaagctatccaaatatccacttgcagattctacaaaaagagtgcttcaaaactgctctatcaaaagaaaggttcagctctgttagttgagcacacacatcacaaactagtttatgagaatgcttctgtctagtttttatgcgaagatattccctttgtcaccataggcctcaaagcgatccaaatgtccacttccagattccacaaaaagagtgtttcaaacctgctctgtgaaagggaatgttcaactctgtgacttgaatgcaaacatcccaaagatgtttctgagaatgcttctgtctagattttatatgaagatattcccgtttccagcgaaatcctcaaagctgtccaaatatccacatgcaaattctacaaaaagagtgtttcaaaactgctctatcaaaagaaaggttcagctctgttagttgagcacacacatcacaaactggtttatgagaatgcttctgtctaatttttatgcgaagatattcccttttttaccataggcctcaaagcaatccaaatgtccacttccagattccacaaaaagagtgtttcaaacctgctctatgaaagggaatgttcaactctgtgacttgaaagcaaacatcccaaagatgtttctgacaatgcttctgtctagaatttatatgaagatattctcgtttccaatgaaatcctcaaagctatccaaatatccacctgcatattctacaaaaagcgtg

SEQ ID NO: 1469 - DNA, 3978 bp, Homo sapiens
ggaaatggacatttagatcgctttgaggcctatggtgaaaaaggaaatatcttcgcataaaaactagatggaagcattctcctaaacttgtttggaatgtgtgtactcagctaacagagttgcacctgtcttttgatagagcagttttgaaacactctttttgtagaatatgcaaggggatatttggatagctttgaggatttcattggaaacgggaatatcttcatataaaatctggacagaagcattctcagaaacatctctgtgaggattgcattgaagtcacacagttgagcattcccgttcacagagcaagtttgaaacaatgattttgtagtatgtggaactggacatttggagcgctttgtggactattgtgaaaaaggaaatgtcttcccataaaaactaggcagaagcattctgagaaaccagtttgtgatgtttgtactcaactaaaaagggtgaacttttcttttgatacagcagttttgaaacactctttttgtagaatctgcaagtggatatttggatagctttgaggatttcgttggaatagggaatatgttcatataaaatctagacagaagcattctcagaaacatctctgtgaggattgcattcaagtcacagagttgaacattccctttcatagagcaggtttgaaacactctttttgtggaatctggaagtggacatttggatcgctttgaggcctatggtgacaaagggaatatcttcgcataaaaactagacagaagcattctcataaactagtttgtgatgtgtgtgctcaactaacagagctgaacctttcttttgatagagcagttttgaaacactctttttgtagaatatgcaggtggatatttggatagctttgaggatttcgttggaaacggaaatatcttcatatgaaatcgagacacaagcattctcagaaacatctttcagatgttagcattcgagtcacagagttgaatattgcctttcatagagcaggtttgaaacactctttttgtagtatctggaagtggacattttgatcgctttggggcctatggtgaaaaaggaaatatctttgcataaaaactagacagaagcattctcataaacttgtttgtgatgtgtgaactcaactaacagaggtgaaactttcttttgatacagcagttttgaaacactctttttgtagaatctgcaagtggttatttggacagctttgagggtttcgttggaaatgggaatatcttcacataaaatctacagagaagcattctcagaaacatctctgtgatctttgcattcatgtcacagaattgaacattccctttcatagagcaggtttgaaacactgattttgtagtatctggaactggtcatttggagctctttgtggcctatgtggaaataggaaatatcttcccatagaaactagagagaagtattctcagaaactagtttgtgatgtgtgtactcaactaacagcgttgatcctttcttttgatagagcagttttgaaacactctttttgtagaaaatgcaagtggatatttggatagctttgaggatttctttggaaacgggaatatcttcatataaaatctagacagaagcatactcagaaacatctctgtgatgtttgcattctagtcacagagttgaacattctctttcatagagcaggtttcaaacactgattttatagtatgtggaactggacatttggatcgctttgaggcctattgtttaaaaggaaatatcttcccataaaaactacacagaagcattctcataaactactttgtgatgtgtttactcaactacaacagttgaacgtttcttttgatagagtagttttgaaacactctttttgtagaatctgcaacgggatatttggatagctttgagggtttcgttggaaacaggaatatcttcatattaaatccagatagaagcattctcagaaacatctttgggatgttcgcattcaagtcacagagttgaacattccctttcatagagcaggtttgaaacactctttttgtggaatctggaagtggacatttggatcgcaatgaggcctatggtgaaaaagggaatatcttcaaataaaaactagacagaagcattctcataaactactttgtgatgtgtgtgctcaactaacacagctgaacctttcttttgataaagcagttttgaaacactctttttgtagaatatgcaggtggatatttggatagatttgaagatttcattggaaacgggaatatgttaatataaaatctagacagaagcattctcagaaacatctttggggtgttagcattcaagtcacagagttgaacattccctttcatacagcaggtttgaaacactctttttccggaatctggaagtggacatttggatcgctttgaggcctatggtgaaaaagggaatatcttcgcataaaaactagacagaagtattctcctaaactagtttgtgatgtgtgtgcccaactaatagagttgaagctttcttttgatggagcagttttgaaacactcttttgtagaatctgcatgtcgatatttggatagctttgaggatttcgttggaaacgggaatatcttaatatgaaatcgagacacaagcattctcagaaacatctttcggatgtcagcattcgagtcacaaacttgaacatttcctttcatagagcaggtttgaaacactctttttgtagtatctggaagtggacattttgatcgctttgaggcctatggtgaaaaaggaaatatcttcgcataaaaactagacagaagcattctcataaacttgtttttgatgtgtgaactcaactaacagaggtgaaactttcttttgatacagtagctttgagacacactttttgtagaatctccaagtggttatttggatagctttgagggtttcgctggaaacaggaatatcttcatataaaatctacagagaagcattctcagaaacatcgctgtgatctttgcattcaagtcacagagttgaacattcccttttatagagcaggtttgaaaccctgattttgtagtatctggaactggtcatttcgagcgctttgtggcctatgttgaaataggaaatatcttcccatagaaactagacagaagcattctcagaaactagtttgtgatgtgtgtactcaactaacagagttgaacctttcttttgatggagcagttttgaagcactgtttttgtagaatctgcaagtgcatatttggatagctttgaggatttcgttggaaacgggaatatcttcatgtaaaaagtggacagaatcattctcagaaacatctctgtgatgtttgcattcaagtcacagagctgaatattccctttcatagatcaggtttgaaacagtctttttgtagtacctggaagtggacatttggagcgctttgaggcctatggtgaaaaaggaaatatcttcccataaaaactagacagaagcattctcagaaaaatgtttcggatgtctgtactcaactaacagagttgaacctttcttttgatagagcagttttgaagcactctttttgtagaatctgcaagtggatatttggatagctttcaggatttccttggaaacgggaatatcttcatataaaatgtagacagaagcattctcagaaacatctttgggatgtttgcattcaagtcacagagttgaacattctctttcatagagcaggtttgagacactctttttgtggtatctggaagtggacatttgggtcgctttgaggcctatggtgaaaaaagaaatatcttcccataaaaactagatagaaccattctcataaacttgtttatgatgtgtgtactcaactaacagagttgaacctttcttttgatagagcagttttgaaacactctttttttcattatactttaagtttttgggtacatgtgcacattgtgcaggttaattacat

SEQ ID NO: 1470 - DNA, 9715 bp, Homo sapiens
gtgcatttaactcacagatttgaacccttcttttatagagcagttttgacacactctttttgtgtaatctgcaagtggacatttgttgttctttgaggcctatgatgaaaaaggaaatatcttatggacagcactgaggatttcgttagaaacgggactatcttcacataaaattagacagaagcattctcagaaactagtttgtgatgtgtgcattcacctgacggagttcaaactttcttttgatagagcagattggaaacactctttttgtagaatttgcaagtggatatttggacagctttgaggccatcgctggaaacgggtatatcctcacataaaaactagacagaagcattctcagaaacttcttactgatgcttgcattcaactcacagagttgtacattccttttcatagagcagttctgaaacactctttttgaaggatctgtatgtgcaaatttggagagcttccaggcctatggtgaaaaaggaaatagcttcacataaaaactggacagaagtattctcagaaacttctttgtgatggatgtactcaactcatgaagttgaacttttcttttaatacagtagttttgaaacactctttttgtagaatctcaaagtggatatttggattgctttgattctttcgttggaaatgggaatatcttcacataaaaactagacagaagcattttcagaaacttctttgttatgtttgcattcaactgacagagttgaacattccctttcatatagcagttttgaaacactctttttgtaggatctggaagaggacatttggagtgctttgaggcctgtggtggaaaaggaaacatcttcacataaaaactagacagaagcattctcagaaacttctttgtgatgtgtgtacccaaactcatagagttgaaccttgctttttatacagcatttctggaacactctttttgtagaatctgcaattggatatttggatagccttggggctttcgatggaaacggcaatatgttcacataaaaactagacagaagcattctcagaaacttctttgtgatgcttgcattcagctcactgagttgaacattccttttcatacagcagttttgaaacactatttttgtagaatttgtaagaggaaacatggatggctttgaggcctatgctgaaaaaggaaataacttcccattgaaactaaacagaagaattctcagaaactcctttgtgatgtgagtactcaactcacagagttgaaattttctttcgatagagcagttttgaaacactctttttgtagtatctggaagtggacatttggagcgctttgaggcctatggtggaaaaagaaatatcttcacataaaaactagacagaagcattctcagaaactagtttgtgatgtgtgcattcaactcacagagttcaaactttcttttgatagagcagattggaaacactctttttgtagaattcgcaagtggatatttggaccgctttgaggccttcgctggaaacggttatatattcacataaaaactagacaaaagcattctcagaaacttcttcatgaagcttgcattcaactcacagagatgaacattccttttcatagagcagttttcaaacagtcatttttagaatctgtaagtggaaacttgaagcgctttgaggcctatggtgaaaaaggtaatatcttcccataaaaactagacagaagaattctcagaaactgctttgtgatgtgtgtactcaactcgcagagttgaagatttcttttaatagagcagttttgaaaccttctttttgtagagtctggaagtgcatatttggattgctttgaggatttcattagaaacggtaatatcttcacataaaaacgagacagaagcattctcagaaactacttggtgatgtttgcattcaactcacagagttgaacattccttttcatagacaagttttgaaacactcttttggttgtctctggcagtggacatttggagcgctttgaggccaatggtgaaaaacgaaatatcctcacataaaaactagacagaagcattctcagaaacttctttgtgatgtgtgtactcaacgcacagagtttatcctttcttttgatacagcacttttgaaacactttttgttgaatctgcaagtggatatttggatagctttgaagctttcattataaagggcaatatcttcacataaaaactagacagaagcattctcagaaacttctttttgatatgtgtactcaactcacgcaattgaacctttctttagatacagcagttttgaaacactgttcttctacattttacaattagatattataacagctatgaggatttcgttggaaatgggaatatcttcacataaacactagacggaagcattctcagaaacgtctctgtgatgtttgcattcaactcacagagttgaacactccctttgatagaacaattttaaaacactctttttgtagtatctggaaggggacgtttggagcgctttgaggcctagggtgaaaaaggaaatctcttcacataaaaactagacagaagcattgtcagaaacttctttgtgatgtgtgtacgcaactcacaaatttgaactttactattgatagagcagtttggaaacactctttttgtagagtctgcaattggatatttggatagtattggggatttcactggaaacgggaatatcttctcataaaaactagacagaagttatctcagaaacttctttgtgctgtttgcattcatctcacggagttgaacattccctttcatagagcagttttgtaacactctttttgtagtgtctggaaggggacatttggagcgctttgaggcctatggtgaaagaggaaatatcttcacataaaatatagacagaggcattctcagaaactattttgtgatgtgtgtactcaactcacagagttgaacctttctttcgatacagcagttttgaaacactctttttgtagaatctgcaagtggatatttggaaagcttagaggctttcgttggaaacgggaatatcttcccataaaaactagacagaagcattctcagaaacttcttggtgatgtttgcattcaaatcaaagagttgaacattcctttacatagagcagttttgaaacactctttttgtagtatctgcaagtggacattttgtgcgatttgagacctatggtgaaaaaggaaatatcttcacataaaaagtagacacagtcattctcagaaactaatttctgatgtgtgtactcaactcagagagttaaacctttcctttgttacagcagttttgaaaaactcttcttgcagaattaacaagtggctattcggacagcattgtggatttcgttgcaaacgggaatatcttctcatatatttggggagaagcattctcagaaaacgctttggaatgtatgcattcaactcactgatttgaaactttcctttaatagagcagattggaaacactttttttgtagaatttgcaaatcgatatttggacatttttgaggcctttgctgcaaacaggtatatcttctcataaaaactagacagaagcattctcagaaacttctttgtgaagtgtgtactcaactcacagagttgaacttttcttttgatagagcagttttgaaacactctttttgtagagtctgcaagtggatatttggatagctgtgaggattttgttggaacgggaatatcttcacataaaaactagacaggattctcagaaacttctttgtgatgtgtgtactcaactcacagagtggaacctttcttttgatacagcagttttcaaacacagtttttgtggaatgtgcaagtgcatattttgatagctgtgaggatttcgttgaaaacggaatacctccacataaaaactacacagagccattctcagaaacttatttctgatgcttgcattcaactgattgagatgaacattcctttttattgagcagttagggaacactctttttgtagaattttaagtggaaacttggagtgctttgaggcctatggtgaaaaaggaaatatcttcaaataaaaactagacggaagaattttcagaaaattctttgtgatgggtgtactcagttcacacagctgaacttttcttttgatagagcagttttgaaacacactttttgtagaatctgcaagtggatatttggatagctttgaggatttcgttggaaacgggaatatcttcatataaaatccagacagaagcattctcagaaactactttgtgatgtttgcattcaactcacagagttgaacttccttttcatagagaagttttgaaacactctttttgttgtatctggtagtggacatttggagcgctttgaggcctatggtgaaaaacgaaatatcctcacatgaaaactagacagaagcattctcagaaacttctttgtgatgtgtgtactcaactcacagagtttaacctttctttagataaagcacttttgaaacactctttttgtagaatctgcaagtggatatttggatagctttgaagctctcattggacacgggaatatcttcacataaaaactagacagaagcattctcagaaacttctttgtggtgcttgcaatcaactcactgagttgaatattccttttcatagagtagttttgaaacactctttttgtagaatctgcaaatggaaatttggagcactttgaggcttatggtgaaaaaggaaatatcttcccataaaaactagacagaagaattctcagaaacttccttgcgatgtgtgtactgaactcacagggttgcacctttcttttgatacagcagttttgaaacactctttttctagagtctgcaagtggatatcttgatagctttcaggatttcattagaaacggcaatatcttcacgtaaaaactagacagaagcattctcagaaacttctttgttatgtttgcattcaactcagagacttgaacattccctttcatagagcagttttgaaacactctttttgtgaaatctgcatgtggacatttggagcgatttgagacctttagtgaaaaacgaaatatcttcacataaaaagtggatagaagcattttcagaaactactttgtgatgtgtgtactcaactcacagagttaaacatttcctttgatacagcagttttgaaacactgttcttgtagactttataagtggatattaggacagctttgagtatttcgttggaaacgggaataacgtcacataaaaactagacagaagcattctccgaaacttctttgtgatgcttgcattcgactcactgagttaaacattccttttcatagagcagtttggaaacactctttttgttgtatctggtagtggacacttggagcgctttgaggcctatggtgaaaaacgaaatatcctcacataaaaactagacagaagcattctcagaaacttctttctgatgtgtgaactcacagagttgaacctttcttttgatacagcagttttgaaacactctttttgtataatctgcaagtggatatatggatagctttgaggatttcattggaaacgggattatcttcacataagaagcagacaaaagcattctcagaatctactttgtgatgtttgcattcaactcacagagttgaacattccttttcatagagaagttttgaaacactctttttctattatctgtaagtgtacatttggaatgctttggggcctatggtgcaaaacgaaatagcctcacataaaaacaagacagaagcattctcgaaaacttctttgtgatgtgtgaactcaactcacagagtttaacttttcttttgatacagcaggtttgaaacacactttttgtggaatttgcaagtggatatctggatagctttgaggatttagttgaaaaagataatatcctcacctaaaaactagaaagaagcattctcagaaatttctttgttatatttgcattcaactcacagacttgaacattccctttcatagagcagttttgaaacactctttttgtgaaatccgcctgtggacatttggagcgatttgagacctatggtgaaaaacgagatatcttcacataaaaagtggacagaagcattcacagaaactactttgtgatgtgtgtactcaactcacagaggtaaaccttttctttgatagagcagttttgaaaaactgttgttgtagactttacaagtggatatttggacagttttgagtattttgttggacacgggaataacttcacataaaaactagacagaagcactctcagaaacttctttgttatgcttgcattcaactcactgagttgaacattccttttcatagagcagtttggaaactctctttttctagaatcagtagtggaaacttggagcgctttgaggcctatggtgagaaaggaaatatcttcccataaaaactagacaaaagaattctcagaaacttctttgtgatgtgtgtactcaactcacagaggagaacttttcttttgatagagcagttttgaaacacactttttgtagaatctgcaagtggatatttggatagctttgaggatttcgttggaaacggaaatatcttcatatgaaatcgagacacaagcattctcagaaacatctttcagatgttagcattcgagtcacagagttgaatattgcctttcatagagcaggtttgaaacactctttttgtagtatctggaagtggacattttgatcgctttggggcctatggtgaaaaaggaaatatctttgcataaaaactagacagaagcattctcataaacttgtttgtgatgtgtgaactcaactaacagaggtgaaactttcttttgatacagcagttttgaaacactctttttgtagaatctgcaagtggttatttggacagctttgagggtttcgttggaaatgggaatatcttcacataaaatctacagagaagcattctcagaaacatctctgtgatctttgcattcatgtcacagaattgaacattccctttcatagagcaggtttgaaacactgattttgtagtatctggaactggtcatttggagctctttgtggcctatgtggaaataggaaatatcttcccatagaaactagagagaagtattctcagaaactagtttgtgatgtgtgtactcaactaacagcgttgatcctttcttttgatagagcagttttgaaacactctttttgtagaaaatgcaagtggatatttggatagctttgaggatttctttggaaacgggaatatcttcatataaaatctagacagaagcatactcagaaacatctctgtgatgtttgcattctagtcacagagttgaacattctctttcatagagcaggtttcaaacactgattttatagtatgtggaactggacatttggatcgctttgaggcctattgtttaaaaggaaatatcttcccataaaaactacacagaagcattctcataaactactttgtgatgtgtttactcaactacaacagttgaacgtttcttttgatagagtagttttgaaacactctttttgtagaatctgcaacgggatatttggatagctttgagggtttcgttggaaacaggaatatcttcatattaaatccagatagaagcattctcagaaacatctttgggatgttcgcattcaagtcacagagttgaacattccctttcatagagcaggtttgaaacactctttttgtggaatctggaagtggacatttggatcgcaatgaggcctatggtgaaaaagggaatatcttcaaataaaaactagacagaagcattctcataaactactttgtgatgtgtgtgctcaactaacacagctgaacctttcttttgataaagcagttttgaaacactctttttgtagaatatgcaggtggatatttggatagatttgaagatttcattggaaacgggaatatgttaatataaaatctagacagaagcattctcagaaacatctttggggtgttagcattcaagtcacagagttgaacattccctttcatacagcaggtttgaaacactctttttccggaatctggaagtggacatttggatcgctttgaggcctatggtgaaaaagggaatatcttcgcataaaaactagacagaagtattctcctaaactagtttgtgatgtgtgtgcccaactaatagagttgaagctttcttttgatggagcagttttgaaacactcttttgtagaatctgcatgtcgatatttggatagctttgaggatttcgttggaaacgggaatatcttaatatgaaatcgagacacaagcattctcagaaacatctttcggatgtcagcattcgagtcacaaacttgaacatttcctttcatagagcaggtttgaaacactctttttgtagtatctggaagtggacattttgatcgctttgaggcctatggtgaaaaaggaaatatcttcgcataaaaactagacagaagcattctcataaacttgtttttgatgtgtgaactcaactaacagaggtgaaactttcttttgatacagtagctttgagacacactttttgtagaatctccaagtggttatttggatagctttgagggtttcgctggaaacaggaatatcttcatataaaatctacagagaagcattctcagaaacatcgctgtgatctttgcattcaagtcacagagttgaacattcccttttatagagcaggtttgaaaccctgattttgtagtatctggaactggtcatttcgagcgctttgtggcctatgttgaaataggaaatatcttcccatagaaactagacagaagcattctcagaaactagtttgtgatgtgtgtactcaactaacagagttgaacctttcttttgatggagcagttttgaagcactgtttttgtagaatctgcaagtgcatatttggatagctttgaggatttcgttggaaacgggaatatcttcatgtaaaaagtggacagaatcattctcagaaacatctctgtgatgtttgcattcaagtcacagagctgaatattccctttcatagatcaggtttgaaacagtctttttgtagtacctggaagtggacatttggagcgctttgaggcctatggtgaaaaaggaaatatcttcccataaaaactagacagaagcattctcagaaaaatgtttcggatgtctgtactcaactaacagagttgaacctttcttttgatagagcagttttgaagcactctttttgtagaatctgcaagtggatatttggatagctttcaggatttccttggaaacgggaatatcttcatataaaatgtagacagaagcattctcagaaacatctttgggatgtttgcattcaagtcacagagttgaacattctctttcatagagcaggtttgagacactctttttgtggtatctggaagtggacatttgggtcgctttgaggcctatggtgaaaaaagaaatatcttcccataaaaactagatagaaccattctcataaacttgtttatgatgtgtgtactcaactaacagagttgaacctttcttttgatagagcagttttgaaacactctttttttcattatactttaagtttttgggtacatgtgcacattgtgcaggttaattacat

SEQ ID NO: 1471 - DNA, 3488 bp, Homo sapiens
cagagatgtttctgagtatgcttctgtctagattttatatgaagatattcccgtttccaaagaaatcctcaaagctatccaaatatccacttgcattttctacaaaaagagtgtttcaaaactgctctatcaaaagaaaggatcaacgctgttagttgagtacacacatcacaaactagtttctgagaatacttctctctagtttctatgggaagatatttcctatttccacataggccacaaagagctccaaatgaccagttccagatactacaaaatcagtgtttcaaacctgctctatgaaagggaatgttcaattctgtgacatgaatgcaaagatcacagagatgtttctgagaatgcttctctgtagattttatgtgaagatattcccatttccaacgaaaccctcaaagctgtccaaataaccacttgcagattctacaaaaagagtgtttcaaaactgctgtatcaaaagaaagtttcacctctgttagttgagttcacacatcacaaacaagtttatgagaatgcttctgtctagtttttatgcaaagatatttcctttttcaccataggccccaaagcgatcaaaatgtccacttccagatactacaaaaagagtgtttcaaacctgctctatgaaaggcaatattcaactctgtgactcgaatgctaacatctgaaagatgtttctgagaatgcttgtgtctcgatttcatatgaagatatttccgtttccaacgaaatcctcaaagctatccaaatatccacctgcatattctacaaaaagagtgtttcaaaactgctctatcaaaagaaaggttcagctctgttagttgagcacacacatcacaaactagtttatgagaatgcttctgtctagtttttatgcgaagatattccctttgtcaccataggcctcaaagcgatccaaatgtccacttccagattccacaaaaagagtgtttcaaacctgctctgtgaaagggaatgttcaactctgtgacttgaatgcaaacatcccaaagatgtttctgagaatgcttctgtctagattttatatgaagatattcccgtttccagcgaaatcctcaaagctgtccaaatatccacatgcaaattctacaaaaagagtgtttcaaaactgctctatcaaaagaaaggttcagctctgttagttgagcacacacatcacaaactggtttatgagaatgcttctgtctaatttttatgcgaagatattcccttttttaccataggcctcaaagcaatccaaatgtccacttccagattccacaaaaagagtgtttcaaacctgctctatgaaagggaatgttcaactctgtgacttgaaagcaaacatcccaaagatgtttctgacaatgcttctgtctagaatttatatgaagatattctcgtttccaatgaaatcctcaaagctatccaaatatccacctgcatattctacaaaaagcgtgtttcaaaactggtctatcaaaggaaactttgaactcggtgagttgagtacacacatcacaaagtagtttctcagaatgcttctgtctagtttttatgggaagatacttacttttccaccagaggccataaagcgctccaaatgtccagttccagatactacaaaatcagtgtttcagatctcctctatgaaagggaatgttcatctctgtgacttgaatgcaaacatcacaaagaagtttctgataatgcttctgtgtagattttataagaagatattcccgtttccaacgaaaccctaaaagctaaccagatatccacttgcagattctacaaaaagagtgtttcaaaactgctctatcaaaagaaaggttcaactctgttagttgagtacacacatcacaaactagttctgagaatgcttctgtcgagtttttatgggaagatgtttcctgtttcaccgtaggccacaaagtgctccaaatgtccagttccacatactacaaaatcagtgtttgaaacctgctctatgaaagtgaatgttcaactctgtgtcttgaatgcaaacatcccaaagaagtttctgataatgcttctgtctagattttatatgaagatattcccgtttccagcgaaatccaccaagctatccaaatatccacttgtagattctacaaaaagagtgtttcaaaactgctctctcaaaacaaacgttcaactctgttaattgagtacacacatcctaaacaagtttctgagaaagcttctatctagtttttatggtaatatatttcctttttcaccataggcctcaaagcgctccaaatgtgcacttcgagatactacaaatagagtgtttcacacctgctctgtgaaagggaattttcacctctgtgacttgaatgcaaacatcccaaagatttttctgagaatgcttctgtctagattttatatgaagatattctcgtttcctacgaaatcctcaaagctatcgaaatatccacttgcagtttctacaaaaagagtgtttcaaaactgctctatgaaaaggaatgttcaactctgtgagttgaatgcaaacatcacaaagtagcttctgagaatgcttctgtctggtttttatgtgaagataatcctgtttccagtgaaatcctcacagctttccaaatatccacttgcagattctacaaaaagtgtgtttcaaaactgctctatcaaaagaaaagttctcctctgtgagttgagtacacacatcacaaagaagtttctgagaattcttttgtctagtttttatgggaagatatttcctttctcaccataggcctcaaagcgctccaagtttccactactgattctagaaaaagagagtttccaaactgctctatgaaaaggaatgttcaactcagtgagttgaatgcaagcataacaaagaagtttctgagagtgcttctgtctagtttttatgtgaagttattcccgtgtccaacaaaatactcaaaactgtccaaatatccacttgtaaagtctacaacaacagtttttcaaaactgctctatcaaagaaaaggtttacctctgtgagttgagtacacacatcacaaagtagtttctgtgaatgcttctgtccactttttatgtgaagatatctcgtttttcaccataggtctcaaatcgctccaaatgtccacaggcggatttcacaaaaagagtgtttcaaaactgctctatgaaagggaatgttcaagtctgtgagttgaatgcaaatataacaaagaaatttctgagaatgcttctttctagtttttaggtgaggatattatctttttcaactaaatcctcaaagctatccagatatccacttgcaaattccacaaaaagtgtgtttcaaacctgctgtatcaaaagaaaagttaaactctgtgagttgagttcacacatcacaaagaagttttcgagaatgcttctgtcttgtttttatgtgaggctatttcgttttgcaccataggcccc

SEQ ID NO: 1472 - DNA, 2170 bp, Homo sapiens
aaaaggaatgttcaactctgtgagttgaatgcaaacatcacaaagtagattctgagaatgcttttgtctgcttcttatgtgaagataatcccgtttccaatgaaatcctcaaagctatccatatatccacttgcagattatacaaaaagagtgtttcaaaactgctgtatcaaaagaaaggttcaactctgtgagttcacacatcagaaagaagtttctgagaatgcttctgtctagtttttatgtgaggatatttcgtttttcaccataggcctcaaagcgctccaagtgtccactaccagatacaacaaaaagagtgtttccaaactgctctatgaaaaggaatgtttaactcagtgagtcgaatgcaagcatcacaaagaagtttcggagaatgcttctgtctagtttttatgtgacgttattcccgtttccaacgaaatactcaaagctgtcctaatatccacttataaagtctacaagaacagtgtttcaaaactgctgtatcaaaggaaatgtttaactctgtgagttgagtacacacatcacaaagtagtttctgaaaatgcttctatccactttttatgtgaagatatttcgtttttcactaaaggtctcaaatcgctccaaatgtccacatgcagatttcacaaaaagagtgtttcaaaactgctctatgaaagggaatgttcaagtctctgagttgaatgcaaacataacaaagaagtttctgagaatgcttctgtctagtttttacgtgaagatattgccgtttctaatgaaatcctgaaagctatcaagatatccacttgcagactctagaaaaagagtgtttcaaaactgctgtatcaaaagaaaggtgcaaccctgtgagttcagtacacacatcgcaaggaagtttctgagaattcttctgtctagtttttatgggaagatatttcctttttcaccataagcctcaaagtgctccaaatttccatttgcagattctacaaaaagagtgtttcaaaactactctatgaaaaggaatattcaactcagtgagttgattgcaagcaccacaaagaagtttctgagaatgcttctgtctagtttttatgtgaagatattcccgtgtccaatgagagcttcaaagctatccaaatatccacttgcagattctacaaaaagagtgtttcaaaactgctctatcaaaggaaagattcaactctgagttgattgcggaaatcacaaagaagtttctgtgaatgcttctgtctggtttttatgtgaggatattcgcatttccagcgaaagcctcaaaagctgtccaaatatccagcttgaaaattctacaagaagagtgtttcaaaactgctctatcaaaagaaaggttaactctgtgagttgagtacgcatatcaaaaagaagtttctgagaatgcttctgtctagtttttatgtgtagatatttcatttttcaccataggcctcaagcgctccaaatgtctacttgcagatactacaaaaagagtatttcaaactactctatgaaaacgaatgttcaactctgcgagttgattgcaaacatcacaaagaagtttctgagtatgcttctgtctagtttttatgtgaagatagtcccatttccaacaaaggcctcaaagctctccaaatgtccacttacagattccacagagagtttcaaaactgctctatcaaaagaaaggttcaactctgtgagttgagtgcacacatcacaaagaaatttctgagaatgcttccgtctagtttttatgttaagatatttcgtttttcaccataggccacaaagtacacaaaatgaccacttgcagattctacaaagagagtgtttcaaaactgcgctattaaaataagggttcaactctgtgagttgaatgcaaacatcacaaagaagtttctgataatgcttctctcgagttttcatgtgaaggtattcctgtttcgatcgaaggcctcaaagtgctccaaatatccacttgcagattctacaaagagtgtttcaaaactgctctaggaaaaggaatgttcaactctgtgagttgaatgcaaacatcggaaagaagtttctgagaatgcttctgtctagtttttatgtgaagatattccgttcccagcgaaagccccaaacctgtccaaatatccattag

SEQ ID NO: 1473 - DNA, 10046 bp, Homo sapiens
ttctgagaatgcttccgtctagtgtttatgtgaagatattcccatttccaacgaaatcctcatagctgttataatatctaattgtaaaatgtagaagaacagtgtttcaaaactgctgtatctaaagaaaggataaactctgtgcgttgagtacacacatcacaaagaagtttctgagaatgcttctgtctagtttttatgtgaggatatttcgtttttcaccattggcctcaaagcgctccaaatgtccactgccagagacaaccaaaagagtgtttcaaaacttgtctatgaaaaggaatgttcaactctgtgagttgaatgcaaacatcaccaagtagtttctgagaatgcttctgtctcgtttttatgtgaagatattaccgtttctaatgaaatcctcaaagcaatccaaatatgcacttccagactctacaaaaagaaggtttcaaaactgctctattaaaagaaatcttcaactctgcgagttgagtacacacatcacaaagcagtttctgagaattcttctgtctagtttttatgggaagatattacctttttcaccataggcctcaaagcgcttcaagtttccacttacagattctaaaaatgactgtttgaaaactgctctatgaaaaggaatgttcatctctgtgagttgaatgcaagcttcatgaagaagtttctgagaatgcttttgtctagtttttatgtgaatatataaccgtttccagcgaaggcctcaaagcggtccaaatatccacttgcgaattctacaaaaagagtgtttccaatctgctctatcaaaagaaagtttgaactctgtgagttgaatgcacacatcacaaactagtttctgagaatgcttctgtctagtttttatgtgaagatatttctttttccaccataggcctcaaagcgctccaaatgtccacttccagatactacaaaaagagtgtttcaaaactgctctatcgaaagaaaatttcaactctgtgagttgagtactcacatcacaaaggagtttctgagaattcttctgtttagtttcaatgggaagttatttcctttttcagcataggcctcaaagccatccatgtttcctcttacaaattctacaaaaatagtgtttcaaaactgctgtatgaaaaggaatgttcaactcagtgagctgaatgcaagcatcacaaagaagtttctgagaatgcttctgtctagtttttatgtgaacatattgccgtttccatcgaaagccccaaggctatccaaatatccaattgcagattctacaaaaagagtgttccagaaatgctgtataaaaagcaaggttcaactctatgagtttgggtacacacatcacaaagaagtttctgagaatgcttctgtctagtttttatgtgaagatgtttccttttccaccacaggcctcaaagcactccaaatgtcctcttccagatcctacaaaaagagtgtttcaaaactgctatatgaaagggaatgttcaactctgtcagttgaatgcaaacataacaaagaagtttctgaaaatgcttctgtctagtttttatgtgaagatattcccatttccaacgaaagaatcaaagcaatccaaatatccactttgagattctacaaaaagagtgtttcaaaactactgtattaaaagaaaagttcaacttcatgagttgagtacatccatcacaaagaagtttctgagaatacttctgtccagtttttatgtgaagctatttcctttttcaccataggcctggaagctctccaaatttgcacatacagatccttcaaaaagagtgtttcagaactgctctatgaaaaggaatgtacaactctgtgagttgaatgcaagcatcagtaagaagtttctgagaatgcttctgtctagtttttatgtgaggatatacccgtttccagcgatggcctcaaagctgtccaaatatccacttgcaaattctacaaaaagagtgtttccaatctgctctatcaaaagaaagtttgaactccgtcaggtgaatgcacacatcacaaactagtttctgagaatgcttctgtctaattttatgtgaagatagtcccgtttctaacgaaatcctcagtgctgtccataagatatttcctttttcatcataggcctcaaagaacaacaaatgtccacttgcagattacacaaaaagagtgtgtcaaaactgctctataaaagaagggttcaaatctgtgagttaaatgcacacatcacaaagaagtttctgagaatgcttctgttattttttatgtgaagatattcccgttttgaatgaaggcctcaaagcactcaggatgaccacttgcagattctacaataagagtttttcaaaactgctctatgaaaaggaatgttcaactctttgagttgaatgcaaacatcacaaagatgtttctgagaatgcttctgtctagtttttatgtgaagttatttccattttctctataggcctcaaagctgtccaaatgtccacttgcagatactacaaaaagagtgtttcaaaagtgctcaatgaaaaggaatgttcaactctgtgagtttaatgcaaacatcacaaatatgtttctgagaacgcttctgtctagtttttatgggaagatactcccgtgtccagcgaaggcttcaaagctttcgaaatatccacttgcaaattctacaaaaagagtgtttcaaagctgctttatcaaaagaaagtttcaactctgtgagttgaatgcgcacatcacaaagaagtttctgagaatgccttcagtctggtttttatgtgaagatattcccgtttccatcgaaagcttcacacgtggtcctaatatccacttttatattctacaagaagagggtttcaaaactgatgtatcaaaagaaatgtttaactctgtgagttgaatacacatatcacaaagaagtttctgctaatgcttctgtctagtttttatgtgaagatatttcctttttcaccataggcctcaaagcgctccaaatgtccacttgcagttaatataaaaagagtttttcaaaactgctctatgaaaaggaatgttcaactttgtgaattgaatgaaaacatcacaaagaagtttctgagaattcttctgtctagattttatgtgaagatattcccgtttccaatgaatgcctcaaagctgtccaaatatcaacttgcagattctacaaagagagtgtttcaaaactgctctatcaaaagaagggttcaactctgtgagttaaatgcacacatcacaaagaagtttctgacaatgcttctgtatagttttcatgtgaagatactcccatttccaaagaaggtcacaaagcgctccaagtgtccacttgcagattccacttaaagagtgtttgacaactgctctatcaaaagaaatgttcaactctgtgagttgagtgcacacatcacaaagaagtttctgagaatgatcctgtctagtttttatgtgaagatatttcctttttcaccataaacctcaaacacaccaaatgtccacttgcagattctacaaagagagtgtttcaaaactgctctatcaaaagaagaattcaaatctgtgagttgaaaggacacatcagaaagaagtttctgataatgcttctgtctagttttatgtgaagatattcccgtttcgagcaaaggcctcagagcgctccaaaggtccacttggagattctacaaaaggagtgtttcaaatctgctctatgaaaaggaattttcaactctgtgagttgaatgtacacatcacagagaagtttctgagaatgcttctgtctcatttttatttgaagatattttctttatcaccataggactcaaagcgctccaaatgtcaacttgcagatactataaaaagaatgtttcaaaactactctatagaaacgaatgttcaactctttgagttcaatgcaaacatcaaaaagatgtttccgagaaagcttctgtctagtttttatgtgaagatactcccgattcaagcgaaagcctcaaagttgttgaaatatccacttgcaaattccacaaaagcagtgtttcaaatctactctatcaaaataaaagtttcaactctgtgagttgaatgcaaacatcacaaagaagtttctgagaatgcttctgtctagttttttgtgaagttattcccgtttccaatgaaggccacacagcgctccaaatgaccacttgcagattccacaaaaagagtgtttcaaaactgctctgtgaaaagaaaggttcaactctgtgagttgagtgcacacatcacaaacaagtttctgagaatgcttctgtctagtttttatgtgaagttattaccgtttccaatgaaagcctcaaacctgtccaaatattcatttgcagtttccacaaagacagtgtttcaaaactgctttatcaaaagaaaggttcaactctgtgagttgagtacacacatcacaaagaagtttctgagaatgattctgtaaagtttttatgtgaagatatttccgtttccaacgaaggcttcaaagcgttccaaatgtccacttgcagattctacaaaaagactgtttaaaaacgctccatcaaaggaaattttcaactctttttgttgagtgcgcacatcacaaagatgtttctgataatgattctgcctagtttttatgtgaagacatttcctttttatccagaggcctaaaagcactccaaatatccactagcagatactacagagtgtttcaatactgctctattgaaaggaatgttcaactatgtgagttgaatgtaaacatcacaaagatgtttctgagaatacttctgtctagtttttatgtgaagatatccccgtttccagtgaaggcgacaaagctgtccaaatatccacttgcaaattctacaaaaagagtgtttcaaatctgctctatcaaaagaaagtttcaactctttgagttgaatacacacatcacaaagaagttcctgaaaatgcttcggtctagtttttatgtgaagatattcccttttccaaggaaagcctcaaagctgtccaaatatccacttgtaaatgctgcaaaaagagtgtttcaaaactgctacagcaaaagaaaggttcatctctgtgagttgagtacacacatcaagaagaaatttctgagaatgcttctgtctagtttttatgtgaagatatttcctttgtcaccataggcctccaagcgctccgaatgtccacttgcagatgctacaaaaagagtgtttcaaaactgctctatgaaaaggaatgtgcaaatctgtgagataaatgcaaacatcacaaagaagtctttgagaatgcttctgtctagtttgtatgttaagatatttcccatttcaccatacgtcttaacgcacaccaaatgtccacttgtagatgctacaaagagagtgtttcaaaacttctagatcaaaagaagtgttcaactctgtgagttgaggacacacatcagaaagaagtttctgagaatgcttctgtctagtttttatgtgaagatatttcctttttcaccataggcctcaaagcgcttcaaatgtccattgcagattctacaaaaagagtgtttcaaaactgctctatgaaaaggaatgttcaactctgtgagttgaatgcaaacgtcacaagtttctgagaatgcttctgtctagtttttatgggaggatatttcctttttcaacataggcctcaaagtgctccaaatgtccacttgcagaatctacaaaaagagtttttcaaaactcctctaagaaaaggaatgttcaactccatgaatttaatgcaaagatcacaaagaagtttctgagaatgcttctgtctagtttttacctgaagatacttccgtttccagtgaaggcttgaaagctgtccaaatatccacttgcaaattctcaaaaagagtgtttaaaagctgctctatcagtagaaagtttcacctctgtgagttgaatgcgcacatcacacagaagtttctgagaatgcttctgtctggtttttatgtgaagatattcccgtttccaaccaaagcctcaaagctgtccaaatatccatttgcagattctacaaggagagtgtttaaaaactgccctataaaaagaaaggttctactctgtgagtggagtacacacatcacaaagaagtttctgagaatgcttctgtctagtttttatgtgaaaatatttcgttttccaaaataggcctcaaagcgctccaaatgtccacttgcagattctacaaaaagagtgtttcaaaactgctctatgaaaaggaatgttcaactctgtgagttgaaggcaaacttcacaaagaagtttctgaggaatgcttctctctagtttttatgtgaagatattcccgtttccgacggaagcctcaaagctatccaaatatccacttgcagattatacaaaaaagggtttcaaactgctctgtcaaaacaaagattcaactctgtgtgttgagtacacacatcacaaagaagtttctgagaatgcttctatctagttttaatgtgaacatctttccttattcactatgggtcccaaaacgctgcaaatgtccacttgcagattctacaaaaagcgtttttcaaaactgctctatgaaaaggaatgttcaactctgtgagttaaaccaaacatcacaaagaagtttctgagaatgattctgtctagtttttatgtgaagataaactcatttcctgggaaggcttcaaagctgtccaaatatccacttgcaaattctacaaaaagagtgtttcaaaactgctctatcaaaggaaagttccaacagcacacatcacaaagatgtttctgagaatgcttctgtctacaatttatgtgaagatattccagcgaatatcttcaggatttccaatggaagcctgaaagctgtcttaatatccacttgtaaattctacaagaagtgtgtttcaagactgctctatcaaagaaaggtttaactctgtgagttgagtacacacttcacaaagaagtttctgagaatgcttctgtctagtttttatgtgaagatatttcctttttcaccttaggcctcaaagcactccgaatgtcctcaggcagattccacaaaaagagcatatcaaaactgctctatgaaaaggaatcttcaactctgtgagttgaatgcaaacatcgcaaagaagtttctgagaatgcttctgtctagtttttatgtgaagatagtcccgtttccaacgaaaacctcaaagctgtccaaatatccattaacagattctacagagtgtgtttcaaaactgctttatcaaaagaaaagttcaactctgtgagttgaatgcaaacctcacaaagaagtttctgagaatgcttccttctagtttttatgtgaagatattcccgtttccaaagaatacctcaaagtgctccaaatgtccacttgcaggattcacaaaaatagtgtttcaaaactgctctatcaaatgaaaagttcaactctgtgagtttagtgtacacatcacaaataagtttcttagaatgctcctgtctagttttcatgtgaagatatttccttttttaccacaggcctcaaagtgctccaaatgtccgcttgcagattctacaaaaagagtgtttcaaaactgctctatgaaaaagaatgatcaactctgagagttgaaggcaaacatcacagagaagtttctgagagtgcttctgtctagtttttatgagaagatattcccgtttccaatgaaagactcaaagctgtccaaatatacacctgcagattctacaagggagtgtttcaaaactgttctatcaaaagaaatgttcaactctgtgagtggagtacacacatcacaaagaagtttctgagaatgattctgtctagtttttatgcgaaggtatttcatttttcaccacaggcctcaagttgctccaaatgtccactagcagattctacaaaaagagtgtttcaaaacagctctatgaaaaggaatgttcaactctttgagttgaatgcaaacctcccaaggaagtgtctgagaatccttccatctagtttttatgtgaagatactcccgtttccagcaaaggcttcaaagctgtccaaatatccacttgcaaattttacagaaagtttgtttcaaagctgctctatcaaaagaaagtttcaagtctgtgagatgaatgcgcgtaaaacaaagatgttcctgagaatgcttctgtctggtttttatgtgaagacattcccgtttccaacaaaagcctcaaagctttcctaatatccacttataaattctgcaagaagagtgtttcaaaactgctctatcaaaagaaaggtgtaactgagtcagttgagtacacacatcaaaaataagtttctgagaatgcttctgtctagtttttatgtgaagatatttcctttttctccataggcctcaaagcacaccagatgtccacttgcagattctacaatgagagtgtttcaaaactgctctatcaaaagaagggttcaactatgtgagttgaaagcacatatcccaaagtagtttctgataaagcttctgtccagtttttatgggaagatattcccgtttcgagcgaaggccccaaagtgctccaaatgtccattggagattctacaaaaagagagattcaaaactgctgtatgaaaaggattgttcaactctgtgagttgaatgcacacatcacaaagaagtttctgagaatgcttctgtctagtttttatgtgaagatatttcctttttcaccataggcctcaaagcgctccaaatgtccacttgcagatactacaaagagtgtttcaaaactgctgtatgaagaggaatgttcaaatctgtgagttgaatgcaaacatcacaaagaagtttctgagaatgcttctgtctagtttttatgtgaagatattcccatttccaacaaaagcctcaaaggtgtccaaatatccattagcagattctacaaagagagtgtttcaaaacttctctatcaaaagaaaagttcaactctgtgagttgagtacacacatcaaaaagaagtttttaagaatgcttctgtctagtttttatgtgaagatattcccgtttctaacgaaggcctcaagcactccaagtctccacttgcagattttacaaaaagagtgttgcaaaactgctctatgaaaaggaacgttcaactctatgagttgaatgcaaacatcaaaaagaagtttcctagaatgcttttgtctagttttatgtgaagatactcccgtttccagcgaaagcttcaaagctgtccaaatatccacttgaaaattctacaaaaagagtgtttcgaacctgctctatcaaaggaaagtttcaactccgtgagttgaatgcacaaatcacaaagaagtttctgtgaaagcttctgtctggtttttatttgaagatattcccatttccaacgaaagccacaaagctgtccaaatatccacttataaattctacaagaagagtgtttcaaaactgctctatcaaaagaaaggtttcacactgtgagtggagtacacacatcacaaagaagtttctgagaatgcttctgtctagtttttatgtgaaaatatttcctttttcaccataggcctcaagcactccaaatgtctacttgcagatactacaaaaagattttttcaaactgctctatgaaaaggaatattcaaccctgttgaatgcaaacatcacaaagaagtttctgagaatgctttgtctagtttttatgtgaagatacccccgtttccagcgaaggcttcaaagctgtccaaatatccgcttgcaaattctaaaacaagagtgtttcaaagctgctttatcaaaggaaatttcaactctgtgagttgaatgcgcacatcacaaagaagtttctgagaatgcttctgtctggttttaatgtgaagatattcccgtttccaacgaaagcctcaaagctgtcttaatatccacctgtaaattctacaagaatagtgtttcaaaactgctg

SEQ ID NO: 1474 - DNA, 2164 bp, Homo sapiens
aaaagaaaggttcaactctgtgagatgaatttacacatcacaaagaagtttctgagaatgctgctatctactctttatgtgaagatagtcccatttccaacgaagacctcaaacagttcgaaatatccacttgcagattgtactaaaagattgtttcaaaactgctctcataaggaatgtccaactctgtgagttgaaagcaaacatcaccaagaagtttctgagaatgcttctgtctagtttttatgggaagatatttccttttccaccgtaggccttaaagtgctccaaatgtccacttgcagatcctacaaaaagagtgtctcaaacctgctctctcaaaagaaaggttcaactctgtgagttgaatacacacagcacaaataagtttctgagaaagattctgtctagcgattatgtgaagatattcccgtttccaacaaaggcttgtaagtggtccaaatatccacttgcagattctactaaaagagtgtttctaaacagctctatgataaggtatgctcaactctgtgagttgagaacaaacatcacaaagaagtttctgagaatgcttctgtctagtttttatgtgaagatatttcctttcccaccgtaggcttcaaagcgctccaaatgtccacttggagattctgcaaaaagagtgtttcaaaactgctctatcaaaagaaaggttcaactctgtgagatgaaagcacacatcacaaagaagtttctgagaattcttctgtctggtttttatataaagatattaccttttccaccataggcctcaaagttctccaaatgtccgcttgcagattctacaaaaacagggttttaaaaatgctctatgataaggtatgttcaactctgtgagttgaatgcacacatcacaaagaagtttctgagaatgctgctgtctagtttttatgtgaagatattcccttttccaacgaatgcctcaaagctgtccaaacaaccacttgcagattctactaaaagggtgtttcaaagctgctctatgataaagtatgtccaactccatgagttgaatataaacatcagagaaaagtttctgagaattcttctgtctagtttttatgtgaagatatttccttttccaccataggccttaaagcgctcaaagtgtccactggcagattctgaaaaaagagtgattcaaacctgctctatcaaaagaaaggttcaactctgcgagttcaatgcacaaagcacaaagaagtttctgagaatgcttctgtctagtgtttatgtgaagatattcccgtttccaatgaaggccttaaagctctccaaatatccacttgcagattctacaaaaagagtgttttaaaactgcactatcaaaagaaaggttcaactctgtgagttgaatgtacacatcacaaagaagtttctgagaatgcttctgtctagtatttatgtgaagatattcccgtttccaacgaaggccccaaagcgttccaagtctccacttgcagattctactaaaagagtgtttccaaattgctttatgataaggtaggttcaactccgtgagttgaaggcaagcatcacaaagaagtttctgagaatgcttctgtctagtttttatctgaagatattttcttttccaccatattccttaaatcgctccaaatgtccaattgcagaatccacaaaaagagtgtttcaaacctgctctatcaaaaaaaggttcaactctctgagtttaatgcacacagcatgaagaagtttctgagaatgctttgtctagattttatgtgaagatatttccttttccaccataggcttcaaagctctccaaatgtacacttgcagattctacaaaaagagtgtttcaaaactgctctatcaaaagaaagtttcaactctgtgagttgaaggcacacatcacaaagaagtttgtgagaatgcttctgtctagtgtttatgtgaatatatttccgtttcaaatgaaggcctcaaagcagtagaaatatccacttgcaaattctccaaacgactgtttcaaaactgctctatcaaaagaaaggttcaactctgtgagttgaatgtacacatcgcaaagaagttaatgagaatgctgctgtctagtttttatgtaaagatattcccgtttccaacgaaggcctcaaagcag

SEQ ID NO: 1475 - DNA, 1465 bp, Homo sapiens
cgtttccaaagaaggcctcaaagtggtccaaatatccactgggaaattctactaaaacactgtttcaaaactgctctatgataaggtgtgttaaactctgtgagttgaatgcaaacatcacaaaggagttcctgagaatgcttctgtctagaatttatgtgaagatatttgtttttcaaccatagcactcaaagtgctccaattgtccacttgcatattattcaaaaagagtgtttcaaacctgctctatcaaaagaaaggttcaactctgtgtgttgaatgcacacatcaaaaagaagtttctgagaatgtttctgtctagtgtttatgtgaagatgttcccgtttccaaccaaggcctcaaagcattccaaatatccacttgcagattctactaaaagagtgtttcaaaactgctctatgataaggcctcaaagcgctccaaatgtccacttgtagattctacaaaaagagagtttcaagactgctcaatcaaaagaaacgtttaactctgtgagatgaatgcacacatcataaagaaggttttcagattacttctgtctacgtcttatgtgaagatatttccttttccaccataggctgcaaagagctccaaatgtccacttgcagagtcttcaaaaagagtgtttccaaactgctccatcaaaagaaatgttcaacttcatgagctgaatgcacacatcacaaagaagtttgtcagaattcttctgtctagtttttatgtgaagataattccttttccaccataggcctcaaagccttcaaaatgtccacttgcagattctacaaaaagagagtttccaaagtgctcagtcaaaagaaaggtttactctgtgagatgaatgcacacaccacaaagaagtttgtcatattgcttttatctagattttatgtgaagatattttcttttctaccataggccacaacgcgctccaaatgtccagttgcaaattctacaaaaagagtcttcccaaactgctcaatcaaaagtaaagttcaactctgtgatatgaacacacacatcacaaagtagtttctcagaattctgctgtctagtttttatgtgaagatatttccttttccatcataggcctcatagcgctccaaatgtccacttgcagattttaccaaaagggagtttcaagacagctccatcaaaagaaagttttaattctgtgagatgcatgcacacatcacaaagaagtttctcagattgcttctgtctagattttattttaatatatatccttttctaacgtaggccgcaaagtgctccaaatgtccacttgcagattctacaaaaagagtgattccaaactgcttaatcaaaagaaaggttcaactctgagagatgaatgcacacatcacaaagaagtttctcagaattattctgtctagtttttatctgaagatgtttccttttccaccacaggcctcaaagcgct

SEQ ID NO: 1476 - DNA, 5324 bp, Homo sapiens
caaaagaaatgtttaactctctgagatgaatgcacacatcataaaaagtttctcagattgctactgtctagattttatatgaagatatttcgttttcttccgtaggccaaaaagcactccgaatgtccacttgcagattctacaaaaagactgtttccaagctgctcaatcaaaagaaagttacaactctgtgagatgaacgcacacatcacaaagaagtttgtcagaattattctctctagtttttatgtgaagataaattccttttccaccgtaggcctcaaagcgctccaaatgacaatttgcagattctacaaaaagagagtttcaacactgctcaatcaaaagaaaggctcaattctgtgagatgaacgcacacatcacaaagaagtttgtctgaattcttctgtctagtttttatgtgaagatatttccttttccaccgtaggcctgaaagtactccaaatgtccacttgcagattctacaaaaagagagtttcaatactgctctatcaaaaggaaggtttaactctgtgagatgaatgcacacatcacaaagaaatttctcagattgcttctgtctagatttaatgtgaagatattcccttttctaccatagtccacaaagcgctccaaatgtccacttgcacattctacaaaaagagtgattccaaactgctcaatgaaaaggaaggttcaactctgtgagatgaatgcacacatcacaaagaagtttctcagattgcttctgtctaggttttatgtgaagatatttccttttctaccttaggccccaaagcactccaagtgtccacttgtagattttacaaaaagagtgtttccaaactgctcaatcaaaaggaagtttcaactctgtgagatgaacgcacacgtcacaaagaagtttctcagaattcttctatctagtttttatgggaagatatttccttttccaccataggcctaaaagcgctccaaattttcacttgcagattctacaaaaagagagcttcaaaactgctcaatcaaaaaaaaagttttaactctgtgagatgaaagcacacatcacaaagaagtttctcagtattcttcaatctggtttttatgtgaagatattttcttttccacattgtcctcaaaccgctccaaatgtacacttccagattctacaaaaacagagtttaaaaaatgctccgtcaaaagaaatgtttaagtctctgagatgaatgcacacatcacaaagaattttctcatattgcttctgtctagattttatgtgcaggtatttccttttctaccactggccgcaaagcgctccaaatctccacttgcagattctgcaaaaggagtgcttccaaaatgctcaatcaaaatgaaggttcaactcagtgagatgaatgcacacatcacaaagaagtttctgagaattcttctgtctagtatttatgtgaagatatttccttttccactataggcctaaaagcgctccaaatgtccacttgcagattctacaaaaagagagtttcaaaactgctcaaccaaactaaagttttaactctgtgaaatgaatgcacacatcacaaagtagtttctcagattggctctgtctgaattttatgtgaagatatttctttttctatcataggccacaaagtgctccaaatgtccacttgcagattctacaaaaagggtgtttccaaacagctcaatcaaaagaaagtttcaactctgtgagatgaacgcacacatcacaaagaagtttgtcagaattattctctctagtttttatgtgaagataaattccttttccaccgtaggcttcaaagtgctccaaatgaccatttgcagattctacaaaaagagggtttcaacactgctcaatcaaaagaaaggctcaattctgcgagatgaacgcacatatcacaaagaactttctcagaattcttctgtcttgtttttatgtgaagatatttccttttaaaccataggcctcaaggcgctcgaaatgtccacttgaagattctacaaacagagtatttcaaaactggtccttcaaaagaaagattcaactctgggtgatgaatgcgcacatcacaaaatctttctcagaatgcttctatgtagtttttatgtgaagatatttccttttccaccataggcctcaaagcgctccaaatgtccacttgcagattctacaaaaagacagtttcaaaactgctcaatcaaaagaaatgtttatctctgtgagatgaatgcacacatcacaaagttgtttctcagattacttctgtctagattttatgtgaacatatttcctagtctaccataggccgcaaagtgctccaaatgtccacttgcagagtctataaaaagagggtttccaaactgctcaatcaaaagaaagtttcaactctgtgagatgaacgtgcccatcacaaagtttttcagaattcttctgtctactttttatgggaagatatttcctttttcaccgtaagcctcaaagcactcgaaatgtccacttgcagagtctacgaaaagagaggttcaaaactgctcaatcaaaagaatggcttaactctgtgagatgaatgcacatatcacaaagaagtttctcagattgcttctgtctagatattatgtgaagataattccttttctaccataggccgcaaagcgctccaaatgtccacttgcagattctaaaaaagagtgtttccaaactactcaatcaacagaaatgttcaagtctgtgacatgaatgcacacatcacaaagaagtttctcagaaatcttctgtctatttttatgtggagatattttcttttccaccaaaggcctcaaagtgctccaattgtccacttgtagattctacaaaaagagagtttcaaaattcctcaatcaaaagaaaggtttaactctgtgagatgaaagcacacatcacaaagaagtttctcagattgcttctgtgtaggttttatgtgaagatatttccttttctaccataggccgcaaagcgctccaaatgtccacttgcagattctacaaaaagagagtttccaaactgctcaatcaaaagaaagtttcacctctgtgagatgaacgcacacatcaccaagaagtttctcagaattcttctatctagtttttatgtgaagatatttctttttccaccaaaggcccaaaagggctccaaatgtccacttgcagattctacaaaaagagagtttcaaaactgctcaatcaaaaaaaattttaactctgtgagatgaatgcacacatcacaaagaagtttctcagattgcttttgtctagattttatgtgaagatatttccttttctaccataagcctcaaagcgctccaaatgtccacttgcagattctacaaaaagagtgtttaaacctgctcaatcaaaagaaatgttcaacccggtgagataaatgcacacaacacaaaggattttctatgaatgattctgtctagtttttatgtggacatatttccttttaaaccataggcctcaaagcgcttcaaatgtacacttgcagattccacaaaaagagtttttcaaaactgctcaatgaaaagaaaggttttaatctgtgtgaagaatgtacacataacaaagaattttgtcagaatatttctgtagagtttttatattaaggtatttgcttttccaccataggcctcgaagagctccaaatgtccacatgcagattctacaaaaagagtgtttcaaaactgctcattcaaaagaaaggttcaactctgtgacatgaatgcacaagtcacaaagaagtttgtcagaatgcttctgtctagtttttatgtgaagatatttccttttccaccatgggccacaaagtgcaccaaatgtccaaattcagattctacaaatagagtctttcaaaactgctcaatcaaaagaaaggttcaactctgtgagatgaatccacacatctcaatgaagtttttcagaatgtttctgtatagttcttgtgtgaagatatttctttttccaccattgcctcaaagcgccaaaaatgtccacttgcagatactacagaaagagtgtttcaaagttgctcttgtccgattgcttctgtctagattttatgtgaacatatttccttttctaccataggccactaagtgctccaattgtccacctgaagattcttcaaaaagtgtgtttccaaactgctcaatcaaaagaaaggttcaactctgtaatgtgaaggcacacatctcaaagtagtttctcagaattcttctgtctagtttttatgtgaagatattacattttccaccattgcctcaaagcgccaaaaatgtccacttgcagatactacagaaagagtgtttcaaagtggctcaatcaaaagaaagtttcaactctatgagatgaatgcacacatcacatagaagtttctcagaatgcttctgtctagttattatgtgaagatatttcgttttccaccataggcatcaaagcgctccaaatgtccacttacagattctacaaaaggagtgtttcataactgctcaatcgaaattaaggttccactctgcgagatgaatgcacacatcacaaaaactttgtcagattgcttctgtctagttttgtgtgaagatatttccttttccaccacaggccttaaagctctccaaatgtccacttgctgattctacaaaaagaatgtttcaaaactgctctatcgaaagttaagttcaactccatgagataaatggcaactccgtgagataaatgacaaataagcttgtcagaatgcttctgcctagttttaatgtgaagatatttccttttccaccataggccgtaaagcgctccaaatgtccacttgcagattctacaaaatgagagttctcaaaactgctcaattaaaatcaagtttcagctctgtgagaggaatgcgcacatcacaaagcagtttcacagaatgcttccatctagttcttaaatgaagataattccttttccaccataggccaaaaagcgctccaaatgtccacttgcagatattacaaaaagagtttttcaaaactgctcgatgtctgttcatgtccttcacccactttttgatggggttgtttgttcttttcttgtaaatttgtttgagttcattgtagattctggatattagccctttgtcagatgagtagcttgggaaacttttctcccattttgtaggttgcctgttcactctgatgttagtttcttttgctgtgcagaagctctttagtttaattagatcccatttgtcaatgttggcttttgttgccattgcttttggtgtt

SEQ ID NO: 1477 - DNA, 1862 bp, Homo sapiens
tttggaccgctttgaggcatttgttggaaatgggaatatcttcagataatcactagatagaagctttctcagaaactactttgtgaagtgtacattcatgtcacagagttgaacctttctttttatagagcagtttaagaaacccctttttgtagaatctgcatgtggatatttcgaccagtttgaggtcttcgttggaaatgggtatatcttcacataaactctagacagaagcattctcagaaacttttttgtgatgtgtgcattcaactcacagagttgaacatttcttttgatagagaagctttgaaacactctttttgtagaatttgcaattggatatttggtctgctttgaggccttctttggaaacgggaatatctttatataaacactagacagaatcattcccagaaacttctttgtgaggtgtgcattcaactcacagagttgaacataccttatcatagagcagctttcaaacactctttttgtagaatctgcgagcggatatttagagagctttgaggcctatggtggaaaaggaaatatcttcacataaaaactagacagaagaattctgagaaacttctttgtgatgtgtgcgttcttctcacagagttaaaacttccttttgattgagcagtttgcagacactctgtttgtagaatctgcaagtggactattggagtgctttgttgcctatgttataaaaggaaatatcttcacatgaaatatagacagaaccaatgtgagaaacctctttgtgatgtgtgcattcatctcacagagttaaagcattcttttgattgagcagttttgaaactctttttttgtagaatctgcaagtgaacatttggagtgctttgaggcctatggtggaaaaggaaatatcttcacataaaaactagacagaagaattctgagaaacttctttgtgatgtgtgcgttcatctcacagagttgaacctttcttttgattaagaattatggaagcactctttttgtagattctgtaagtgggcatttgaagcactttgcagcctaagttagaaaaggaaatatcctcacataaaacctacacagaagcaatgtgagaaacttccttgggatgtgtgcattcatctcacagggttaactcttacttttgattgagcagttttgaaactctctttttgttgaatgtggaagtggacatttggagcgctttgaggcttatggtggaaaaggaaatatcttcacatagaaactagacagaagctttcttagaaacttctttgtgatgtgtgcactgatctcacagagttaagcctttgttttgattgagcagttttgaatctctctttttgtagaatctgcaagttaacatttggagccctttgaggcctgtggagggaaaggaaatattttcacatcaaaactacatagaagaattcggagaagcttctttgtgatgcatgcgtttatctcacagagttgaacctttcttttgattaagcagtttggaaacactctttttgtggaatctgcaagtggacatttggagcgctttgcagcctatgttagaaaaggaaatatattcccataaaatctagatagaatgaatctgagaaacttctttgtgatgtgtgcattcatctcacagagttaaaactttcttttgattgagctgtcttgaaactctctttttgtaaaatctgcaagtggacatttggagccctttgaggcctacggtggaaaagtaaatatttttacatagaaactagacagaaaaattctgagaaacttctttgtgatgtgtgcttacatctcacagagttgaacctttcttttgattgagcagtttggaagtactctttttg

SEQ ID NO: 1478 - DNA, 7492 bp, Homo sapiens
tccaaatgtccacttgcagattctacaaaaagagtggtttcaaattattcaatcaaaagaaagatttaactctgtgagatgatcccatgcataaaaaagaagtttctcagaattcttctgtctagtttttatgtgaatatatttccttttccaacacaggcctcaaagtgctgcaaatgtccacttgcagattttacaaaaagagagtttcaaaactgctcattcaaaagaaaggtttaactctgtgagatgaatgcacatatcacaaagaagtttcacagattgcttctgtgtagattttatgtgaagatatttccttttctaccataggccgcaaagcactccaaatgtccacttgtagtttctacaaaaagagtgtttccaaactgctgaattaaaagaaaggttcaactctgtgagatgaacgcaagcatcacaaagaagtttctcagaatacttctgtctaatttttatgtgaagatatttcattttccatcattggcctcaaggaacttgaaatgtccacttgaagattctatgaaaagaggatttcaaaactgctccaacaaaagaatggtttatctctgggagatgaatgcacacacaacaaagaagtttctcagaatgcttctatctagtttttatgtgaagatatttccttttccaccataggagtcaaagcgctacaaatgtccacctgcagattatataaaaagagagtttcaaaactgcacaatcagaaggaaggtttaactctgtgagttgaatgcacacatcacaaggaagtttctctgattgcttctgtctagattttttgtgaatatatttccttttcaaccgtaagccgcaaagcactacaaatgtccccttgcagattctacaaaaacagtgttttcatactgctcaatcaaaagaaaggttcaactctgtgagatgaaagaagtttctcagaattcttctgtctagttttcatgtgaagatatttccttttccaccatagtcctcaaagtgctccaaatgtccacttgcagattctacaaaaagagagtttcaaaactgctcaatgaaaagaaaaatttaactctgtgagatgaatgcatacatcacaaagaagtttatcagattgcttcatctagatttaatgtgaagatatttccttttctaccatagacaacaaagtgctccaaatgtccacttgcagattctacaaaaagagtgtttctaaactgctgaatcaaaagaaatgttaaactctgtgagatgaacgcacacatcacaatagcttttcagaatttctctgtctagtttttatctgaagatattaccttttccacagtaggcctcaaagcactccaaatgtccacttgcatattccacaaaaagagagtttctaaactgctctatcaaaagaaacgtttaactctgtgagatgaatgtacacatcacaaagaagtatctcagactgcttctgtctagatattatgtaaagatgtttccttttctaccataggacacaaagcactccaaatgtccccttgcagattctggaaaaagagtgtttccgaactgctcaatcaaaagaaagtttcaactctgtgagatgaacgcacacatcaccaagaagtttctcagaattcttctatctagtttttatgtgaagatatttccttttccactataggcctaaaagcgctccaaatgtccacttgcagattctacaaaaagagagtttcaaaactgctcaatcaaaaaaaagttttaactctgtgagatgaatgcacacatcacaaagaagtttctcagtattctttctaggttttatgtgaagatatttccatttccacattggcctcaaaccactccaaatgtacacttccagattctacaaaacagagtttcaaaaatgctcaatcaaaagcaatatttaacactgtgagaagaatgcacatatcacaaagaattttctcatattgcttctgtcgacattttatgtgaaggtatttccttttctaccataggccgcaaagtgctctaaatctctacttgcagattctacaaaaagagtgtttccaaactactcaatcaaaataaagtttcaactctgtgagatgaacacacacatcacaaagaagtttgtcagaaatcttctgtctagtttttatgtgaagatatttccttttccaccatagacctcaaagcgctccaaatgtccacttgcagattctacaaaaagagagtttcaaaactgctcaatcaaatgaagttttaactctgccaaaaagcactccgaatgtccacttgcagattctacaaaaagactgtttccaagctgctcaatcaaaagaaagttacaactctgtgagatgaacgcacacatcacaaagaagtttgtcagaattattctctctagtttttatgtgaagataaattccttttccaccgtaggcctcaaagcgctccaaatgacaatttgcagattctacaaaaagagagtttcaacactgctcaatcaaaagaaaggctcaattctgtgagatgaacgcacacatcacaaagaagtttgtctgaattcttctgtctagtttttatgtgaagatatttccttttccaccgtaggcctgaaagtactccaaatgtccacttgcagattctacaaaaagagagtttcaatactgctctatcaaaaggaaggtttaactctgtgagatgaatgcacacatcacaaagaaatttctcagattgcttctgtctagatttaatgtgaagatattcccttttctaccatagtccacaaagcgctccaaatgtccacttgcacattctacaaaaagagtgattccaaactgctcaatgaaaaggaaggttcaactctgtgagatgaatgcacacatcacaaagaagtttctcagattgcttctgtctaggttttatgtgaagatatttccttttctaccttaggccccaaagcactccaagtgtccacttgtagattttacaaaaagagtgtttccaaactgctcaatcaaaaggaagtttcaactctgtgagatgaacgcacacgtcacaaagaagtttctcagaattcttctatctagtttttatgggaagatatttccttttccaccataggcctaaaagcgctccaaattttcacttgcagattctacaaaaagagagcttcaaaactgctcaatcaaaaaaaaagttttaactctgtgagatgaaagcacacatcacaaagaagtttctcagtattcttcaatctggtttttatgtgaagatattttcttttccacattgtcctcaaaccgctccaaatgtacacttccagattctacaaaaacagagtttaaaaaatgctccgtcaaaagaaatgtttaagtctctgagatgaatgcacacatcacaaagaattttctcatattgcttctgtctagattttatgtgcaggtatttccttttctaccactggccgcaaagcgctccaaatctccacttgcagattctgcaaaaggagtgcttccaaaatgctcaatcaaaatgaaggttcaactcagtgagatgaatgcacacatcacaaagaagtttctgagaattcttctgtctagtatttatgtgaagatatttccttttccactataggcctaaaagcgctccaaatgtccacttgcagattctacaaaaagagagtttcaaaactgctcaaccaaactaaagttttaactctgtgaaatgaatgcacacatcacaaagtagtttctcagattggctctgtctgaattttatgtgaagatatttctttttctatcataggccacaaagtgctccaaatgtccacttgcagattctacaaaaagggtgtttccaaacagctcaatcaaaagaaagtttcaactctgtgagatgaacgcacacatcacaaagaagtttgtcagaattattctctctagtttttatgtgaagataaattccttttccaccgtaggcttcaaagtgctccaaatgaccatttgcagattctacaaaaagagggtttcaacactgctcaatcaaaagaaaggctcaattctgcgagatgaacgcacatatcacaaagaactttctcagaattcttctgtcttgtttttatgtgaagatatttccttttaaaccataggcctcaaggcgctcgaaatgtccacttgaagattctacaaacagagtatttcaaaactggtccttcaaaagaaagattcaactctgggtgatgaatgcgcacatcacaaaatctttctcagaatgcttctatgtagtttttatgtgaagatatttccttttccaccataggcctcaaagcgctccaaatgtccacttgcagattctacaaaaagacagtttcaaaactgctcaatcaaaagaaatgtttatctctgtgagatgaatgcacacatcacaaagttgtttctcagattacttctgtctagattttatgtgaacatatttcctagtctaccataggccgcaaagtgctccaaatgtccacttgcagagtctataaaaagagggtttccaaactgctcaatcaaaagaaagtttcaactctgtgagatgaacgtgcccatcacaaagtttttcagaattcttctgtctactttttatgggaagatatttcctttttcaccgtaagcctcaaagcactcgaaatgtccacttgcagagtctacgaaaagagaggttcaaaactgctcaatcaaaagaatggcttaactctgtgagatgaatgcacatatcacaaagaagtttctcagattgcttctgtctagatattatgtgaagataattccttttctaccataggccgcaaagcgctccaaatgtccacttgcagattctaaaaaagagtgtttccaaactactcaatcaacagaaatgttcaagtctgtgacatgaatgcacacatcacaaagaagtttctcagaaatcttctgtctatttttatgtggagatattttcttttccaccaaaggcctcaaagtgctccaattgtccacttgtagattctacaaaaagagagtttcaaaattcctcaatcaaaagaaaggtttaactctgtgagatgaaagcacacatcacaaagaagtttctcagattgcttctgtgtaggttttatgtgaagatatttccttttctaccataggccgcaaagcgctccaaatgtccacttgcagattctacaaaaagagagtttccaaactgctcaatcaaaagaaagtttcacctctgtgagatgaacgcacacatcaccaagaagtttctcagaattcttctatctagtttttatgtgaagatatttctttttccaccaaaggcccaaaagggctccaaatgtccacttgcagattctacaaaaagagagtttcaaaactgctcaatcaaaaaaaattttaactctgtgagatgaatgcacacatcacaaagaagtttctcagattgcttttgtctagattttatgtgaagatatttccttttctaccataagcctcaaagcgctccaaatgtccacttgcagattctacaaaaagagtgtttaaacctgctcaatcaaaagaaatgttcaacccggtgagataaatgcacacaacacaaaggattttctatgaatgattctgtctagtttttatgtggacatatttccttttaaaccataggcctcaaagcgcttcaaatgtacacttgcagattccacaaaaagagtttttcaaaactgctcaatgaaaagaaaggttttaatctgtgtgaagaatgtacacataacaaagaattttgtcagaatatttctgtagagtttttatattaaggtatttgcttttccaccataggcctcgaagagctccaaatgtccacatgcagattctacaaaaagagtgtttcaaaactgctcattcaaaagaaaggttcaactctgtgacatgaatgcacaagtcacaaagaagtttgtcagaatgcttctgtctagtttttatgtgaagatatttccttttccaccatgggccacaaagtgcaccaaatgtccaaattcagattctacaaatagagtctttcaaaactgctcaatcaaaagaaaggttcaactctgtgagatgaatccacacatctcaatgaagtttttcagaatgtttctgtatagttcttgtgtgaagatatttctttttccaccattgcctcaaagcgccaaaaatgtccacttgcagatactacagaaagagtgtttcaaagttgctcttgtccgattgcttctgtctagattttatgtgaacatatttccttttctaccataggccactaagtgctccaattgtccacctgaagattcttcaaaaagtgtgtttccaaactgctcaatcaaaagaaaggttcaactctgtaatgtgaaggcacacatctcaaagtagtttctcagaattcttctgtctagtttttatgtgaagatattacattttccaccattgcctcaaagcgccaaaaatgtccacttgcagatactacagaaagagtgtttcaaagtggctcaatcaaaagaaagtttcaactctatgagatgaatgcacacatcacatagaagtttctcagaatgcttctgtctagttattatgtgaagatatttcgttttccaccataggcatcaaagcgctccaaatgtccacttacagattctacaaaaggagtgtttcataactgctcaatcgaaattaaggttccactctgcgagatgaatgcacacatcacaaaaactttgtcagattgcttctgtctagttttgtgtgaagatatttccttttccaccacaggccttaaagctctccaaatgtccacttgctgattctacaaaaagaatgtttcaaaactgctctatcgaaagttaagttcaactccatgagataaatggcaactccgtgagataaatgacaaataagcttgtcagaatgcttctgcctagttttaatgtgaagatatttccttttccaccataggccgtaaagcgctccaaatgtccacttgcagattctacaaaatgagagttctcaaaactgctcaattaaaatcaagtttcagctctgtgagaggaatgcgcacatcacaaagcagtttcacagaatgcttccatctagttcttaaatgaagataattccttttccaccataggccaaaaagcgctccaaatgtccacttgcagatattacaaaaagagtttttcaaaactgctcgatgtctgttcatgtccttcacccactttttgatggggttgtttgttcttttcttgtaaatttgtttgagttcattgtagattctggatattagccctttgtcagatgagtagcttgggaaacttttctcccattttgtaggttgcctgttcactctgatgttagtttcttttgctgtgcagaagctctttagtttaattagatcccatttgtcaatgttggcttttgttgccattgcttttggtgtt

SEQ ID NO: 1479 - DNA, 811 bp, Homo sapiens
cgggctcccacagtgcagcggtggggcgaagggctcctcaagcgcggccagagtggacgtccaggccgaggagacacggagagcgagcaagggctgccagcacgctgtcacttcttattaagaaatatcagacattaatgaaccagtaaagaagatactgaggtgcagaagagctttcccagtgtcccaggagccattctacacagcatcctacagaatgactgtggatctgctgtgcttagtttctttacttgtgaaaacagagtaatagtagcacctacctcacagggttgttctgaagattagaggggttctttcatgggaagttctagagcagtgcttgagacatgccccaccactcttgagagtatgagtcaacagaagtttgcaggctaaaaccattcaataatattttcatcaatactggaatgatagctgtattttcagactacacctgtcccacctgccgggatgcgcagcgggaccagcgctgcccgcgcctctcaccgcactgcatccgcctcccgccagccaggaagccactgcggcctgaggcttcccgccaccaccgcgcgcgccttcctccggggacatggggagctggctgaaggcgtaaaggagcgagcagaagcctcaggccagacacagcgccaccacgcgcggtagcgccgcatggccccagccgcgttcctcggtctccgtctccgccgcgcccgcctggcgaactggagcacagggactatagttctggaaatttatcctttttctctccatggattcagcagcagtgtctaaaagaaaaaaattcatc

SEQ ID NO: 1480 - DNA, 467 bp, Homo sapiens
agccactgcacccggccaggggttttggtttgtttattttcatggcccttatggggaacagatcttatctttaaatgtattcagatgtgcttttccaaagtttcgagactggagaatatgctgagaatatgctgggttctgtgttcagggctgaagaggatgtgacggatgaagagtgtggcctgtggtgctggtgggactcatagtagaccacctgggagaacacatagactcagatcggcagggcagccctctctgccatgttggatgaggagaatctattctgcagaggaggccagcgtgcactggggagaggccccgtcccagagagagggtctgagacagacatgggggcacttgatggatttccttttccgggatctgagccctcctgaaggaccttggactccaaaagtgcccttgtatctctataataaatcctcatgtttcaaattcttcagctgacc

SEQ ID NO: 1481 - DNA, 3467 bp, Homo sapiens
gtgttctggggctgacagagttttgaattctccctggcatggaggcctcaaggtctggcccagtgagggacctcccaaccgtggcctccagccacccccgctggtgttctggggctgacagagatctgaattctccctggcatgtagttctcaaggtcctgcccaatgagggtccctttagctggggtctccagccacccccaccggtgttctcagtctgacagagatttgagttctccctggcatggaggtctcaggatcttgcccagtgagggacctcccaactggggcctccagccacctccgccagtgttccggggctgacagagatttgaattctccctggcatggaggtcttgaggtcctgcccagtgaggaaactctcaaccgtggcctccagccacccgcccctgctgttctcaggctgagagagatctgaattctccctggcatgtagttctcaagatcctgtccaatgagggtccttttagctggggtctccagccaatcccaccggtgttctcaggctgacagagatttgagttctccctggcatggagtgccccgagggaggggtgggctgccatatttgatgttttggcaacttagccattccaacctttgggctttaaggagtcccagctgacttagggtggatatagcccaccagcacagcacagctgctgtacaaaagcatagccagactgcttctttaagcaggtcccggattcattcctcctcactgtttgggacttcccaactggggcctccagccacccccactggtgttctcctgctgacagtgatttcagttttttcttggctggagctccctgatggaggggcaggccatcatgtttgctgtttttgcaacttaaccacttcaaccttcagtctttggagtgtccaaggagaccaggggctgatgtggaccctcagcatagcacagatgctctataaaaatgtggtcagactgctttttaagcactttcccaatgtcattccgcctcactgggcaaaaccccctaactggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcagcagccctatggaaaagtggccagactgttacctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgccaagccatgatctacagccagcactcaaggaggagagaagcacattttcagatcattgagagtgaacatggctgcaactgtgaggaaacataggggagccacatgaccaagcaagactctaccaactgaccagtaagcccaagtgccacctactggatcacatcccaaagcttcagcaccaaaaataccttactaatatactcccctctgaaaccagaaatgagaagtcagcttcaaataaagaacctgcacaaagcctcagcctggtgaaaacatctgaaaataagtctacggactgtactcaatctacactgcaattaaaggaaaacccataggtggaaatgagaagaaaccaatgcaagaactccagtaactcaaatggcctctgtgtcatatgtccttcaaacaaccacaccagttctccaacaagagttcttaacctggatgaactgtctggaattacataaatataattgagaatatggataggaaaaaaaatcatcaagactcaggacaatggcagaacccaatccaaggaaaataagaataacaataaagtgttataggagctgaaggacaaagtagctggtataataaaaaaagaaactaactgatctgaaagcgccaaataacacaatacaagaatttcacaatgcaatcacaagtattaacagcagaaaaaaccaatctgaggaatgaatctcagaacttgaagattggttctctaaaataagatggacaaaaataaaaaagaatgaacaaaaccttcaaggagcatgggattatataaagaagccaattctacaaatcactggcatctctgaaagggaggtggagaaatcaaataacttggaaaacatttcaggatatcatctatgaaagcttccctaaccttgctggaaaggccaacagtcaaattcaggaaatacaaagaactcctacaagattctacacaagaccatcctcaagacacataaacatcaggttttccaaggtcaaaatgagggaaagaatgttaaaggcagccagagagaaaggggcaggccatctacaaagggaaccccatgaggctaacagcagatctctcagctgaaatcctacaagccagaagggattgggggactatatttaacattattaaagaaaatcttcaaccaagaatttcatatccagctaaactaagcttcctaaatgaaggagaaatgagatcatttacagacaagcaaattctgaggtaattcattaccaccacatctgccttacaagagattttagaaaggaggactaaatatagaaaggaaagaccactacacactaatacaaaaacatacttaaacacacagaccagtgacactataaagcaaccacacaaacaagccaacataataaccagccaacagcacaatgacaagatcaaatctacacaaatcaatactaaccttgaaagtaaatggacaaatgccccacttaaaaggcagagtggcaagctagattaaaaaaaaaaaaaagcgagacccaatggtatgtcgtcttcaagagacccatctcacacataatgacactcatcgtctcaaactaaaaggatggaggaaaatctaccagacaaatagaaaacagaaaaaaagcagaggttgcaatcctaatttcagacaaaacagatttcaaatgaacaataatttttcaaaaagacaagggggcag

SEQ ID NO: 1482 - DNA, 3157 bp, Homo sapiens
gtgttctggggctgacagagttttgaattctccctggcatggaggcctcaaggtctggcccagtgagggacctcccaaccgtggcctccagccacccccgctggtgttctggggctgacagagatctgaattctccctggcatgtagttctcaaggtcctgcccaatgagggtccctttagctggggtctccagccacccccaccggtgttctcagtctgacagagatttgagttctccctggcatggagtgccccgagggaggggtgggctgccatatttgatgttttggcaacttagccattccaacctttgggctttaaggagtcccagctgacttagggtggatatagcccaccagcacagcacagctgctgtacaaaagcatagccagactgcttctttaagcaggtcccggattcattcctcctcactgtttgggacttcccaactggggcctccagccacccccactggtgttctcctgctgacagtgatttcagttttttcttggctggagctccctgatggaggggcaggccatcatgtttgctgtttttgcaacttaaccacttcaaccttcagtctttggagtgtccaaggagaccaggggctgatgtggaccctcagcatagcacagatgctctataaaaatgtggtcagactgctttttaagcactttcccaatgtcattccgcctcactgggcaaaaccccctaactggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcagcagccctatggaaaagtggccagactgttacctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgccaagccatgatctacagccagcactcaaggaggagagaagcacattttcagatcattgagagtgaacatggctgcaactgtgaggaaacataggggagccacatgaccaagcaagactctaccaactgaccagtaagcccaagtgccacctactggatcacatcccaaagcttcagcaccaaaaataccttactaatatactcccctctgaaaccagaaatgagaagtcagcttcaaataaagaacctgcacaaagcctcagcctggtgaaaacatctgaaaataagtctacggactgtactcaatctacactgcaattaaaggaaaacccataggtggaaatgagaagaaaccaatgcaagaactccagtaactcaaatggcctctgtgtcatatgtccttcaaacaaccacaccagttctccaacaagagttcttaacctggatgaactgtctggaattacataaatataattgagaatatggataggaaaaaaaatcatcaagactcaggacaatggcagaacccaatccaaggaaaataagaataacaataaagtgttataggagctgaaggacaaagtagctggtataataaaaaaagaaactaactgatctgaaagcgccaaataacacaatacaagaatttcacaatgcaatcacaagtattaacagcagaaaaaaccaatctgaggaatgaatctcagaacttgaagattggttctctaaaataagatggacaaaaataaaaaagaatgaacaaaaccttcaaggagcatgggattatataaagaagccaattctacaaatcactggcatctctgaaagggaggtggagaaatcaaataacttggaaaacatttcaggatatcatctatgaaagcttccctaaccttgctggaaaggccaacagtcaaattcaggaaatacaaagaactcctacaagattctacacaagaccatcctcaagacacataaacatcaggttttccaaggtcaaaatgagggaaagaatgttaaaggcagccagagagaaaggggcaggccatctacaaagggaaccccatgaggctaacagcagatctctcagctgaaatcctacaagccagaagggattgggggactatatttaacattattaaagaaaatcttcaaccaagaatttcatatccagctaaactaagcttcctaaatgaaggagaaatgagatcatttacagacaagcaaattctgaggtaattcattaccaccacatctgccttacaagagattttagaaaggaggactaaatatagaaaggaaagaccactacacactaatacaaaaacatacttaaacacacagaccagtgacactataaagcaaccacacaaacaagccaacataataaccagccaacagcacaatgacaagatcaaatctacacaaatcaatactaaccttgaaagtaaatggacaaatgccccacttaaaaggcagagtggcaagctagattaaaaaaaaaaaaaagcgagacccaatggtatgtcgtcttcaagagacccatctcacacataatgacactcatcgtctcaaactaaaaggatggaggaaaatctaccagacaaatagaaaacagaaaaaaagcagaggttgcaatcctaatttcagacaaaacagatttcaaatgaacaataatttttcaaaaagacaagggggcag

SEQ ID NO: 1483 - DNA, 3036 bp, Homo sapiens
ccagtgaggaggaatggatcacagaccttcttaaagacccagtgtggccacattttggtagagcaccttgctatgccaaccccgccagtgttctcaggatgacagatttggattctccctggcatggagtgccccgagggaggggtgggctgccatatttgatgttttggcaacttagccattccaacctttgggctttaaggagtcccagctgacttagggtggatatagcccaccagcacagcacagctgctgtacaaaagcatagccagactgcttctttaagcaggtcccggattcattcctcctcactgtttgggacttcccaactggggcctccagccacccccactggtgttctcctgctgacagtgatttcagttttttcttggctggagctccctgatggaggggcaggccatcatgtttgctgtttttgcaacttaaccacttcaaccttcagtctttggagtgtccaaggagaccaggggctgatgtggaccctcagcatagcacagatgctctataaaaatgtggtcagactgctttttaagcactttcccaatgtcattccgcctcactgggcaaaaccccctaactggggtctccagctacctcctacaggtgtgtttgggccagcaacaagttcattcatacctccctagggcaaagcttccaaagggagcagtaggctgccaacttttctgtttcacagccttcactgatgataactccaggtactggaaaatctgaggctactagagactgaagtgggccctgggcatactgcagcagccctatggaaaagtggccagactgttacctgggttcccattcctgtatcttctcactaggcaagtcttgcaggcctgggcctctacctaacccccctgccagagctgtcgagccagtagcaactcagccactccctggacagagcctccaggggcaactgaaagcctctctgccactgcttctgcagtggaactgtccttgctaccctcagactgatgaaggagctaacacccttatctacaccttcaacaagctttaattgaccaaagcccatctcccacgggttttacacactccccactgctcataacagacagggaacccctggattggcccccacagcatgaattctccatcctgcttgctgattgcaataaacagttgctgacctgtattctccgggggtagaaccctgaggagacaaacaaaagacccttggctacaaccactactaatgtcccttcctcttcttccccaaagttagggaagaaatataaacactgagattgccccagagctgcagtgggcagcctaggagtgccaagccatgatctacagccagcactcaaggaggagagaagcacattttcagatcattgagagtgaacatggctgcaactgtgaggaaacataggggagccacatgaccaagcaagactctaccaactgaccagtaagcccaagtgccacctactggatcacatcccaaagcttcagcaccaaaaataccttactaatatactcccctctgaaaccagaaatgagaagtcagcttcaaataaagaacctgcacaaagcctcagcctggtgaaaacatctgaaaataagtctacggactgtactcaatctacactgcaattaaaggaaaacccataggtggaaatgagaagaaaccaatgcaagaactccagtaactcaaatggcctctgtgtcatatgtccttcaaacaaccacaccagttctccaacaagagttcttaacctggatgaactgtctggaattacataaatataattgagaatatggataggaaaaaaaatcatcaagactcaggacaatggcagaacccaatccaaggaaaataagaataacaataaagtgttataggagctgaaggacaaagtagctggtataataaaaaaagaaactaactgatctgaaagcgccaaataacacaatacaagaatttcacaatgcaatcacaagtattaacagcagaaaaaaccaatctgaggaatgaatctcagaacttgaagattggttctctaaaataagatggacaaaaataaaaaagaatgaacaaaaccttcaaggagcatgggattatataaagaagccaattctacaaatcactggcatctctgaaagggaggtggagaaatcaaataacttggaaaacatttcaggatatcatctatgaaagcttccctaaccttgctggaaaggccaacagtcaaattcaggaaatacaaagaactcctacaagattctacacaagaccatcctcaagacacataaacatcaggttttccaaggtcaaaatgagggaaagaatgttaaaggcagccagagagaaaggggcaggccatctacaaagggaaccccatgaggctaacagcagatctctcagctgaaatcctacaagccagaagggattgggggactatatttaacattattaaagaaaatcttcaaccaagaatttcatatccagctaaactaagcttcctaaatgaaggagaaatgagatcatttacagacaagcaaattctgaggtaattcattaccaccacatctgccttacaagagattttagaaaggaggactaaatatagaaaggaaagaccactacacactaatacaaaaacatacttaaacacacagaccagtgacactataaagcaaccacacaaacaagccaacataataaccagccaacagcacaatgacaagatcaaatctacacaaatcaatactaaccttgaaagtaaatggacaaatgccccacttaaaaggcagagtggcaagctagattaaaaaaaaaaaaaagcgagacccaatggtatgtcgtcttcaagagacccatctcacacataatgacactcatcgtctcaaactaaaaggatggaggaaaatctaccagacaaatagaaaacagaaaaaaagcagaggttgcaatcctaatttcagacaaaacagatttcaaatgaacaataatttttcaaaaagacaagggggcag

SEQ ID NO: 1484 - DNA, 872 bp, Homo sapiens
ccctcatccttctaacttctgcttctgctttccattaagggacttgccacaagtcgcctcatcagaaacctccaaattacctcactagctgctttctttgtttacacctgcccaatttgacatacattcttttttgttcataaatctaatatccatattggtggacttgattctttgacctccacattagtttcttcattattttcaccaccactgtattgtgacatctgtacaatcccattctgacacatgtgaagataaggttttgctttattaaaatgttaaatatgtcagacacttgactaacatgtacaaattccttcttcacaaaagcagccccattgcctcctctctcccatagacactctttcacagctgttcttcactcacatcgccccatggcttcctctctcccatagacactctttcacagctgttcttcactcacattggtttgagtatctatcatctcttattttgtctctatgctttcacatcatattatgagttattatcataggctcagcagcctatcttacctattttcctctccagcagacagtactgagtagtaaattagaatcttccaggatatgaaccctttcatgtacacaagactttgtggagctattttatgtttaactacacataaaaccactatgtctatgccttccagagaaatgggttctgaaatgttattgaacataacctatttaaaaacttctttaactccaatgacactgcctctcctcaatgcaccaacatcttcagaaataacttgtgaagacttgaaaacatgtcagtaattgacatgaaaaatgaagaatggtgtaattttttgcaggtacaaataagacacgctgagatcctta

SEQ ID NO: 1485 - DNA, 593 bp, Homo sapiens
ctgatactaagaaacatgaataatgaggcactgtggtttatcccaattctagcactccttcctgattccagtagtcattggagcagccagaaatcagatgatccggtatgcaaatattcaaaatgcatctgaatcactgtggtttatcccaattctagcatagtttcctgcttctagtagttcctggagcagccaaaatcaaatcttcttttatgcaaatgttccaaatgtattgaagtgagttcactgaggtttcctcagcagaaatcccaaattacataaataactacttttccctccttcctgactcacaatccctattccttgaggaaaataattgctacatcactgctcttgctagttctcattctacagtgtttttgtggtattaggatcacttttccctctgtttatcacaatacaatctgacgcctctaatatctattacttcatctctttctcttttccctcttgatggaaacatgctgtagaattaaagcaaaatgatgctgtcccctgagcctgttatgtgttgaattgctgtcagatggttctttttcccaatttcaaagtacagacatctataatcttag

SEQ ID NO: 1486 - DNA, 1074 bp, Homo sapiens
ggtctccagccacccccaccggtgttcttgggatgacagagatttgaattctccctggtatggaggtctcagcgtctggcccagtgaaggacttcggcctccagccaccctgccagtgttttggggctgacagaaatttgaattctccctggcatggaggtcttgaggtcctgcccagtgagggacctctcaaccgtggcctccagccacccccaccggtgttctcgggctgacagagatctgaattctccctggcacgtagttctcaaggtcccgcccaatgagtgtccttttagctggggtctccagccaatcccactggtgttctcaggctgacagtgatttgagttctccctggcatggaggtctcggggtcttgcccagtgaggaacccccccaaccggggcctgcagccaccctcgctggtgttctggggctgacagagatttgaattctcccaggcatggagtttgtgaggtcccacccagttagggttctcctaactgagacctctggccactcacacctgtgttctcatgctgaaagagatttgaattcttcctggcatggaggtctccggttcctgcccagtgagggtccttccaactcaggcctccagccaactccccccacccccgccaatattctggggctgacagagatttcaattctccctggcatcgaggtatcggggtcccgcccagcgaggaggaatggattggggatccacttaaagaggcagtctggccacattttggtagagcagctgtgctgcgtgggggatcccttctgccctcagttggtttgggttctcaaaagcccaacaggctggaatggctaagttacccaaacaacaaagatggtggcctgccctgtcccctaggaagtcagtctcaggtaggtaaaacactgttgctggtggctggctggagttgtttccttgattatgtgagtaatgcgagtacctggttgtttcagttgaaggtgctgtattgacttgcccttttcattcctctccatgagagccgtgcaccctagcttcttctagtcagtcatcttggccacacaccccca

SEQ ID NO: 1487 - DNA, 393 bp, Homo sapiens
atccagtcgtggcaccaaaggataatatattagcctcaataaaaatatcatcaattatcaattttgacatatttctacaaagtaaaactgctacaagcattagatattgatgttttacattcagaaatcattccaatattctttgacaatgatcactctaggacttaattagaatgcaacataatttatgcctctaaaatagctttgttgggagtatcatgttattttctaaagaagtttcattaaacagctattttatacaagaggtagctccttcaacaaggaagccaatgtattcatattcaagtttatctcatttctataactaaaatcaacaaaacatgtatctctgatgcctaatagtaacaaaaaggagtaatgagtcagtgtgct

SEQ ID NO: 1488 - DNA, 8248 bp, Homo sapiens
tactgcccaaaacaaataaataaaggtatcataatgcactaagcttggcaaatacaattgtgtagggacaaaactgtattatacaatatttttacatctttaaaggaaactaaaggcaactgtgctctgtaggagctctgacagaatccacattacattcccagttttccatagatctcttttctttttaaatggggaggcatcataaggaacactggacggaacctctgttttacggtaacctgtaaaactgccttccctgcacctctgaaaacccaaagctcctacagaagagaggagctgcttgcctctgtgccacacaccctcaccctgcaggcactggaagcgtgtgatgctgccggaagcccaggaatgatgccttcagagagaatactgaaacctgaaccttttctatagcatttgccaagtcttacagttttatggtgacccattacatagagcaaaaattgggaaaataattcatataaaggtgtcacatgcaaaactgctgacagatgatcaacatttgctatattccctttgatgagtgcagatatttaatgctctccagacaaaaaagatctgaaaactatgtgggtaatatttatttttaaaaagcaaggagattttttaaaagttaaaatgagaaaagacagaactaaaaatttacaaattaaatgagatggtggagaggtgaaagggtaaatcagccatattgaaaacaaactgtctgtgaacagaaattgacacttaaaaaggagaatctgataccagcagcagccacctgtgcagtgggtttggcgggcaggagcttctctgcttcctgcctgccacagtgaactcagctttgagggagcagcagagagcttcgtccttcattaaagtgtccttcacagacattttcctccctgcaggcatcgggagacagcaggcgctgcttgcatgctgacttctgagtaggagggggtctggaaggtcatccagttccaccctacctgatgcccaccccctctgtgttcctgccaataagcagtcctccccatgcctcagcacccctggcccaagtttgttacatgtttctaaaggaaccagaagaatctctaggcttttagacaaaagaatttctaagaggttcacaaatcattaggatcagcatcattaatatgtgccatatgtatttcttttacaaccttttcaagaacatgtaaacatcgtaaacagaatcaataaaacatataaactcctaagaaacaaactctgctatgtgcagataagactcatcatcatcttataaaagatgaccagacaaaattttctatgaaattcctaagttttatggcccataaatccctttcaaaatctcatttgaggagaataaatttcaactgtttctcaatagtcatcttacataagaatgagaataagaaagtaacaattattgcaaacctaaaaataagacactttcatcagacattcaaacatgattgtactgtcttttcaaagataaattggaaatcctgcaaaaaaaattttttttctgaaaatatttaggtttctactatctctatggtcataaattccccatgggagtgttgacatgccacatctgaggccctacattaacatctagagaagaaggggagatgtgtcctctgggcgtgagggagcctcggcagggagcttcagagaacaggagacaggctaaagggaccttactgctggctttgtgtctccagcagactccctgttctgtaactcataagggacagaaaaaagagtggccccaactatgtggggtaccttgcaggtgttaccttctaataaagtcttatctcccgttgatttatcaatctttctttcaacttcttcaggtggtagtgtagataggataattcactagaacccgttattctcactgcatgagatagtgctagcttctttccccaaataacatttattggtatgcctaggatccaattatttaatttattatttactgttttacattcagatttttacaaagtggattgtaattcaatggttacttttgagttactctgtagaaaagtaagtgagcaagcaggcatttgaaaaagtcttctagcatttcagacaaacctagcttgattcatgtaggtaactattgatgagatctgtgtagttacagccaaaggctatttaatttaaataggcagttgttactatccacactattgagccaaacattacctcctattgattccaatggggaaaaaaacccaaaaaacaaaaaacatgctccagagactctttagtgaaatgttttttttaaaaaaaccacaaaaaataaaaaccaatccttcaggtcttcttgaagaattcatatatgacactagagggtacccacatttattatgtaacagctaattagaggaaaccgtgtgttcacgtttcaacttttccgtaagtcccttcgggaggcctgtaatgcttggggaaagccttcagctgcagggaattaaatgcatatttgcgacttccaacattcttcattgtattttctcttcgacaaccctcactggggaaaaaacaagcacaagaaatgacggcagtaaaaaaggaaaaaagaaaagacttaaactaagatgaaatgaactgatcattttcataacattaaaaaaaagattaatttaaatgggtgccggactcatttacaacaaatacatatgtaagatggcaggtttctgaacaaggcaattaagaagcacagagatggacacatgctgcgtggggctgtgagttgtgcgttcctaaaagcagcactgtatctaagtggaagcaaactttttccaagtgaatggtttcatgtagctcatgtcttttggggttctatcataacttgtggttcaaagattccctcacatagcaaatgaagtggaaaaagaaatattactactcttactaaagttgcacttcagagctttaaagagccggacttttctgtattagcaagagctgtaatcacatcaaattcaaaatgctgactttccttgcagaattcaacatgtagcaaagccagctggctaggaaggcgttctggtctgctgtctcctggaggacagttgttctgggtgccaggtaatccaatgggttcatgcactgtctgcagagcagcctggcaatcagggctggaatgttatgagggagggatctcaccaagttctggtagcagccagccacccttccacaggtgggctgcccccatgtgttccctcttgcacaggtgccactgagccagtgagagcccacaggtgcccttccctagagaactcactaccagcgtcatcctcagctgcatctgatggagggttgccatggcaatccagggggcaaaagcaaacactgcatgggaggatgagcagccagggggcctcacctactcagtgagcgcgtccggggagttctctgggaaatgttcaggtgtagacataaaactaaccagcaaaagtgattttaaacataaatgacttcccacagcacagtataacttgatggttttatgctgttctaagactagcagtgaaatcaactagttatcaaatttagtacaaaattccccttatgagatgtaaaatttgcagttaccaagaaacagtgattttttaaaaaattcaaattgtatgaagaccattatgtcacgcatttaaaaaaaaaaaacatcagtggcaattgctcaagccttttaaagtgaaaatgacagtctcattatcaagaacatgtaaaatacttttggtaagacagtattttttattcaaaagctaagctccgatagtttagaaaagtatccacctggttgttgtaactaatttggtaacttggatatgctttcttgtcacggagcctcaaggcctcagctagatgtgtgtcatctgagctgaacacctaggccacaggaggccccctggagtaagtaacaatcgtgtttgcctaacattcattcagtaatcaaaaacgtacttccacttaaagcagaagctataggttcctatacacagttaatctcctttaatctttggaaactcttacattaatgaactacttcagatatggcttctccatttatatagaaatgtacaaactgcttaaaaaccacctgtcactaataaatgctaaactgccgtgaggagcgaggcagaataatttgtgaactttgacattatcttttatttacatgttaaaggagttaatgcctagtttagctggctgaacacatcagatgtgaaattctaataaagattatactttcatttcaacgtagttttcaaatcaaattgtatttactttcccccagatgtttgaatttgcaatatccggctgatgtggctgatccacatgccgacactgttatcccaccacctgcctgtgcggacgagctggcaagagggcccggggcgaggcatgcagaggtggcgaggacagcctgtgctaactggggtttcctgctgcagaggccaagctgctgccctaaggcaggacacctccactgatcacgtcggctgcatactttttaggaaccaatggtacatgttgaggtggtcttagattttagcaagagggacttaattatttcaaagctccatgattacttttattatatcaataaattatttcttttcaagggcatccatttttgaaatgaaaattaaaatggaaaccccaagtgacagataattttagggaatcctctagttttccggttccagtggggtcttccacttgagaactcatctgcaggcatcagtatcttagtgattctatggctgagcatggggtggctgctactcctgtcactttgtggagggaaaacaggtcattgtgttaaaatctctgctggaatcaagccataggcgtaaatagtgactgtcacactagttgaaaaaacttatacaacaattttataagaccatccaaagagaaccactcctgattgtggtttccctaacttcagaaagctgatttaatctgaacacctagagctggctgacatcaacaatgcctcagcactactacagtataagcaactaaaaaccatcactaaatgtcaatgacccctttcttgaatcatctcccatctttgtttcatcctgcctatttctcactaaagcaagtaagattttgcatacgtatttggcctgatttcatgagtaaaaggccttagtgacattaaaattcagcataaagggagagcaactgagtttcttttctcaaatactttaagtttaaaaagccaaaaccaacccaccacctaggctaatctcatggtgtccttttgctagctctccaagtgcacaggcggcatactgattttcacccagaccctggaggagagaaacaaagaaccttatctcgctccctttggtctcatttctctcagcccacgggccaagcccacatgggcagaaaggtgtggtgacaatcaaggatcaggccgtggtgtccttgaggccccctgggaggggctcctcggcctggccgcagcttctctgtgctatggggcagggtcctgggaggcgtccctggagggtgccacagaagcatccttgagccctgggagagggaggggtgctgtctgcagtcagagggccttcctctgtgcatgggctctgcctagccactagccctgctgtggaagtgggagtgcacgtaagtcaccactacaggcattggaaccacgttaccaggagcaggaccaggaagctgtgtaatgggaactgaatgaggctgtggactctgctctcttgctttcaaataaagcaaacaagatggtcttagttgaagtgcacgcctcaatgtgaaagagggaaagtggcaaacatggcaaacatgcctttcaaataatcacaggctggacaggacactgcccagggactattgtcatgctgccacagcttacaccacccatgagctggcgtttggtgacttcagactccctactgaaggccaccaggagctatgccacaacagccacctcatttattttagaagagacaagtgaacacactgcacttggagaagcgtggattcacttacaggggtgacacacaggtgatgcctgccccagggagcctgcagtgctcatgatggtcttacattttaggatgtaaagtgttgagtctagcatttgccattcattgctaactgcttctgtgattcctaggacccagactctgagctgatactgaatgagaaaaagcccggggtaaggtctgggagtcctggagagataatgaagagaggtcgctcgctgccttttgtggtcgactgggtttctgggcatgcatgggtgtcaagtttctggaaaagcaagcttctctaaattcattcccatttttctggcctggttaaaaaaaatcgtcttcataaactacagtgtatggggaaccagctggagatagaaagtggaggcacaacataatatgaactggaaaacagagaagctgctgaccgtcctgcacagggtgtggggagtttttcctgatctatttggttacttttacaggtggacaattaccctctgccctacatgggtgttaaggttacacttcatcgcgctgcagggaatgccacgtgaggactgagggggcaccagcagaaaccagagcgccctgctgctctctcagctccatccaccgcaactgcccacaagtcagggatcacttttttttttggcattttttctttgattttttttcattatcaatcatatttgattagtaagagagaaaagatgttggaactttaatctgcaattaaagataccattttttaaatgaaaaatactgttttaaaataaataaaagtatataactttaacagcctttggtgactatatgcattaattccttgaaccagctgaatgatccttacatagtgaagagtaaatctaaagtcacatgcagtaggtgatctttctgtgtctggcgtatgcaggaggttatctttctgtttgacttatgcagtaggtgatctttctgtgtctggtgtatgcagtaggcgatctttctgtttgacttatgcagtaggtgatctttctgtgtctgacttatgcactaggtgatctttctgtctgacttatgcggtaggttatctttctgtctggtgtatgcagtagatgatctgtgtctggcgtatgcagtaggttatctttctgtctggtgtatgcagtaggtgatctttctgtgtctggcgtatgcagcaggtgatctttctgtgtctggcgtatgcagcaggtgatctttctgtgtctggcgtatgcagtaggtgatctttctgtgtctggcgtatggagtaggtgatctttctgtgtctggcgtatgcagtaggtgatctttctgtgtctggcgtatgcagtaggtgatctttctgtgtctgactgtgtctggctcttgctacagtgtactactgtattcacagctttgtgtcatccttaattggaaataataaacataagcaaggaaatggtaggattctgcaaactgtttgctactgtaattcagggactacgctttgaaatgaaagcagaaagtacatgtcctattagataggtttttctagataagccagttataaagcatgtttttttcttttcgtttgtcatcaaaaggaaaggaagggttagcagtacacttaaagaatagtatcaaatatacaaattctctttaaacagaactcgtttctcttggaaacagggcacatgagaggtacaggtgataaatagttgtacatcagaaggtagagacgtggtacaaggaattccaggccagctaaacgatgcagtgacagggcaccgtaagaacatgttacaagcactgaagatgctacaggagctaaacaaacaagtcttcttggtgaaataatttggcagatatttacagttcagaagaacaaaacgtcaaaatgtaaggcatgaaatatttcttggcagaccacggtttgacacattccttctgtccagttaggtacacggtggctggacatgttctggcacttttgtttttcttgtgacttattaatttttcataatgatattcatttgcaacgcaatttggtcaccaggtatgctatgctcagaaagagccacacaatcagtaaattggggctcagagctaataaagggatggaacagaggaggctggggtctagccttaagtctcggatgggcaccaggccgctcaagttcttctgggtgactacctcccgtgttccaatg

SEQ ID NO: 1489 - DNA, 1974 bp, Homo sapiens
gcttttactcagctctgcccctgggatatttctggatatttagtagcttccaaaggtttgctggttaaggggtgttttggaagaagaaagggatgattttctgtattctttacttatttctgttgtttttttcttaagtggtcatcatttcaaaaagactaggtaataaggtgagaggtactgaaatagaagtgccaacagacaaaattggagagaagcatttggtaggatggtttgcaaaaaacccctcaagcctctgcttgcctaattgatatgctgttctggaacaattcagcctgacacaggtgctcctgcaggttagttaaaaggagagtgcagtgcggaatccatatgctaccattccgcctttcaaagcagcagagaatctgaggctgtgtctccattagtaatcaccagacataacagttaaacatatatcacaccaggctcaaaaatccctggaagatactttgtgtccattctgttctactctgaatctgttcataatattggtaaaatgggacaagaggttggagaagaagaagaagggaaggaaacccccgacaagatttggaaagcagagaattcacatattctactcttggaagcttaaagagtgtccaacagagtgcctaataaagcgtaaagtgaatatttattgaaccaatggtgaccatgtgctaagaggttgaacatatcagttatcagtggagattctggctatgaagagaggtggttagtgccatccagtgcagctcaccacctgacacacacatggcaaggtctgggacagctaagcctgcatatgctgtgtgtagtctaatcctcttttccatattctttcatccagttcctgtgggtgcggacattccagtcacagaacagcagctctacatctaggaggctcctgaagaacccaaactaactgtgaaaatgcaagtgaaaagtcctgctctggtgtgttacaggtgctgcttctagaaaacccctttattagaaagcagcatgaaaccagcgttgggatataagaggatgtgctttgttaaaagaaaacctctttctaatactcccaaccaaagggccagaggtcttgtctaactaaatgccacctttctgtgattcttggagcttcatcttcaaagactgagaggatcctccttcatctgaaacctctcagaaagggaaaggttggtcgtgacttgtcccctcaacaaggaacttcaggcactgccaactgtgttcagtaacccttctctgacaggtgaatacgtgaggggtcctggaactattatgccaattctccatgttggtgggttgccaacgtttacttgtcttattgagaaaggaaagaatgagcaaagaaatctttccttttctttccaggatgctctccagaaaaattcctgctagcttgactcagaagaagagcagcctgtgcatgagcctgttccccttgagaatttcctcttccttcattagtgtcttgcgatggccacattctccatttctgtgacttcctaccagcttttcaaatgcttaactacaaactaaagttattctggcattggcaatgtgatctcaggattcccacaactagctttcctcaagatgaatattgggacgagtttggcagcagactgtatgataaggagcactggaatgggagtcagaaagcattgtgaaccctacagggcaagtgacttcacctctcttaatctcattgtcatcaactgtaagtgagagtgaatgaaggatgctcccaactgtcaaaccctgtaagttaagaaaacctgtgctccagaggagaacatgaacattggcaaaaagtggactaaagcttctgctgcaccacgaacccaagaattgtagacatatcccagtggccagatggctgactacccaccgaatctatcttcccattctctcaaggtaatgagctagctgtagcccaatatgtgacctctcagttggcgg

SEQ ID NO: 1490 - DNA, 585 bp, Homo sapiens
cggggctcggactcgggtgtggaggaggggctcgcgcttgggcctgggcggagaggcgccgtgcagttctgggaaacccggccaggaccgggaggcagggcttagggctctgagccgggcccgagcgtgcagctgggagatgcctggaaggcagagataggagccaggatgtggagttggcggcgagacgtggaggctgggctcagggcctagcgtgggcgtgaagatagaagaggagccggaacgtgcaagggagggctggcagcccgagcgcggaggcggggccggaatcgaagctgtaaaactacaaatcgttcttcaaatggagccccaggtgcagtcgaggactaagatctaccgcagccccctggaccagcctgctagcccatgcttcgatgttgatgacatcaaaggcacccctcccgaggaaatctcaactgcatgacccctactgcgccctagttcagaaggaagcagttagagcagtcgctggcccgcctccccaacagcacttgggttttcctgttgagaggagggactgagagacaggactagctgcgtttcctaggccggctaagaatccct

SEQ ID NO: 1491 - DNA, 217 bp, Homo sapiens
tgcctgttcactctgatggtagtttcttttgctgtgcagaagctctttagtttaattagatcctgtttgtcagttttggcttttgttgccattgcttttggtgttttagacatgaagtccttgcccatgcctatgtcctgaatggtaatgcctaggttttcttctagggtttttatggttttaggtctaacgtttaagtctttaatccatcttgaat

SEQ ID NO: 1492 - DNA, 2847 bp, Homo sapiens
cctctataaaataatttcagtcggtgtcgctgttcagtagatgacatctgctggaatgaatatggtctagatgctgctccatctcctttacagattgtatgcttgtctagaggatgtatgccacattttatccatgaaccttttctaccacacgcaccattctttatccccatgccccatcattacgccaatgccattccctaataaatgaatgtgaggggttttaattattttgtgccaaatttcttcaagcaactatatgttgaactcttattatcaaatgatgagtttgagtctccaaaattactacttgttttcattaattgacttagtgatacgttacctaactctgttgcatagttttggtccactaagtggctgcaggaaggaaggaaatgaagtgctgggcatttcgttaggcgattacaagaacacaacttttaataccaaagtatttatcatttatgattttcctagttctcttgcagtgagctaagcaacttgttttgtgatttatttattggaacttactaagcttttttttttttttagatagacgtttcaaggaaaaaggaagtttcataaaataatttcaatagatgtctcgttaaaattcaagttgatttcagtgctattctgacctagctaccaactagctttgagaccccaaacaagccacttaccctctgtgatcctcagttttctcatctctaaaatgagggggatgggctaagttgtccctaaagccctctaaagtgctacatgctgtaattatgagtctatgttatccccggaaatatcatgaaaaataaaaataaaattgattgagttgaaaatggtccaacagttacaaagaaatatttgacattgtaatcatgcatcagttagtttttggctctttaattttgaaagcagatgtttgattgcttgtttaaagcctgcgtaaaaaaccccaggcaaaccttgcaaaagctcaaaatattcttaagcagggatatcaattgcataatttcctagaccttgcagattggttcaaattaacccacagcatatttgaaagcctttttcttttgtgagcatctaaccaattccccattgctctcctcctgggtatctattcgttatcaaaaccggaagcacagtgtggcatccaaattggagttcagtgtcagcagaggttacatttgtacatttcccagaaaaggaacaattattgtcataggagaggattaatgtacggccattttgggtctttattataatcttttctttaagaatgaggaattggaatgttaatgtattcaataatctatgaattatacaggtatgctatagtgctttgaccttttcaacatttggtaattttgattgagtggctgttctgagcctgttctttttaacagctctattatcctgtggaaaagaggaaggctagccaaatttcaaaaacacatttatcccgaagcaagaatagagggaattagttacaatgtgccagagagagtgcaagatgacttacagaccttctctgatgtaacctcaacaacatctcatgagataatattattatcaccattttacagatgaagaaattgggacccaatgcatgcctcatgggtaagaggcagaggcaataataatcccagtactatatgatatcaacatctatacacttgcacaaaggtggtggatacaacagcagcccacttatggtatcagtttatgtttcagtcagagtagaataagctatgctgtggaagaaaataaatgctaaaatttcactggcataacaaattaatggttaatttctcaatcatgcaagtccaatgaaagtgtactaggtggcttttctccatcttgtggctgtgccatctgaagaatgtgaccttaagatcaccacacatggaaggaaagacctgaaggaccatgtgaataaagggccagattggtctgtggccatatcacctccactaaatccattgccctcaatccagtcacatgcatcctaacctcaaggaaaactggagaagcacatggatggatacctggtgagaactaatagcatatgccacagattctatagtggcattagaagttcacctaattcttaagtcttgtttttatttattttattatttatttattttttgagatagagtcttcctctgtcacccaggctggagtgcagtgtcacttggctcactgcaactgccacctcccggatttgagcgaccctcccacctcagccttggagtacttaggattacagctgtgagctaccacgcctagctaatttttttggatttttagtagagatgggatttcaccatgttggtaaagttggtcttgaacttctgacctcggtctcccaaagtactgggattacaggtatgagccactgtgccccgccctaatttttaaatttcaaattttaaatttttaaattttaaagtctgatttttaaaataccgaaaggtataccctccaatttctccctaggaatatgccctgtgttagtccagaagatgctgaaggcatatttgaggggttaccatgggggcattctttcatctgatcactgcagatttctccttaactctgtcatgtctcatcagtgtagactgacccacacttttccacaccatttacctctctggattggattgactattctttatctcatttttaacctctcctcatctgtcttcatggagatgtagttttgtgttttaacatctctaagaatatgttttgttaatgtaaattatattttacatatcctctgtactctattttatgtatcatatcctctgttttttaatattatgatgcatactataatgcctc

SEQ ID NO: 1493 - DNA, 1322 bp, Homo sapiens
tttgagaccagcctgaccaacatggagaaaccctgtttgtactgaaaatacaaaattagccaggcatggtggcacatgcctgtaattccagctactcggaaggctgaggcaggagaatcacttgaacctgggaggcgaaggttgcggtgagccaagatcacgccattgcactgcagcctgggcaaaaagagtgaaactgcgtctcaaaaaagaaaaagaaaaagaacattctgagtctgatcaaggtgtgtgatcttgggttgtggtggagagagccagggaagagtcagctgtgggagagagagaacgcaggctttaactctggaaaaatagaaatatgtcagtcattcggatttccaataactaaggcaacatgggtttggaggcttatttatatatggagttgcagattgtagacctaatggtgtgttctgctacatacttttccgtgagtatctctatgtccctaaattcaatttcactttctacctttgagaataatttttagagatttccaaaattacaaaatgtgagcatatgaattattctgtcatcacctcttacatctctcaatttttagagatttcccaaattacaaaatctgagcatgaattgtactaccatcacttctttttctttcatgaggtaatattatttgagagactaattttagatgtcaacagtttgtcttcctccgagaggagtttgggtttctttacgataaacatgcaattatcccatgatgactcgtatatattaaacagccatttaactgacatataagactcagaagaatggtaaagttggaagaggcactaaaattcatttagaacagcccaatcttgtcattttacaaacgcagaagcaaagccacaaattgattacgtttgtcccgagttctacaaccagtcagtggcagaatcagacatttcagtagctttagcgtgatgttacatttcaatttatgaaagatggaaatttaattttataattatgcaaggtttacagcaacatagcatgtatgttgacaactggtaggaaatggacatttatgaattatgaatgtttctattatgaagggcaattattaccttaagtagtagctggtaatgaacactgaatgcctactatgtgctttacatacaccacctcatttcaagtccccaataaagccataaagttgatattacaatctataaagtataaggtcagtacttcatatgtgaagaaacagaggcttagagagattatacacaacctgctaaggccacacagctagtatgtacagctgggcatagagccaggcccttgttctttttccc

SEQ ID NO: 1494 - DNA, 898 bp, Homo sapiens
ctcagccaccgatccccaggtccggagccacgtgcccacgtcctgacacctgattgtcctgtgctggtccctgcagatggcccagcctcgcagtctggactccacccctgcagaggaagcacaaccgatgtcacaggtgcaaagaccactcgggagctgggccacagcttcccatcctgtcccgtcagtgcctccctctcctaagcctggagacccttcacttcctctacctcctaacaactcctgttggagccattttgaatgcagccctaaggctttccttgtcagccaaatgggtgtcagaagccatctgtgcctgagctggtggcagctggtgggaaaatgcttgcatccatatgaatcgattttgttttgcctcctaagatcttcagttgagcaagaggagatttgctgaatttttcagaggttgcattaacctggggaaggcggaactgacagcccagcaaagggcaggaggaagaaagcctggacacagctagagagatccagccagtgtgaaggcctgtggcccgaggagggagccgtgaggtgtagcccaggccatgtccccaggcgaacagcagctcccaccaacccctgacgaggtcggcgctggggtggccctccacagaggtggcagagttggcttttggtgcctcacctgagctcagtgtcagcggatacggcaaagcccttctgaaaaacaaacatcgggcaatgattgtgcaacacagctgctaaaaatccttcatttctgggtaggaaagagtctctctgtgtcctttccattgaaagagcataagctcaacgaaggtgacagccccggaatgtggacaaatgggactgggaaaacgccatgtcttcattctctatccctcccccacctttcacacccagc

SEQ ID NO: 1495 - DNA, 866 bp, Homo sapiens
gcaattccattttggaaaatttatcctgaggaaataaataaagatgtaaacagagaataacttacagatgtgacgtttgtgatcgttaaaactggaaacagcgcaagagtggacgataggggatgagagagccacacagcgcatagaagatgatcagtctgaagagagggttttcagacatgcaattaactgctattcactgtacttcattttaactgcaaactagcagtctctttccccaggaaaaaagaggtcaactcggaggagccagggattcagcccactctggacaacactcagagccatggcacctacctgtatgaaaaaaaattgttaagcagctgccactcctagttactggcctctgctcggtgactgatgcacttctaacatccttgtcccaggataaagaccttgtaatggagaaaaaagatggcagggatcctttccatggaatttcggctgttgtctagtggaccttccaggaattgtctgattctatgggagtgcgcaactttgactgttcagttgggccaattggcaacactgtagagacggaaactaacttgtggagggctgagggtgatacagacattttctgtccgtggtaatgcaaaaggtgttcatagcaatgcaaatggattttatccaatgggggagataaatatttgaacgggctctcttgttaattactagttaatcaaaatatttgacatgtattcattctatatttataggggagtcatgattctacctttttggaaatgaccctctagcagttttattggtcctatgagatacacagtagattcaccagccagagccagatgagctgcacagttgccaaagggaacttcagatgccac

SEQ ID NO: 1496 - DNA, 447 bp, Homo sapiens
tgacaacctatgagcccttggtatatgctgcctgatgagagtctttgtatacttgaaaactgataaagacgtgacattacacaaaaattgataaacgacagaaaatcagccaacaaaaatgaaagtgtggcaaataaatgaaagtgtcaacaccgaaagtgaattcagatcggatcttgatggatttatagaagaaatagttaattgcgagaatgctgacacaactaccatccaagagatttcatatgtgcagtcaggggaacttatggaatacatatttacaacttaaatgaagaagctgattgcagggaaaagacgaaagttttcccagaagatgtgatgctgagaaaaaaaattacattgaagaaactctccaagatgtttaaagacaatgaacgcacaaacaataaaatgttggacaaataatcaaatttataaagaagtatg

SEQ ID NO: 1497 - DNA, 546 bp, Homo sapiens
gggagattcttcttagtaaccctcaccttttcttcccacttcatgcccagtatcaagctcccgtgctgctagagaaagtcctcagctagaaacaggtgcaaattctggagatgagaccttgtagagtgttaagaatggttttcttcccagcagctacagtgataaagacgtgacattacacaaaaattgataaacgacagaaaatcagccaacaaaaatgaaagtgtggcaaataaatgaaagtgtcaacaccgaaagtgaattcagatcggatcttgatggatttatagaagaaatagttaattgcgagaatgctgacacaactaccatccaagagatttcatatgtgcagtcaggggaacttatggaatacatatttacaacttaaatgaagaagctgattgcagggaaaagacgaaagttttcccagaagatgtgatgctgagaaaaaaaattacattgaagaaactctccaagatgtttaaagacaatgaacgcacaaacaataaaatgttggacaaataatcaaatttataaagaagtatg

SEQ ID NO: 1498 - DNA, 556 bp, Homo sapiens
aggtgaggccactgaaggtctgagggagaactgacttgtcaggaactcctgttaaggagaattaacaaagtgtggttattaaaggagaactgagttgggagtcagacctggaggactgcacccttggttaagacattataccaccttgagtctggcctgttgactgaagtgataaagacgtgacattacacaaaaattgataaacgacagaaaatcagccaacaaaaatgaaagtgtggcaaataaatgaaagtgtcaacaccgaaagtgaattcagatcggatcttgatggatttatagaagaaatagttaattgcgagaatgctgacacaactaccatccaagagatttcatatgtgcagtcaggggaacttatggaatacatatttacaacttaaatgaagaagctgattgcagggaaaagacgaaagttttcccagaagatgtgatgctgagaaaaaaaattacattgaagaaactctccaagatgtttaaagacaatgaacgcacaaacaataaaatgttggacaaataatcaaatttataaagaagtatg

SEQ ID NO: 1499 - DNA, 390 bp, Homo sapiens
gtttaccatgagtttcctgctgctagaagaaagtaaactccatgaagacaaggatgtcatgtttatgttcattttgatagcacctataataatatatcagcacctgttattcaacagaaggtcaacaaacatttgttgaatgaagaaaaaacaaaacaaaacaaaaaacccctctgcttttccccagaaaaagtcagcatcacatttccgccatctcatccactgcctcacagctttttccaggtcttaacttttacagagccattcacaagagatcaacagatataaggcattggtttctatttctttagaaaaaaaagaaaaatctgatacaacttcaccagccaacgtgatatttctggtttcttgaattatttggcaaagggaaag

SEQ ID NO: 1500 - DNA, 645 bp, Homo sapiens
caaacagctactctgggaaggtgatctctacggccaccggccacagggctccgtccctgagctcctcacgccgcagtagctaaagcacccttagctgcaaggaaaacacaggtgggaaaacagtttcttaatgaggaatatttgtaagctctgttggcgctcagcaggttgaagattgacaatgaaccacctaagggtgcagatttagcctcagggtgcagctcggatccctgggttcagcggaggtgggtgccgaagcccgaactgaattggcacgcaggtccctgcccagcgctgagccgcgcctcgggaaagactgaaagctgcccgtgccgctgagcatgcccagtttctgcctgagtccctggagggttgcaagattgggggttgatttggtctccaggtgccgtaggctgcgaggaagatgagacggccaaagatgagaaggccaaagattgcgagcgactagtacaaaagaaggaaagagtttgaaataggtgctgaacgtgtggagctatccatggttctgaatccgactcagcagttggcaactcttctctgcctacaaccaaccagggacaatagaactacaaactcagagtcttaacgaaacccaagttcaccttcctcccaaaatatatcaag

SEQ ID NO: 1501 - DNA, 751 bp, Homo sapiens
caaacagctactctgggaaggtgatctctacggccaccggccacagggctccgtccctgagctcctcacgccgcagtagctaaagcacccttagctgcaaggaaaacacaggtgggaaaacagtttcttaatgaggaatatttgtaagctctgttggcgctcagcaggttgaagattgacaatgaaccacctaagggtgcagatttagcctcagggtgcagctcggatccctgggttcagcggaggtgggtgccgaagcccgaactgaattggcacgcaggtccctgcccagcgctgagccgcgcctcgggaaagactgaaagctgcccgtgccgctgagcatgcccagtttctgcctgagtccctggagggttgcaagattgggggttgatttggtctccaggtgccgtaggctgcgaggaagatgagacggccaaagatgagaaggccaaagattgcgagcgactagtacaaaagaaggaaagagtttgaaataggtgctgaacgtgtggagctatccatggttctgaatccgactcagcagttggcaactcttctctgcctacaaccaaccagggacaatagaactacaaactcagatgtgaaaactaaaggtgaaaagggttaagaaacttaaccaagatttcatagctagcatgtggcagaactatgctggcaccacagagaaggagaaggaaagtgatggtggatataagaaacataagaaggagaggcgatgtgaaatacctgg

SEQ ID NO: 1502 - DNA, 672 bp, Homo sapiens
agtataatagctaaaatgtgtgcgttgtattggggatgttccagttcaatggaatactgggaagagaagaggaagattgcagtgatctgaggtgctgatgagaagtgaggaagtggattttcaaagccataatgatgaaggtttgttctttatccaaagcacccactgttggatcagaagggaaatatttgtggaaactgaaagaggaaatgctggtctgaattcaagagagagatcaattctggaagaaagtctcctcatgtcccaggagaatgagcagtcataaagatggagttttgctcttgttgcccaggctggagtgcaatggcgcaatcttggctcactgcaaactctgcctgccgggttcaacgaatcctcctccctcagcctcccgagtagctgggattacagcttccaggtggacagcatccaagcacggagacaagtgaaggtccccagccagggccacttcctggcgaatcagaaggtctcattgtgaagacttctgacggctgccgccccatcaggcattgatcctaagagcaccccctcataaatatatggcgtgctagtctccatctcagattctgcttctcggggaaactgtgacacattgtttatccttggtggacacatattaagagtgaaagcttcctatgtgctcaaatgttg

SEQ ID NO: 1503 - DNA, 675 bp, Homo sapiens
gatggagttttgctcttgttgcccaggctggagtgcaatggcgcaatcttggctcactgcaaactctgcctgccgggttcaacgaatcctcctccctcagcctcccgagtagctgggattacaggtaaggagtgagtccgtggagctccacagctgccattccagagcttccaggtggacagcatccaagcacggagacaagtgaaggtccccagccagggccacttcctggcgaatcagaaggtctcattgtgaagacttctgacggctgccgccccatcaggcattgatcctaagagcaccccctcataaatatatggcgtgctagtctccatctcagattctgcttctcggggaaactgtgacacattgtttatccttggtggacacatattaagtgtccatggaatctgaatatcattctggataccttccgctttgactacccagatctgcttgccactgacctctgtgctgctctctaggaggcaaactcccatggtttcccttgccctctggttgggttgacaaataggagattaacaggaggagaaaaagttccaaggctggactcaaaggaagcttaagacccatgctcactacatgcattcagaaaagatgccataggaaagtctctgtttcttatttgaggagtgggaaagaaatccctaacag

SEQ ID NO: 1504 - DNA, 392 bp, Homo sapiens
cagagccagattttggacctcaaattcattgaagaaaagtctgagtcaccaggcgaaagggctccacaaagccacagcaattgtacatggctatgattaactgccaagtcttttcccaaaggggccttcagcttccaggtggacagcatccaagcacggagacaagtgaaggtccccagccagggccacttcctggcgaatcagaaggtctcattgtgaagacttctgacggctgccgccccatcaggcattgatcctaagagcaccccctcataaatatatggcgtgctagtctccatctcagattctgcttctcggggaaactgtgacacattgtttatccttggtggacacatattaagagtgaaagcttcctatgtgctcaaatgttg

SEQ ID NO: 1505 - DNA, 565 bp, Homo sapiens
gctctgtctctgatctttctagccctccaaaaacttaccaaatgattacctagcagtgcgggcttccatcaccaagccaaatggattggtcccctcccttggccctgcagatgagactggtgctaagatgtcatgtaagctgtaataaacatgctcacggctagctctacagatagtaagaactcttaaaaaaatttccttttgttggcgaaagggaagcagtattttcctttctccatttctattatctaaaactatttcaaactttctcttctgcacataacctcagccatttttgcttatgccttcccatctgagaagcacagtctcagtacttcagcgtcttagaggtgatgaaagtcagccagcctgaactttgtttccctttatctactagactacttacatccgtaactcctttgcctttccagactcaatgaaataattttcttagtttgattctggttttctgacccttaccacctctggtgatactgcaatgaagaagcaagtgtaactgaattcctcttcccctaagaaaatacttcaactgaggacatgtagg

SEQ ID NO: 1506 - DNA, 961 bp, Homo sapiens
gtggaaaagaagtcagatagtcccttctctcacctcgctttctgtatgattagtgttacaaatggtatgtgtgtttggaggagaagagaagtagagtagaaggtgctatagatggaccctctaaaccagacttgggtgtatgaggaggcttccagtggggagagatgatgattcccaaatattgtgtaggtgatatctgggtgaaacaagtgtggagagtagtgattcaggcaggcatagagaatattgtttgcgacgagttgagagagcacttgtggatgtgaaagggaatcattttgactgtaagcataggtgcttttgagaggtaaaatctaaattacaaagagttttgtaagccatgctgagggttttagacttttttagagagcaatgggaaggcattttagggctttagatagtagagtgacatcagatttgcattagaaaagtataaagttgaatgtgatatgtacagattttgaccagttgaaagtgaggcttttgtgagtcatccaaatggggatgtgataattgatgggtttgaagggtagatgctcaggggagtcatcaccaacaaactgtaactgaagccgtgggaatggatctcatccagagagaaaagggcctgtggtaatacccttaaatactatcttcatttagaggacaagcagaagatggttagcctgaggacaagatttatgagagacgcagataggaaggagaaaatttggaatgtgaaatcctagaaggaattatgttttttttttaaaaaaaggaaccagtcaacaagtgtcaagttctgtggagaggttaagagccaaaatgtattcattggattttgtgacaaaggaggcagttgatatccttgatgaggatagttttggtgacgtggttggggtagcagccagaacatggcttttggaggttacaaagtagaaaatttggcaataaagtggaggag

SEQ ID NO: 1507 - DNA, 243 bp, Homo sapiens
tccactccagaccctgtttgcctgggtatcaacagcagaggcctcagaacatcaaagattgctgcctgcttcttcctctagatgccctgcccagtgaggaggaatctaaagaggaagtctggccacagtcgcttttctgtgctggggtgaattccacacagtctgaacttcccggttgcttccttaacactgtgtggggaaaaccgcctactcaagcctcagtaatggcagacttcccaaccc

SEQ ID NO: 1508 - DNA, 670 bp, Homo sapiens
cccctaatctctgctagcttctaaggtttctgctgacaattttgctattagcctaatggggcttccattataagtgaactgccatgtttctctagctgcctttagtattatagtatttctttcattttaaccttggagaatctgatgactatgtgtcttgcagattgttttctcacgtagtatcttgttctctgcatttccataatttgaatgttgattcaaatctaagtaagtttgggaaaattttcatggatgatattctgaagtacgttttccaagttgcttgttttctctacctgtctttcagggacgccagtgagtgacagacttggtttcttcacataatcacatatttctcagaagttttgtttgttacttttcattcttttttcctctgtccttttctgcctgtcttatttcggaaagatagtcttcaagctctgtaattcttacctctgttcagtgtattctggtattgatacctgtgactgtattgtgaatttcttgtgttgtgtttttcagctccatgaggtcagttatgctcctctctaaactggctcttctcgttatcagctcctgtattgctttaccatgattcttagtttccttgcattgggttacaatatgctcctttggctcagcaaagctcattattacccactttctgaag

SEQ ID NO: 1509 - DNA, 589 bp, Homo sapiens
gcccttttcagatggcaaaaggcctgagggtgaatctgggcgagctggttgagtccatgcgtttgtgcttcctctcagtccactttcgcttacgatggggcgactcttgtccatcgtcacctcaccgggaaacttttcctgccgggccagttaatggtcccctgtaccatccccatcctgagtgactactaagcagccgcagcgactcggggttgctccgtgaccacgttactcagttaaccttcttgttccctggagaggcggagctgaatggcccggacggggtttctccatgtttcccaggctggtctcaaactcctggactcaagcaatctgcccaccttgcctcccaaaatgctcctccaaaaaaggagtgtgccgccacacccagcctgagcaacttttgtttttaaggtaagcacctaaagataaacagtttggattttcatgaaggaagaaagtgaatactagaaattacagtctgataaatggatcatgagcaaaatgtcgagggtcctgttaacgaagccatgcagagaggcataattgtcccaagatccattcataccaagttagcctttcttatgtc

SEQ ID NO: 1510 - DNA, 638 bp, Homo sapiens
atctttgtgagattattcatgtaggtattctgaaggtcctgctagctataggatcttctgatcatggtgacttacacaagactcacatctctctacctctccacttgtctggtttggttacttgctaatattattgcctctgttttcttctctaacagatgctgcaacccaccgagaacaacattagactatactatgcccacattaattactttccccctcatcaccttagaaaatactttcatttttcagtattgtgtggacacctgtgagctggttattttgaaaaaggaaaaacccaaccaattaaaatggactgctctattaaagaacataacataatcagggcacatgagatggggtctcattatactgcccaaactggtcttgaactcctggcctcaagcaatcctcctgcctcggtctctcaaagcactgggattacaggtgtgagccaccatgtccagcctactttctttatatccttgttttataagctttttaaaaaaggtttttaaatgtttttgttaaaaactaagacacaaacacacacactagcctaggcccacactcagttgggatcatcaagacatcactaagccgtagtaatgtttcagctccgttataatcttctggga

SEQ ID NO: 1511 - DNA, 790 bp, Homo sapiens
acgtgacttgctctgccttgccttccatcatgattgtgaggactctccagccacatgcaactgattccatgctgctgctccgccatgcttcacaccaatcaataagaagtgtttccagctgtatctacgaaatgtctctccagaatcactgacaattcggttcacatcatatggcaattagataattttctgatgacttttaacttacctcctctcttttgacttctccctacaccatatcagtgtccaaagtgttgccaaaaccacttcgaaaatgcacatctgtttctgtctctcccttatattatgccttcaaatcatgacttcttaaaatgatataaggaatttttacagttgggtaaaaaattaagttggagcctcctttataattgttcctgtacatttgccatccctccagacttaaagaataaattgaagaactttgtacagaatattgactttcctgttgatgtgccatcatttagtacaggagaaacaactcagtgtatacctatctgcaaacttttctaatgataatttgtgcctatagtcctatactgatgtgaagtgtgaaaaaatatataccaggagaaacaaaggagaatggcaccatataattggtagattttcatcccatagtttattttcgtatttgcctgcaaggtcttttttcatacactaaatcaagccctgcctgttttgaaatcatcatcgacaccccttcaaagcacagacaaattttgagaattgtcagactaataatgttgactcttcaaatgtatgaacaagg

SEQ ID NO: 1512 - DNA, 1222 bp, Homo sapiens
gccatttttgctgctttgcagccctcattcctgttgcccttgggccagggagggagcacagtgattagggacaacgtggacccccagaagagggcagcagacttgcaggaaagcggccagactattttccagttaaaggaacatcggcccacacagatgagaaagaatcagtgcaagaactctggcaactcaaaaaaaaacagagtgtcttctttcctccaaaggaccataccagttccccagcaagcattcttaaccaggatgaaatggctgaaatgacaaatataattcagaatatggacaggaacaaagatcattgagtttcagaagaaagtcaaaaccccacccaagtaatctaaggcttacaatacaacgatacaggagtcacaaggcaaaatgactatcataagaagacccaaactgatctgatagagctggaaaaaacactacaagaatttcataatacaatcacaagtattaatgacagaatagaccaagctgaggaaagactctcagagttcaaagactggatctctgaactaactcaataagacaaaaataaagaaaaaaataataaaaaagaatgaacaaagcctccgagacatatgggattatgtaaagagacaaaatgtacaactcattggcatctctgaaagagagagggagaaagcaagcaacttggaaaagatatctcaggatatcattcaaaattcccccaaactcattagagaggctggcattcaaattcaagaatgtaaagaacccctgcaagatactgctcaagaagaccatccctaagacacacagtcatcagattatccaaagtcaaaacaaaggaaaaaatgttaaaggcagctggagagaagggacagttcatctacaaagggaaccccatcaagctaacagcaaacctttcagtagaaaccctacaagccagaagagattagcggcctatattcagcattcttgaaggaaagaaattccaaccaagaatctcatatccagccaaactaagcttcataagcaaacaagaaataagatccttttcagacaagcaaatgctaagggagtttgttaccagcagacctgccttacaagaggtcctgtagggaatgctaaatatggaaaggaaagactgttactggccactacaaaaacatacttaactacatagaccattgacactacaaagcaaccacacaaacaagtcttcataataagc

SEQ ID NO: 1513 - DNA, 2963 bp, Homo sapiens
tcctctttatttttctattttatgatgaaaacaattccttttcagaagtacattcccgggctggttgattggtaagctttcatctgctgagaagattcagaaatcttttccgatttcaggctgaaattagaaccaatttcttgtcttccagctcttattgtgggcctttattctgcaaagaaggctgcagtgccagcggagctgactgccagtgccaagtgtgtgactgacataacgtatggaggaaaccaggaagagaaagaataatgcagatttgaagatggaaaaaaatgcagtttttatagaattatgggaagtaaaagtggagaggatcttagaaacattctagttgtggcttctcaaactttaaaatatattctgatcacctggggatctgattgggatgaagattctgattcagaggcttggggtgggtcctgaattctacatttctaatcagctcccagctgatgtaaatgctgcttgtccagggatgtggtgggcagaataatggcccctcaaagacgtccatggccttatcccctggaacctgttaacatgttaggttacatggcaaactgaatttgcagatggaattgaggttgctaattagctgaccttcaaatggggagatcatcccggattatctcagtgggtccagtataatcacaagggtccttataatttgatggagatggaagagagtcaatgggacagtgatgcaatgagagaaaggcttggccagcctctccgggtttgaagatgaaagggggccacgaaccaaggaatgcaggcagcttctaacagctagaaaatgcaaggaagagtattctccccagggctccagaaccagtaccttgagttcagcccaatgagacccattcggacttctgacctccagaactagaagataatcaatgtgtgttgttttaagctgctgaagttgtggcagtttgttacagcagcaactggaaatgaatgcaatggaccacactttgagaaacaaaggcctacacttctcttcctccctccttataaggagatgtctttccctatcccaccaactattaccttttaaaaaaatataccttccagatggcaaccctctccacaaaggtttgggggaattctagccattcactcattcaagccacattttgtgagggaaagtgaaatgaatctcacacaatctttgcatccaacgagctgacaaaagagtaaggaaaataaggcaaagtcataaataactagcacatcattctggtaacaacgttctctctgaatcttacctgctccctattctttctttcattaacccagacaggttcccctatctttcacctggactctggaaaaggcctcctaatgggattctctggcttggtttctcctctctccaatctgtcttaaaacagtcattgcacaattaatctccccaaagtgctgagcgtgttcactgatagagggaaggagatggcagtgagaaagaattagaagaggggaagagaggagataaattatgaaacaagcttccactggaaataagagaaacgtcatcaaaacccatgtggaatggaagggaggttcttctgtttttctaagaattcagagaaaggagaaaaggagaagtgagagtgaagacataataaaaatttcagattgtgaaggggaaaatttatggaaaccattcctctgcgtgagagttttagaattcgctttggggcttaaaaagtggagaaaggtttagagctgcccttatggaaatgagataggaaatgaccttgatgaatgatggaatgctgagcaggcctgtgggtccatggtgctggactgcacagatctgttacggtgccgatcggcatggctttccccagcaattctcaacaagccagaagcaggagcaaagcaatcatccatagttacaaactgaactgtaagaaatgtagtggtagattttagggctcagaaacataggggctgagtatcactaaggtgtctgatgaaggcatctgtggtctatgaagggggaggatgaattggaacactagagaaaggctaagggacaagaaagaacagatgttaaagagaattagaagatgagagaggtcaatgataaggacatgctcagagaagggatgttagacattgccagtatgtggtcccagtgctgcttgctggtgtgtaagtataaccccttttctgcagtccagccctttgctttttaaaaagaactaaagtgttctccacaattccatctttatagagtaaacgtgctcttctgcaatttttcataagctgtgcctcctaagtttttactatctgatcaagctcacctgagcatatcctgttaaaatatgttgctataagagaagcacattgctccagaagtggttggattagagcagaggactgtgagacctgcacctgccttggttgggccccgtttatccattaagggagtctaaggtggcatcagcaattttaggagccacattaattaatcactaggtcaaatgcaggttacttgctactgactctccttccgttgagtttgagacaagtgtccccgggcctttacttgtgcaatgactagaacacaaaggtaggattttatattcatctttcttaaatttcaatatgtaagttctgacatatcactccagccaactgttatgttttagaaccttgcattttgccccatgataaacaggaatgtttcagccattccttccaattttgtatcattttaaaaatcagttgacatcctctatatcttagatttgttatttgaattttgtgtaggccatggccaagtacagaggctagagtattaccataaaaacttccctcaaagttgaaattaatcttttaatacctggttcattcatttcttcagtcagtcacaatgcacagactcagaagctggactgcagcagtgacagatgcattggggtttatagtct

SEQ ID NO: 1514 - DNA, 773 bp, Homo sapiens
attagatagttttgccatcaactttctgatgaaccttcataatttgaaggcaggaaaatctaactacaatagtcctcccatattcacagtttcagtaacccatggtcaactgcggtccaaacatagcaaacagaaaattccagaaataaacaactcattaagttttcagtttcatactgttctgagtaatgtgatgaaatcttgtgccatctcactctgtcctacccaggatgtggtcatgccttcgtccagagtatccatgccatatacgatacctgcccactcgtcactttagtggctgtcttggtgatcagagtgagtgtcatcgcatctcatcatgcaggcattttatcatctcacatcatcacaggattactgcagctgctactgagaatactagagtactgcatggtgcaaaggtaagtgatcattaaagcactgtacggtcttcaaatgttttcatcagcatttaaattatgatcagtgggttttagagttaaatgcagtttagtataattggattcacagaatatggattaaatgggtatggtatgtgtaatgtgatgctattgaccagaacatttcattgaacaagatggcctatttcctgattatgttagaaaacagatcacctattccatacagatctgcatgtaagagtatttaggttgtaatgagacaacagcacaagctactgtcatgtacccacccagcacaagccatgggtgggtatatgacttgtaaaggtgctgacactatagattagaaaggtg

SEQ ID NO: 1515 - DNA, 2301 bp, Homo sapiens
cttttcagaagtacattcccgggctggttgattggtaagctttcatctgctgagaagattcagaaatcttttccgatttcaggctgaaattagaaccaatttcttgtcttccagctcttattgtgggcctttattctgcaaagaaggctgcagtgccagcggagctgactgccagtgccaagtgtgtgactgacataacgtatggaggtaattgcagcaaagcacatcatctgatcttgagaacccagcagccattcagaggagctccaacctacatcctcgtgccattccccacctcccgccactgtcagtggctttgagcagctccaatccatctacaccctctggcaatggcagcctcttaacagaagagctcagtctgtgccctttgacaagtttcttcaccaccacaaggctgcacgttcctctggtagccacacaccttcttcgatcaggtcagaatctcagtcttggcttgggggcctcccctaggccttagttcctttattgtctcattttcttcagtacagatatagtaactgctctcatgctaaatgtggacaccttatggtcctcttttaccccttctagtagttagtaacctcctactgttttaattaacaatgctttacattacatttctcctattcaaataaccagtatggttcttatctcctgacttgatcttgactgatacacatggccagtatgagggcccaaacagagaccagcatagctaaagtagagagggcaagaacgaatgtgccatgcaaggagggtggagtgggacacaggggccagactatgctgggcttgcaggacagggtaagtcttcttgtctttatcgtaagaggtcagatttgtgttttgaaaagattacaggatagagaatgatttacaaaggaacaagggtaagtgctaggagattaatgagtggactattgctgcagtgcaggcaagtgaggatggtagttttggtgggaaggcaggggaagagacagcaatgaatgaattctagaaatacatggaaatgaaaaccaacaggaaatggggatagactggaaatggggagtgagaaagagggagatgtcatgactgatgactagatttctggtttgcacaattggataggtggtgcactaggatcgggaacactaaaagagagccacgactgggaagggagatgatgagtttgttttgagcatgttgttgaagtgctttgaaatatcaaggtgaaaaagtcaaagaagagtctggagttcagagtgtagccagaactaggaagatgagtttgtgagtcatcttacataattaaagctagagtatggctgaaataatctaaggacagtgtgtagctttatatgatgaaggacctgagatcaaacaagccctagggagcttcagcaatttaacagccaggtaaggaagaatgacctccaaagggaacagagaggaagcagtaaagacagagggacacaatcaggagagtgtcatgtcatagaaaccacagggaaacgatagagttaaggatagggtggttaacaatgctgaatactgctaaagggaaaaaataaagattaaaaaacaatggctagattcaataatatggaggccattgctaaacttacctataacagcttacctagagcagtttatttggagagatggggctgaaagccgtaacaatgaggtgatgagtgagagggaggtgaagagtggagacagggagtaaaggtaactctctgaagatgttacagaataatggtctagtgatgaagcctcaagaaaactcctttttttttttgtttttgagacacggtctcgctgtcacccaggctggagtgcaatggtgtgatcacggctcactgtggcctcgacccccagctcaagtgatcctcccacctcagcctcccaagcagctgggactacaggcatttgctaccctgctcagctaatttttgtattttttgtagagatggggtttgccatgttgcccaggctaagaaaaccattctctcataattattatatactttgatttgcaagtttcatcattcttctatctttacatgacagggtaataaacaaaaatttggggaaacaataactttggaacagagaccaaaatagacaggtttatgcagcagacacaatgtcagttctgccttctcataatgtctttatcaaatacagatatactttattatttcattcaaatcctatgaagcttgatgagctcagagggcataaaggtggtaactttctgactggaataacatctttagttttatttacattcac

SEQ ID NO: 1516 - DNA, 2868 bp, Homo sapiens
cccgcgtttactatccttcaatttgttcatatgacctgatttttcatggatgctggacaagagctcaggatacagaaaagtgtcacattgaccctctgccttcatgaaaaagtagaaggtctattgagctgttaaatacttaagccgtccttggactgcaaagctaaaagagcattgtaacgcatgccctctggggctccaggggtcatgggtactaccctaggcactgctgtgggactgcatggagttttgatcctgccggtggccaaaagtgcttgctctagctcctgcacctgctcacctgcatgctctccctcccccgaggggttcagagcttcaggctgagaaagtgaggcacccctgttgcaaggcctgtgaaggggtcaaggaaaatttcctgttcaaaaccatgcataggaattctaattacgtaagtgaagaaaaagtaaaattctgtaacttttcttctctaaagtagcttttctaatttattccaaaacaaatatctttatagttcagaaatattatcttggacaaatataggggtgaagtgtatctggcaggtcttggtggcatgcagaaataaggtgtattttcacagaggtaattcattgtttttctaaactttctgcagttataagcaaagaaaatttgaagcctctattaaaaaatcattccttcaacacatcactgaccaggaacgtaaatggatgagcagtaaggacgcaatggattaagctcctttacaagggaaagatttctgaactcctcaaggtaattgcagcaaagcacatcatctgatcttgagaacccagcagccattcagaggagctccaacctacatcctcgtgccattccccacctcccgccactgtcagtggctttgagcagctccaatccatctacaccctctggcaatggcagcctcttaacagaagagctcagtctgtgccctttgacaagtttcttcaccaccacaaggctgcacgttcctctggtagccacacaccttcttcgatcaggtcagaatctcagtcttggcttgggggcctcccctaggccttagttcctttattgtctcattttcttcagtacagatatagtaactgctctcatgctaaatgtggacaccttatggtcctcttttaccccttctagtagttagtaacctcctactgttttaattaacaatgctttacattacatttctcctattcaaataaccagtatggttcttatctcctgacttgatcttgactgatacacatggccagtatgagggcccaaacagagaccagcatagctaaagtagagagggcaagaacgaatgtgccatgcaaggagggtggagtgggacacaggggccagactatgctgggcttgcaggacagggtaagtcttcttgtctttatcgtaagaggtcagatttgtgttttgaaaagattacaggatagagaatgatttacaaaggaacaagggtaagtgctaggagattaatgagtggactattgctgcagtgcaggcaagtgaggatggtagttttggtgggaaggcaggggaagagacagcaatgaatgaattctagaaatacatggaaatgaaaaccaacaggaaatggggatagactggaaatggggagtgagaaagagggagatgtcatgactgatgactagatttctggtttgcacaattggataggtggtgcactaggatcgggaacactaaaagagagccacgactgggaagggagatgatgagtttgttttgagcatgttgttgaagtgctttgaaatatcaaggtgaaaaagtcaaagaagagtctggagttcagagtgtagccagaactaggaagatgagtttgtgagtcatcttacataattaaagctagagtatggctgaaataatctaaggacagtgtgtagctttatatgatgaaggacctgagatcaaacaagccctagggagcttcagcaatttaacagccaggtaaggaagaatgacctccaaagggaacagagaggaagcagtaaagacagagggacacaatcaggagagtgtcatgtcatagaaaccacagggaaacgatagagttaaggatagggtggttaacaatgctgaatactgctaaagggaaaaaataaagattaaaaaacaatggctagattcaataatatggaggccattgctaaacttacctataacagcttacctagagcagtttatttggagagatggggctgaaagccgtaacaatgaggtgatgagtgagagggaggtgaagagtggagacagggagtaaaggtaactctctgaagatgttacagaataatggtctagtgatgaagcctcaagaaaactcctttttttttttgtttttgagacacggtctcgctgtcacccaggctggagtgcaatggtgtgatcacggctcactgtggcctcgacccccagctcaagtgatcctcccacctcagcctcccaagcagctgggactacaggcatttgctaccctgctcagctaatttttgtattttttgtagagatggggtttgccatgttgcccaggctaagaaaaccattctctcataattattatatactttgatttgcaagtttcatcattcttctatctttacatgacagggtaataaacaaaaatttggggaaacaataactttggaacagagaccaaaatagacaggtttatgcagcagacacaatgtcagttctgccttctcataatgtctttatcaaatacagatatactttattatttcattcaaatcctatgaagcttgatgagctcagagggcataaaggtggtaactttctgactggaataacatctttagttttatttacattcac

SEQ ID NO: 1517 - DNA, 2326 bp, Homo sapiens
gtgggtatcaataaaagaaactagccaggtgtcaaatgcagcatattttaatttgtttcaaataaagcaatatatgtatatatattttttcagaaaaacaccagatgttaaattctacaaaagcgcatgtgtcctcagcagatcatgtttgtctgattattaagaattcttttttgtaacattaactctctaaagacaatcaatggactgacatcactgctacaacacaggttgctaactgagcctctgatcttcagccacatcttgattttcctaataatgagtaaatactgcctggctaaaatgctgcaaagtcttgatgagagaaagcatcaacagatcaagcaaagccatgaaaattatgaagcaagctagagctgattattagaattagtaaaaatgattaagagaggatgacacaaccatacgggatttgtatattctgattgacactcttttggcagcgaattgggtcagcacctcgggcagggaaccaaaactgagtgaaaactgctctttttcctcctagctcaggccaccaacgtcacagccgggactgagagaactgctgcatctgtggaaacttctattctcgtggggcagagattgcactgtgaaaccctaccgacactaccccggaagggcctggcctccgaggtgtctgcagcgtgctgccttcgccggggcttttcagaatgggccggggcctcgggggtcttcatccccaaggaagcctcttgatttttggcaccgcctttgtttttgggccggaagccgttgtgcggctgtcttctgtgttcgtggcggctgttgccctttcccagtggctcggcttcattcccactgccctgcgacttggcaggcccatttagcctgttgttatgatactgtggattaaatctccgtctttggttagaagatccattctaccaaaaaagaaaagagataagtatcagatgccagcaagccactgatgacaccagtagacatcaggaaaaccaaatctctaagccacagttataagcaaagaaaatttgaagcctctattaaaaaatcattccttcaacacatcactgaccaggaacgtaaatggatgagcagtaaggacgcaatggattaagctcctttacaagggaaagatttctgaactcctcaaggtcagtaatagccaacactcattgagtgcttaccatgcactgaatggggtttctcaccatgcactacctcatttaacatcagaatcaccctttaagttagttgctattatgtgcttcgttttatagatgaggataaggagtttcagggacttgcccaaggtctatctacagttgggaaatggtggagctattcccgctttatatactatctcctgacaagactcttaagttgtaacataaacataaaccttttttgaaaatcaaacctcttaagaaaacatgaaattttatgagttacaaatatataaggttcttcatttgtgcactgtgactggatggtataggtttagggcagaccaacccccaataattcagagcctagagcaagagtacaaatgtaggtccatacatctgttaaaggaaaataaatcttggggcccccaaatcactaagctgaagggaaaagtcaagctgggaactgcttagggcaaacctggctcccattctattcaaagtcacccctctgctcactgagataaatgcatatctgactgtctcatttggagaggctaatcagaaactcaaaagaatacaaccatctgtcttttatctgcctaagacctggaagccccctcctcgctcccagttgtccgcctttgcctccagtagtcccacctttctggactgaactgatattcaccttacacaaatggattgatgtctcatgtctccctaaaatgtacaaaaccaagctgtgccccaccaccttgggcacatgtcatcagaccttctgaggctgtgtcacgggtgcacgtcctcaaccttggcaaaataaactttctaagttatctgagacctgtctcagatttttggggttcacacaccatatgtctgaatactgtcttttcctatctctggctccatcccacattgtaaggggccttgcacacacaaatgtggacattccagcctgcacacctaagcatcgcctccactcccacccttccagcggatgggtgtgaaaactggcagtgttgttcatcttcaagatgatgtatacaggaaagtggtccaggcagatcctgtgagcaggcttgggcccacttgggaagagtaacccaggatctcgagtactgactggcagcatgcttcagaacaaagagtgtaga

SEQ ID NO: 1518 - DNA, 545 bp, Homo sapiens
ctgtgccacattctacctgcatcatcacaacctcaccagcattgagcattgcctcaaataataacccaaatacccctccacatacaaatcttttgttaatctgatagttaagtttgaatgctttgtcatgcctcagccatctttagacttgttttctgtctttatactttttacaaaataggtttctgtagggattaactctgaatgaactttttttgagacggagttttgctcttgttgcccaggctggagtgcaggggcgcgatctcagctcactgcaccctccgcctcccgggtttcaagcaattctcctgcctcagccaggtgcccgccaccacacccagttaattttttgtatttttagtagagatggggtttcaccatgttggccaggcctgtgttgaactcctgacctcaggtgatccgcccgcctcagcctcccaaagtgctgggattacaggcaggagccaccatgcctggcctacagtgctgtattttcttgctctggtgtctgctggtattgcagacctctactctgttgactg

SEQ ID NO: 1519 - DNA, 991 bp, Homo sapiens
tctgtcacctaggctggagtacagtggtgcgatctcggcacactgcaacctccacctcccagacattctcctgcctcagcctctcaactagctgggattacattcgcccgcctccacacccactaatttttgtatttttagtagagatgcggtttccccatgttggccaggctgttcttgaactcctgacctcaagttatacgcccactttggactcccaaagtgctgggattacaggtgtgagccacggcaccagccaaaaatttctttaaatattagtggtatattattctctcaataagttttttttttttttttttttgagacagtcttgttttattgcctaagctggagtgcagtggcacaatctcaactcactgcaacctccacctcccaggtttattttttttctcatgcctcagcctcccaagaagctgggattacaggcatgtgccccaaaggccagttaagttttctttttctttttttcttttttcttggttgagacggattttcgctcgtcacccacactggagtgcaatggcgcgatctcggctcactgcaacctccgactcttgggttcaagcgattctcctgcctcagcctcccgagtagctgggattagaggcacctgtcaccacgcccgctacttttggtatttttagtagagatggagtttcaccacgttggccaggctgatctcaaactcctggcctcaagtgattcacctgccttggcctcccaaagtgctggaattacaggcccggcctatttttgcaataattatgaatagcacaccatttaaacctgttgattgagccctccttaaataactaaatacactactggccaacatggtgaaaacctgtctccactaaaaacacaaaaaaatggccgggcacagtggctcatgcctgtaatcccagcacttcaggaggccaaggggtgtgaatcacctgaggtcaggagttcaagaccagcctggccaaca

SEQ ID NO: 1520 - DNA, 2835 bp, Homo sapiens
ctatcatctatcacttttcctaaggatctttagttgtttactttttaatgaagtataatatacgttatgatagtgtattttatgtatcctcatatcctttcactgtggatttaatttttagaaataacaaaaagtcacatagggcaaattcattaagctgagtgggtgattaagttaacaatagtaatgaccatgtattaagtgcctactatgtgccaggcactgtgctagcatttcacacccattatatcattcagtcttcacacccctgtttggtggttattaatgattactaatattcattttatagatgaataaactgatactcaaggccttaattgcctttcctaggggtgcacaactagaaaaaaggcagagccagatctgcacccaagtccttctgaccccagagctcatgcttgtatcatcgcaccagtgttactcaagctttcctggtgattacagtcacatgtacttgacaaaaccacaaactgttgggcctgtcccagtgatactgaatcgaaatttactgaggagggacctgggagattacactgcttgaacagcatggtaccggggaaccagagatcaacttcaacccttctgttagctcttagtgggctggtcagctggatgtagaagctaaattgacagcaggcagattaacaagagaaaaatgtataaattttactagttttacatgtacttggggatcttcacaagaaagtgaagtctgaacaagaggccaaagtaagatattcttatactttttagacaaagaatgataaatttgagaagaaacaacaggagaaagaaaatctggctaggacagtaaaattttctaggggagtcacaggagatatatgagggggtgtaaagcaagtggaagataaaggttattttgttcgtaagtttgtttattcgggttccttgcagcctccaagtctctggtgataagggctattttctcatcctggtatggataaatctcagggccttcgaagagtatccgtcccagaggattctttatcccttgctccatacaggaagatatagatcagctcttcctttctgaaactagaatttctccattgttttccattagaaataatcaacatacaaattttgggatggcacatccttcagtcctccaatggtatctaccatatttttttcaaacatataacatactttaaggtaatgagattaggtcgtgcagctcacaaatagctctgaaggcagttcctatagcagagactcaattgttatgagcattagctattggcatgacagaataggcttcaaagtgacttctttgaaggacaagatttatttgaatgttctgctttagaatcattaaaatgagcaccctcactgccatgttggctctacgcacagtaagattagagagacagcgttttacagtgaaaagagtaagtcaaccctggtttgggatctggataaattgcttaacttctcagagccttagtttcttcatctgtaaaatggattactacccaatttgaaggactattgtatacattagaaataactatatatgccttgtcatgtagtagatgcttatagcagttcttataataataaagcgaagtccccgtggtgtattgtaaatgtgaaccacactcctcagcagtgatccttgtgtgctaagctagtggaccagagtttccagctgaagtagatctggaaccgagtcttgaaaaatgtgtgtagagaagcttctgtacttttcttatgtggatggcagtggcgagggggcggtggcgggtgcagctgcaatacttaaaaaggaattctattgtggcaataaatgaatatggcaagaaatgagcctggcaagaaatgaatgacaatggcccctaggtggtgctgaatcatcatggaagtggaggctggacacttggcatttgcggaggtgacttccttctggtttgaatttcaaataagagcaggacagctccttgggatgtctgggaaaaaagaccaggcagaaaagagtcttttcactaggagcgggtgcaaaatactcttgcctgtgaggcctcttcaggtcttcggtttgctttagttggaaacaggaagcagggtcagaccaacttgtattcatttgctgagagctgttggagctgtgactgattctgacagatcaaataccatttataacactcctgtgggggacactttaaccggggatgttagtgctagcccctccagagactaagtatgtttgcgggatgtgaggacccctggaatatacaaatatgcatgctaatgaattttaacaaaaataacccattattgttttctgtgcaacactgtgcatttctcagctacacctgtcctttccaacctcaattgctgggcaacctatttttctttcggcatcagaagcgatagcatctgggaagtgaatctgatgaattctgcctggcaaccaacatctttccaactgccagatcctgggataagaactaactcagaaggcagttccagaagaaaagtgcatccaaatattttgaacaatgacagcatcatgggaataagtgtacggcatgtctcccgggaagagtatttgaagcccaaaccaacagataccacataaaatacaacaatagccactatcttttaagcattttcctcaaaggttgattaaatgaaacacttcaactttggggtaagtattattaatgcccactttatagatgaaaaaattcagacttagacttatcagccatgtggctttgagcaagtaatttaaatttttagatttgattccagagccatatatcatatatgatataactttgtaccaac

SEQ ID NO: 1521 - DNA, 1696 bp, Homo sapiens
gttatttaaaacaataatatcaaaaagtctcctcaaaataaaacacatccatattttaacataattgcaatttggtcatattggttatagtataaacataatattgatttagaaggacacatttttcagatcttaggaaaattacaggtaacaaattcatcattcctccatctccctcttcccttcttggttacactgtatgtatctttatcacttcactatttataaagtgatctatcaatgaacaacatcttttaaatcactgtccttgcttcattctttttcctaacattttcttgctagttggtatccatcattcttacccacatttggggagatagaaaagtttttgtattcctcattttgttgtacctatccacctaatgccttaaaaatcaaattattaacatgcaggataagtcacctaatcatgagaattagcagctttttggtttaattataatcataaacttttcttctgaatcaatgttcacgtattcaatcatttatcttcagaaatgtcttcttatatcaaaaattcaaatctgagactttatctcctttcacattttacaatgtctgaacttctttataatctattttagactctaacaactttgtaaatatattacttgtcattgttctctacttttaagtttgaatgtgatatcactctttatagaaggctccaagcaaatctgagaataagttttgaattgatttagttactttttacgtgcatttatttccaaatgcacactaaaatattagaaagatggtggttatacaaattagatctctttcgtcacacattttcttctaaatgtatattttcaagtgtcttagtaatttcttgcagctgaaatagagaagctgatatttttattaaatagttttcagaaaacctcaatctctttatctctaccactgctctttggctttctctaaacatacacctgtatgcaccataaatatatttattgtgaatatgaaagttcctcaaggttcctgcgtgtttatatctaacatcactgatctataaggcatatattaaactttagtgcttctttagtaataatgatgcgcttgtaccaccacctatccacactctcacacaatcaccccttttgaagtaaagcctatattttaaaaataaccattacagattgtgagtgcagtctaggatcacatagcagaactaaaagctaactggcccacccacaaagtaaatgtgagacagagggctcggggtagccatactctagccaagtagtactgacagataccaatagatataatcaaatgttacacatttgtgtttgcaaacgggataaatattttcctgaccaatctatacttttgatgattcaagctacaggataagttttaaaaatgtcttttgcacttatctacattacttaatagtatcttcttgtcatagacaactgttttacaccattttagtaggaaatcaatttgtcattcaattccattttctaatgcagtagtccaacccaacccagaatgcattattgatatggaaatgagtgtaattagcagcgtaaatgatctgttatttatgatacaagtcagagcagtaaatcaccattggctcactatcattactatgcaaatagaagaaagcagttaatggtccatgtgtttaaaacaggccacttgcttgctcatttgcaaa

SEQ ID NO: 1522 - DNA, 3769 bp, Homo sapiens
gccagcaaaagagacgtggggttttattgagggcttacatacaggggagggagtccagaggtggcgggctggatagaattgtcttacatacagaaatggtcctgtggtgttgggctggacaacatatccgcatggcccggtggtggcaggctgggcaggaaaaccacaactgcctgcaaacatcatgcagtttatacagcattttcacttaacccctttccctaatgagcgacacctggcaactgtcatttaacccaaaacttaaggcctcaatcctctctacagcctgggtttcatgggatgggccaggggctcagatgtctattatagataagaaacgaatctccgattggccactcccggattttctagctcgaaacacacattcaggagcatctgccatatagggtcattataaaggtgtgcttaagttattgctatcaggtgcatttaccctacaccgggtaagacactgaccacatggactctttcttcataatgtgcaagaattcatgaataaaaggacacaaagacatacaatatctaataacagtgaacatttatagaatacttgcagcttgtttcatattcacattctcaataaatgcagacagatgatgtcttcacaatttagtagtctgaccctttccacctatataacatggacaaatgtttatcacctcctaacacagcaagaacatctagcacacatatccgcacacacacacttatagaaagaaggggactaaaatgattgagtcccatatttcaggtgctgttctaggcatctgacagatataaaacacactccccaaagtcctgctcatgtgtctgtgtctagttcaatcccctccctccccttttacccttgccttaccaccccttgtaccacatgtatcttccttttaactccacacatttattctctggagatataataatctcagtggctgtcatgggttgaattatgatcccccaaaaagctgtgttgaagtcccaaccctcagtactactgaatgtgaccttactaggaaatacagtctttcctaatgtaattggttgataagctcagatgagtggggtgggctccttatacgactggtgtcttataagaagatgccctaggaaagcaatacagtggcctaggaagggaatgtgtgcgtgtatgcatgtgcactggacactgggattatgccttgtgtgtggaataacaatgtatatgtgtatgtgtgtgagagagggtttgagtctgtgtgcccatgcattatgcatgagaagccaagggatgatttttgcccatttaccatcacacacatgtatactcttcagtcctgaaattctgagtgtcctctctgcctggaccattaattagaatcatgtatttcccctgcctccctttgccagtgggcagaaggcagtttctgagcagtgattaagcctctatcaggacactaatgcaagtggcccataaaaggcatctaaccctgacactgttggaggatccaggacccagggagttggaaagagggaaggaaaatctttaaaagagggagccaggtgaagcgacacactgcaatgtgactgacctgctgagattccaagacctgaaacacaaacatacatgtgcacgcacacctcctcccatctagaacccaactgtttttgacttctgttctcttagcgggcttcccattcctcctatgcccccaacattatctgagaggcagctgtctgttttgtaggagaaaagagatagtctgtttgagtgatgcacactggatcacagagcaagttatggacaaagatggaactgtctctgagtgtcattacttaacttgctaatccacatagggctgggggtatccactcataaaaagcagggcaggacattttaaagccagacaggggctgtgtagagaaggaagaaaaatagaattgcagggactgataatggaagtatttactgtacacttactatacaccaaacattttatgtggttcatgctcatttaatcctgacagccctgaaagttaggttaacataaaccctatttgacaggtgcagaaactgagactgagaatagtcaagcaacttggctgaggtcacaaagccaggatatagtggcaggttttgaaagaggcagtttgattccaggctcggctctgataatattaagcgggcattaaaaagcaggcttctgggagatggaaaaggagtggtggaatcatcaaatggcatggatgttgtacataactgaagccctggattacagaattaaaattccatgtctgtactcctccctcccgctccagctccacagttggcgtgggccagcccaaggctactggtggtgggaggaatagcttcatgtcctcaaagcactcacctaaattctggtgtagggagagcttaaagtctgtggaagagacccagcatgcctttccaagtaggtcctgggttagaaagatctgggaggcctgtgtgttaaaagagatggcaggaaatgattcagctctatatctgtaaaatctctgacaatgacaggatgtgaggaatgacaggaggatcaggagggctgggcgggggtgactgaaatgtactgaccctggctgcaaactaaaaataaaatcctaagtcccctccaccaactgaatagaaacgctcttggcaaagaggaccccagaaaaaccttagaaactgagttcccagccatgacaggacaagaggtcagacacacctcattatactcccctcccttttatggtttagacacaaccaaccagcattaatgtcaaaatagaggtcataagactgaccaaacacactctttgtggcaacaagataccaaattacaaacaggacctaaggccatgccaaacaagggttaagtcatgcagccctacacttaaaagaataaactatgttctaactgccacaagttttccttttctctagcagctaaataagcactggcctctaaataaacaatactaaaacacttgcagctccaccagatgctgactaactgaactccaccagccataactacagctttgattggacaagagtgatttcggtaattttctcctggtaaggagcccaccgaccatgactggttctagcgggtttacagagattgcatacttgagtgccttcatgtcctgaatagaccttttgatgtatagggcctgattgcaatatttaaatattaagtctccaccccaaggtgaacatttaacgtatctggcaaagatgggattctgaagcagcccctgaattccttttcctgtgtcacccaggacaccaggtacagccaaggtccctttgaaaaagtccagttgttcctgactatgctgggaaaggatctgggtaagtgctatcaaaatccaagatctcccacttttaggttgcagacttgatttcttcttttaggcctcctccatctgtggaactccggaggagaccctcctgctggccttgggtttgggagggcattcctagttcttctcagtcctttctgttctcctccctggaccccggagggaacatctctcctagccttgggtttggaggaggccttcctgattccctccatccaagggccctggagaaaatgcatttgtgggctccgggcttatggagaggcattcaggttggattcaactggttcataaggtttgtggggatgctcacactaagggcactggaagagatatcttcataaagtcagtgcaataggtaacttacccactaggggcaggaactcct

SEQ ID NO: 1523 - DNA, 628 bp, Homo sapiens
gggattcttgatccgggatctggtgatcctcggcaggacaactcaccattctgttcggttgcccgcttgcctcctcccgctggctccagcttctgtgcctacaatgaaggctgtgcccattccctcacgtgcccgccgtggcctgacaccttcctgggcccaccctaacacattcctccgttgcttttaacgactgtttacagctcgctacctctaggacgtggcttctgatgaaaactgtccagacgctctgcctccggtgtaattcagagcccagctctcctccttaaaattcttttacgctattttccacaagcatgtgcttctgttggcagtgccataagtgtgattgatctttaccataagttccttgaactttgctgtgacctggatgctaaggtggcgggagctgcctccatccccacaatttgactggtacaacccgaaagtaggatgatagtctgttctggtcaaacattaacccttgttgatgtaaaaggaattaaagttgagaaaccatttcctgcaaccagaattgtgaaagcatacaacgtagtaccaaaggaaaattaccgaagcctccttccctgaagaaccttcaggaaggggaggccagccgtctgacgtg

SEQ ID NO: 1524 - DNA, 736 bp, Homo sapiens
acagccagtcaggaaaatcttgcttctcaaactcctgtcttgaccccttcctgaactttgcctcctggatcttgaggtctgccttctgtggaagagaaatactagaatcaatgaactgtgaactagagccctgggattatcaacagctgaaattttgagagccaccttatagaaagcctaacagcaaagactggagagaggcttccagccaacagccagcaaggaattgaagccctcagtccaatagcagtgaggaattgaatcctgccaacagcctcgtggaccgactgcttcatgctgggcttcagacatgagaggctaggagtaggaggcatgccttgttcaaaggtgagtggacacatttatcaccattaaaacaatgtttatctgtttggatttagtaaatggcctcaagttcctggaaatgtgtgcagagaccccgtggccatgagaagatctgtcattttattttttacagtaggatgaaatatatttggaagtcattgggctgtagctgtcctacatcaaaagacgtttcataacaaaacactatcatgccccatttatagtaatagcatgctgtgctctggctgctgtgggcaaataaaatatgttcctgtaatataaacagcctcaccttccctctaaagactaaaaggccatgaaagatttatttaaataggcttttgaaacatagagacacatgcaaaaacatgttaagcatatggatatagag

SEQ ID NO: 1525 - DNA, 486 bp, Homo sapiens
agcataccaagtcttttagtcacaagagggcacaactacaaaaatgggttagaccatgtttttcttcttcctgcgactgcagagatgaagggaatgaaggttagctcatgaatggtatggggctggtgttttggagtatactgggggtggcagcaggggcaactatttgggagttaaaaggtcctggcgctggatatagagatggattgtggcaaaggactactatgagaaaatagaaaaggaggcaagctgtaattgtgtttatcaatccttttgaattttgaaacttcaatttccacaaaagagctgatggatggatgtcaagaaaaatgtcgctggggacttattccttgttggagtaattaacacactgtttgacctctggtaactaaaactgcagaaggcaaaactggataaggagactactgtaatgattatgctattacaagacgctcgattgctaacatcagacatttttataaaagg

SEQ ID NO: 1526 - DNA, 559 bp, Homo sapiens
cacaactacaaaaatgggttagaccatgtttttcttcttcctgcgactgcagagatgaagggaatgaaggccagaatcctgctaggacatctctgcctgtggaaggagggctggatggcatactgggaatggctttctaggatgacttcctgttgctacagactacaagaagcatttctggccttgatgttgtctgaatgaagaagacataggagtttcaccaaagtaatgaaagctggctgagcaaaaacccagagcataatttctcactggctggctgctccagatagtaatagcttcagtgcccttcagagtggaattttcctgagcctgtgaagatgtgtgaggtgtacccagcaggtaagcattcttccatttgccttccacccgttgctttaattaaatgcacattgcttctcctggttagttcttccaagactccagaagttgtggaatgtcactgcagcagctgaaatggcagttcactgagtggaaatgatgcagacagggaaagggatcttttaagtctttttttttttcacattggtgatgggggtgg

SEQ ID NO: 1527 - DNA, 466 bp, Homo sapiens
gggagttaaaaggtcctggcgctggatatagagatggattgtggcaaaggactactatgagaaaatagaaaaggaggcaagctgtaattgtgtttatcaatccttttgaattttgaaacttcaatttccacaaaagagctgatggatggatgtcaagaaaaatgtcgctggggacttattccttgttggagtaattaacacgccagaatcctgctaggacatctctgcctgtggaaggagggctggatggcatactgggaatggctttctaggatgacttcctgttgctacagactacaagaagcatttctggccttgatgttgtctgaatgaagaagacataggagtttcaccaaagcctacaggaatgaggaagcaggaagggccagagtgaagtggaaactttgaacttgaagttggaagacactggtactcatctcttctatttgctagctgtatgatcttg

SEQ ID NO: 1528 - DNA, 378 bp, Homo sapiens
agactccccctgtgggcacctgtaacctctctgagacttatactttcattgtgaggctactgggtctgtgacgcatttgagtaaaaggaaaggagatttggtgggtgaagcacatctgtgatacacacagcagagcgtgcccctgccaagagcaccaaggattgggtggagccgagagctacgttcagactcaaaccccgttgtgatgatcactctaagtttaatataccttcgggaatcaaatttcatggatgcatttgaagaaaaagaatacaaaatttgtccaaaggtgaacagttacttagaatgataaaggaagcaatctatttttaacaagccgatcaatatcacaaccaccacaaaatctagaaacaaagg

SEQ ID NO: 1529 - DNA, 506 bp, Homo sapiens
gtttgctaggagccaaaggaccagtgccaataataagtgctataggatggctgggagatggtttttgagcagctgctaatgtgctggcctcagtcctgggtgatttcatgttatcacatgaatcctccaggaactcagtggtgggagtaatcgctgtggattgggatggccagaacgtcttcagaggggagggaccttgtgacgctgatacagccaatggccaggagatttgaggggcagattctgcatctatccaaagggtaagctttctagagtttcatattccaaagtgtatcctctccgtcctgattcactatttgaagttgatatccaaagcagaaaagtgaagggaccacaagggaggtgaggacatattatattagattcagtattttcttttgtgttttctgagaggagtggggttgtgcagtcagaaaatgcattgagcaaatataagaggaaatggaattgtgcttaggaaaggaaaataccctggcagcgggagg

SEQ ID NO: 1530 - DNA, 1853 bp, Homo sapiens
caaggacagaacagaacagggcaggggagcaatcctacaggcatcagattggtgcccgtcgaggtccgagatcccagaagaaggagcaggcatccacctttgctgttctccagcttccttgagtgacatctccaagtgagggggcgaaccagatgaataggacctgaagtgaacccctggaaaactgcaggagccctacagaagagggacctgaccattgaaagaaaaacaaacaaacagaaagcaacaacagcatcaacaacaacaaaaagtacccacagaatagccctccaaggatcagcagcctcaaagatcaaaactagttaaactcacaaagatgagaaagaatcagcaaaaacaaaaaacaaaaaactgaaaatccaaaaagccagtgtgactcttctcctccaaatgattgcagcgtctctccagtaaggatgcagaactggatggaggatcagatggacgaattgacaaaagtccggccctctaggtggtaaattctgagtcattcttcaatctccaggacaaaaacactttgcaattgtgtctggctttaatttttgcatctggcaagagtttctgcaaattccctgtggtaaagatggcaggctgccctggagatcttctcttccttgtgggttggctgtggctcggaagtggcggcttcctggagcctgtgtgtccattcccaacttccttgcatctagagcctgtttactagcatgtcactgcctatcacacaataaggctggtgaaattctattgaaataatccatgtaaaatgctcagtggagtgcacgatacaagtcaattcacttcagaaagtatctacccccgtgtccccagcagcacatttcatccacaccacgaagcgaacagaaagagacctaaagcttggtctatgtgcttctgccactcacgtctgagaaccatctgtgtgggagtgaactgcccagggagcaggagcttcccatctctggaagggaccatacacaaaatgcacaaccaccagaattagtgttgaaggaactcaaacatgcagtggatttttgtaagacgaccgtttatgagcctgtaatctgtgtttttattattctatgtttcctcgcaaatgaacaaagttttgaagaacttgcgtgaagtcaacccgaatatgtgccccaacgatcctgtagctctggtttgtcaccatcacttccctggctaactcagtaagccacaaggcatgagtgactgcaattttgggccatgttcaatctgaacacattcccggattctttaacacgtttgcaacatcaaaggataggaagcaggagaggcaattagacgcagtgcttggtaatcaagttgaaatccttttactacttgtaaggagcatttattaagcccctgctaggtaccatttctatgctaagcctttccttaatttatctcattttgtctttttaacacccctatgtggttgctacactctcagtacctatttaacacttgagggaagttagggccccaaatcagagccaacaaatgaacccaggtctctctgagatccatacaaccttggacaagtcatttagtccctggaaaaattagttttgacattttttaaatgaagatactctttttagcttggaagtttgtagtttcaagtgagcacctccatgtgaactttctgtaaattttaacgtgcagatattactgtaaaaatatgtgaatccatgaaaaagaacctcagtgtgtttttctattgctacataggtagaagaggtagaagaagatgtcttgtgattatggactttttgagttagcagtgatttaaaaccttttataattctatgctatgccctgga

SEQ ID NO: 1531 - DNA, 1485 bp, Homo sapiens
accccatctctactaaaaataaaaaaattagcctggcgtggtggcaggcacctgtagtcccagctacttgggaggctgaggcaaaagaatcacttgaacctgggaggtggaggttgcagtgagccaagatcgtgccactgcactccagcctgggtgacagagtgagactctgtctcaaaaaaaaaaaaaaaaaaaaaggtgaagtaacaccccaacaaacccatcctaagttaaaaatatcgtaagtcaaaatgcatgtaatatacctaacccacagaacatcacatcttagcttagcctaccttaaatgtgctcagaacacttactgtgtaaagttgtctaacacaaagcctgttttataataaagtgttgaatagtgcatgtaatttattgaacactatactaaaagtgaaaaacagaatggttttatgggcactcaaagtacagtttttactgaatgtgtatcactttgcaccatcctcaagttgaaaatgataagtggaaccatcgtgagtcagggatcttccgcacggggataagtacagaggtttctggagccttaccaattcaggaaaattttgggacttaataagcacaaggagacatggaggactggacaattgggcataaaaggaatatacacttaagggatatgagcctagaaaaattggacggatggtattttatattttcactgaattttcttgtaaatgtgagcagtcaataaatgcttgagggaattagaaaatctggtcaatgagtgttaccatttatataatattttggacccttaagttgtttttctcgaacttgtttttatattagtcaataagtatgcacaatttcatgtttcaaatgttttggcaaatttcttcattggttttttcccagctttaatttttgcatctggcaagagtttctgcaaattccctgtggtaaagatggcaggctgccctggagatcttctcttccttgtgggttggctgtggctcggaagtggcggcttcctggagcctgtgtgtccattcccaacttccttgcatctagagcctgtttactagcatgtcactgcctatcacacaataaggctggtgaaattctattgaaataatccatgtaaaatgctcagtggagtgcacgatacaagtcaattcacttcagaaagtatctacccccgtgtccccagcagcacatttcatccacaccacgaagcgaacagaaagagacctaaagcttggtctatgtgcttctgccactcacgtctgagaaccttgcagaaatgacaagaaaggtttgattgttcgattttgtaatataaggcataagagaacagactaagagacaggccaagagagcgaagaacaatacaagagcaaaaagaaatgagaaactggggacttagccaactcaagaatgtttaattctaagtcagactgctactttttacaccaagtcaagtcttgtagaactctttgattctttgga

SEQ ID NO: 1532 - DNA, 1527 bp, Homo sapiens
ctagggaagagtatctcagtgttaggaaatgtcagctttgtaagtttttatcaagcagctcctggtatagtgtatgggttcagtaagacatggaaacagattagttgtatgaagaagggggcattaaagatgaggttaagatttaatggtatggggaatgttgggatcattaatatgaagaaattaggaggaggggtgttagtgaataggagcaccaatggtgagtttttgacagtctttgccagcttaagtttgtatctagccacatagcgagatgaggcattaacttataataaagataaatcaaaagctccccatgttccatgaatatctattctcatatcccggctgtttaagactttcaccaaaatttcttgtttatccttcatatagatctcgcatatttttcaggattaattttactcctacatatggtaatagtttctattgagatgataaatgaaatcttcgtatccattataaaatgataagtagttattacaagtctttaggaaagctctcattttttgtgtgtttcacatgaatcagtgttctgctctattgctctgagtatggctggcacagaaagagttaagttggggaggaaagctcttggtttctatgttttttgtaaaatggcattctgttctattgctgtaagagcctagcgggagaaaaacaagcagggccagggtgcaacagcggctggacagggagaaagcagcagtcaaggagcattcagggcacaaggactgtccgtaagtggaagcatctactgaggcttagacgaatataaccatgaatatcaataagatccttgatccttctcagcataggtgagtgtgctggggccatttcccagctctttgagagatgaggggctattacgcccttgcactttttaacctcctattctgtagagacagcaatcacacactgccataattccattagttaatgaatactctgagaacttgtccatcataaagatacacttaaaagttaatcaattatctcttttcttaatgttttctcccgtttcttataccttctcatttaatgaaaccatactggaaatatttgattaattcttgaatttaagattttcatgtgcttgtacagataggttgagaaaggaaaaaagtatttctgatttttcccctgtttttgctccatattcccatttcaaattcttgggtagtgtggtctagtggggaaattgcaaatttgagatgagcagttcacctctgccccatggcaagctgatgattttttttttttttttttttttttttgagatggagtctcactctgtcacccagtctgaaggcagtgggacaggatctccactcactgtaaccttcacctgctgggttcaagcagttcgcctgtctcagccttcctagtagctaggataacaggggtgcaccaccatgcccagctagtttttttgtatttttagtaaagacgaggtttcgccatattggccagtctggtctagaactcctgaacctcgagtgatccgcc

SEQ ID NO: 1533 - DNA, 1205 bp, Homo sapiens
gccacattctgtgacaaatctgagtaaatttacataatatttcatcaattcctagtgggggaagggcatttacaaaggaattacaggtccttagaaagacggcactacacagtgcaaataatcacataaattaggtttttgtagtaatcaaatttgggaaaaatgtaattgaattctggggaaagggatcaacaaaggaatgcagagactgtgggacttagcacttcatttgtgctcaactcagacgcaaaatttaaaactccaaaggaaactaagacacggtggacatttttatattctctgtcctttgtaagatttcagaagacatgtggagatatccaatttactacaaagagtaaaaggaactgtacaggtctacagaactgacactcgagattagtgatgccatttcctgtatcaaaaattcaaaatcatgaaagtcacgatgactcatgacagagcaggacattgtgacgtggctcatctggtactaacaagtaaaaaacaggtctcaattttaggaaaaacgtaattcattctacaactgacttggcttggccattcctatcataagatgtgaaagaagagctggaaagcacatctggttacctattctaatgggtgcagaaatggatctaacaggaaggggaagccatataatactccccaggaatgtttaaaagaggattcttcaggctttcatggaaaacaggagttttaaggggacatcctagccaatctctccaggctgtgtgtcagatggggatgtgtctggttgtatcacttttggaagggcagcttatccctcttgggcatgaagcaatgtcaatagctccttgagcaccaattgattcatgagtaaaaagaaaggccgagatgttagaagtaacccacaactgtgaagaaaactatgaatatcaagggatgggcaagatcagagagtgtggcattgaaactagtaggtatgaaaaagactcatggatttctgtctttgaaatctaaggtaaaaataaatgaaaatcataaccattaaggactgaaaatcgaacctagctgtttcatttctttaaaagcatactcaatgcaactataatatctacttaaaataataccatacgtgactatcttaatagcatgcactattttcccccaggaacataaggaaagagatgccattttactcgaagctgaaaccagacccacct

SEQ ID NO: 1534 - DNA, 285 bp, Homo sapiens
cagatgaggacactgaggtatggagagacatttcagctagtgcctctgtactctgaaaaatacctggaaaggacacaccagaaagaagaagccactgaacaggaaaaggccatgagagatgagaagatgatcaacggaagaggatataggatgaagatacacaagttcgggtggggaggagatgaagaaaaagaagaggataattggaaggaaatatctttctctacccctgaccaaattgactggtttgagtttgttgcctgacgtaagcagcatcaatgggcc

SEQ ID NO: 1535 - DNA, 302 bp, Homo sapiens
agaagtaaacatgtgcctgtctgggccgttgaagaatgagaggtttgtgaagcaaagctgagatgcttcagtcttccaaccatggacatcgtcagtcagctgacagccagctaaccccagacatgagaatgagcccagccaagatcagtagcaccaccgaagccactaacagtcaaccacagaggtgaaaacatgactaaggagatatgaaaaaattaaagagaaaagacgtgcagagatttcactttgaaacgagtgaaacaagtgaacaataatattagcatctttctgccatcagcagg

SEQ ID NO: 1536 - DNA, 433 bp, Homo sapiens
gccccagtgtgtgatgctctcctacatgtgtccatgtgttctcattgttcaactcccacttttgagcaagaacatgcggtgtttggttttctgttcctgtgtttgtttgctgaggatgatggcttcaagcttcatccatgtccctgcaaaggacctgaactcattcttttttatggctgcatagtattccatggtgtatatgtgccatcttttctttatctaatgactggtgttcttataagaaggaaacacgaggcaggcaaatgcatagaggaaagagcatgtgaggacacagtgggaaggtgccatctgccagccagggagcaagacctcagaaggaatgggagcaccttgatcttggacttctagcctccaaaactgatatgttccagtcgccagtggatgcctgaaacctatatatataatattgagc

SEQ ID NO: 1537 - DNA, 765 bp, Homo sapiens
gaaggaaactgtgttaacatgataaagatgatcttttcaagccaagagccatcatccttcccttaacagtcaggaacgagggccagttctctgtccccaggaccagccagttaccaacaactccacagaatggacagcttccctgtgcagagcctgatacaccaaccaagcctctcactggacatcaaaaatctgaatcaacataagcaagggcaggcaaaacattgtccagatgttagtcttcccgtaagttaacacaaaaatttaatgcaatttcaactgaaatctccatggtgtttttgtaaggaatttgtccaatgacttagaagattacttggaagaattaaatgcttgagaatagcaaagaatcttttttaaaaggaggcagaataagggatggaatgtgttcaccaaacagtgactatctcatatgacaccactaatgagagagagtggactgatgctggacagacaggaatggagcagaatgcccagaaagaactcgagtgcaaagacacaggcttccatttgataaagtctgagatcagtgagaaaatgaaggattcaacaaataatggggagaaatgttacatctcaatctaatatctatcaaaacaaattctaggccaggcacggtggctcacacctgtaatcccagcactttgggaggccgaggcgggcggatcacaagttcaggagatcaagaccatcctggctaacacggtgaaaccctgtctctccaaaaaatacaaaaaatcagccagg

SEQ ID NO: 1538 - DNA, 4099 bp, Homo sapiens
gggtcctgagggaagatgagggagagaagtataggaggaggagggagttgaaggctgcagacaggaggaggaaggggagggagtagggctgccaggggaggggtggagggctggataaggaggagggctacaaagaaaagagtagagctgcagggaaggagggtggagggctgcagcgggaggaggagagggaggaaggctgcaaggggaggaggagtattgcaggggagggggaggagagctggcaggggaggaggaggagggctacaaagaaaagagaactgcagtgggagaaggagagtggtggagagttgcaggggaaggggagagggaggaggactggaggaggaggagggatgtaggaggagggtagtggagggctgcagaggaggaggaagaggagaatagggaggacaaatccactctagcaggggaacgaaagcagcatggggcagacaaatccactctagcattccaatctccctaagcctttgaatcccttcttctacactaaccatgggcggccaggcatgtccagttatcccatggtgggccatgttttggcccatgtttcagccaagcagccaaccaaccaattagagccctttctaaatgcggaatctctgcttagtgagcccgtatcaataaacttggcctgatctaactctgtgttcctcctaccattctcccaggccctcaatatgcattcccacggtcctgggatttctatgtaaactggaaaactcacgttctctttggtaagtgcatctcctcatggtcacgccctgtatctctaggggctgcccaacatcagtctagttccatgtctagaagcaaagaggggtgggggcagatcctgggaagcagcagcttggtcctgctagtcagcagcctcagggcagtcccatttcctcaggcagtacagggttaacccactcagatggagttggggaggctaccactagggttaggaaggcctcttccactgaagactcatcaggatttaggggttgtcttcactgttcatcagggtcaccccacacatcctcatcccaactgacaggatcccattccttcctaaccaatgccttcatttgcacagcagacaccgtgaggctgggagttccacatgtgctataatccagccactggaagggcgagattctgggtttgattttcagtagtctcagacccgcagctaaaggaggtaagagtctctcttgggacagtcataactttcagattattcatgtgacacttcagctgggaatctgaatcctgagctcactcccatgatactttttctgagatggagtctcactctgtagcccaggctggaatgcagtggggcaatcccagctcactgcaacctctgcctcccaggtgcaagtaattctcctgcctcagcctcccgagtagctgggattacaggtgcctgccaccacacttggctaatttctgtatttttagaagagttggggttttgccatgttggccaaggtggtcttgaactcctgacctcaggtgatctgcccgcctcaggcctcccaaagtgctgggattataggcgtgagccaccacacacggctttttttttttgagacagggtctcactgtgttacccaggccggagtacagtggtacaatcacagctaactgcagcgtcaacctctcagattcaaccaatcctcccacctcagcctccagagtagctggaaccacaggtgcaggccaccgtgcttgactaattttattttttagagatgggatcttgttatgttgcctaggctggtcttgaactcctggcctcaagccatcctcctgcctcccaaagtgctgggatgacaggtgtgagctactggtcctggcccattatactctagtttgatgaaagtgttcaaaagccaccgagaaccctgccttctgcaagtatttaattaggagcacccagtggtgatactatgcatacctctattgccacatcacactatggactatcggtgttctttttactactggaaatcagcattagtgcctttacatctaatcaggataaagacccaattccaggaaccctcccatccccaccctctcgccactccccaccctcaattattttcaagcaaaccctccgcacctcttaccatgttgtgtataggtagaagctatttaacacacacacagtgacattctgtctaaaatgacaacgatcgtttggagaagtttattaccacccctaccctccagtgggatctcaatgtcacgatgagtccggggctggctttccgccgggaccctcctgtcctggcacatggcccaccccagcacgaagcctggccgggagggctcaggtgggtggctgctaggccaggcctccccagaacgactgccccatgtccagcctgtatctcctgagtgccatgctgcactggggagggacagggctggctcggggctccaggaaagatgcctcacatgtgcctagaaatgtaggcgtcaagggaaggctgtgtgtgggggcacctgaggggctgggcttcccaggcatctgagttcttacggagccctaataggcacatccccaaatggttgtatgaggatgagcacaaaaatagcagatggggtcaccctcaccctccactgacaatggactgggatccgactcatgcaacattccttctcggccgtaggttccacatccatgggttaggtgtgctggcctggagcccgccggccccggtccccaccgcacaaggaccccatcacaagtgggtgtcatactcttcctccagaaacggattaagcaaccagcatgtgaaccttacgctctgtttacaggctgagtccccacagctcttccagcttcagccaggccagggtcaccttcagattgaatgtgcagggcccctgaggactcatgtcctgagatggcccttcttcctgggatgggacccccgggttcaggtgagaggtgttcccgggccccttcacctggggctcaggtgacaggaggtgttccgggccccttcacctggggctcaggtgagaggaggtgttccgggccccttcacctggggctcaggtgagagcaagtgttccgggccccttcaccgggggctcaggtgagagcaggtgttccgggccccttcacctggggctcaggtgagagcaggtgttccgggccccttcacctggggctcaggtgagagcaggtgttctgggccccttcacctggggttcaggtgagagcaggtgttcccgggccccttcacctggggctcaggtgagagcaggtgttcccgggccccttcacctggggctcaggtgagagcaggtgttccgggccccttcacctggggctcaggtgagagcaggtgttccgggccccttcacctggggttcaggtgagagcaggtgttcccgggccccttcacctggggctcaggtgagagcaggtgttcccgggccccttcacctggggctcaggtgagagcaggtgttctgggcccctgcatctgaggcctgggagttgaccctgacttcctggccccagaaagaaaagggaaaacacagagatcacaggagaagggacacaagcggggagggtcgcaggctgccccaaagcccagctccaggctcaggaaagcccctccccactcaccccttccggagggcctgggtctgcggaggaacggggcttagggggtctccgagggttagagtgctccaggctcgggtggggaggaggaagatgtgttcgggtgctgagggcctcctgcgttgggcccagagggccaggctgcggccactgccaggtgggcagctcatctctctggcagcagcacgaagaaggcagccttcaggaagcggccgaagctgcagagtgcagccaccagccagtgggagcggaggccagggtctgtgctgaccacacacttgaggacatcagtctgggagggaagagggagaccgttagaaagcagagccagcaccgccaggcccccagcaccgccaggccccccagcaccgtgcaccagaatatcagcaaaattgcatgaagggaatgcaggagactgttcgggaaggaggtctgtggcct

SEQ ID NO: 1539 - DNA, 1816 bp, Homo sapiens
gggatgagcagcgagactgtggtgggactcacctgagctgcaagttctgcttcccaagggagggctgtccccggcctgccagctgccctccccagaagctgagctcaggaagacgggtaccagcgtgtgaggaaggggccccagaaggagcgcgtgtctgcggggagagggagcgctaagccaccacaccaggtgggcagcagtgctgaaggggcacccggcttcccctgatcgtttcttttccctgtggcccaatctcccacccccatctcaccctgtcctggagccagccttcggggaggctgggcagggagcggggtcagaaggcgtctgccccaggcctgggtcctagggcctgtccttggagggaccacacatgcctggagagaggctccagtggccggctccaggtgggcgctgatgcagaaggcccaaggaggaccctgccacatgttgcagggacccgtgggtgctgtgcacaacctgcctcatccatccccgccgaagaagagggggtgctcatggctggctgatttgtgagggggccacgtaagcagctcttgcagggcgtggcttgtgggtttgggagacagacaaatgggcagtcagacagaggcgtggacaggatgccctctctgctgtctgccgcccaggcctctggaggtgttctgggatgggtctaaggaaaactcaacaattcttgagcgaataatgcccgggcaaccagctccctgcatttcataagggccggaattgccatccaaaaggttattttgggtgactgtggtcagtcatcattccaaagcttttccctaaactcagagccaggtgtggcctccagggctgaggagcctgagaggtgggactggcaggcagggctgtggccccagcgtggcacggaagcagccaggaaacactggctctggggggctgtggtgggaggaggtcctctgcagggacccctgtggaccgaggcttttggaggcaagtggacagtaggtgtctcttagacccctgcgggggcacacgaccaggaccacaaggggcccacacacgcacagtggcccggagccaaccagcaaaccccaggaccttagatacagcccggcgagtgagttaggattgctccggctagctgtgtgatcatccacagtgccagagaacagtgcctcgagaccacagtggcagctggcttacttctcgtgtgaacaggaaacccagaggtgggcgaccctccagtggtgtgacgactccatctgtcaccacagccccgggctcccgccttcctgctccttgggctcacagctctgtgcttgaggcaggtctaagacaggctggagtgcggccatcatcccagcactgatggatagaagaaaatgaagctgggatgagaaacgcggggctttccctggcagtctggccctgtatggaggccccttcccagagtgcgtcccactggcttcctcttctatcttgcagtcacacctagctgcaaggcgggaagatgtcacaggtttgaaagggccgaaaagaaggttcagaaatgaaaactatgacaaggcgcttgccagcattagctgcagagtcgacagagacgaggagataatgtgtgaagtggtagaaaaatgagaagagattgttcagtgtgcagggcagagagatggcgagatgggagctgtgaggagagccgggtggccgggagcctcccgggggcagatctgtgctgaggttttgcagggatcagctggctgtctccgcccctgcacgtcccggctccttctcagctcaccctttcttgttgtgccatgacaggtgg

SEQ ID NO: 1540 - DNA, 1639 bp, Homo sapiens
aaggaaggaaggaaggagaaagaaggaaagaaagaaaggaagagagaaagaaagaaagaaaaagaaagaagaaaagacagaaagaaaaagagaaagagggagggagggaaagaaagagaaagaaaaggaaggaagggaaaaagaaagaaggaaagagagaagggaaggaaagagaaagacagagaaagaaagaggaaagaaagaaatagaactttctgtcttacagaactagatactgctcctggaggcctgggtgtgaccgtgacgtagactctggagccacaggatagaccagtgacctcatttttcttgccaggcctccagcccaagctcagccatcatatcccctgtgacctgcatgaatacatccagatggcctgaagcaagtgaagaatcacaaaagaagtgaaaatggccggtgcctgccttaattgatgacactccaccattgtgatttattcctgccccaccttaactgggtgattaaccttgtgaaattccttctcctgcctcagaagctcccgcactgagcaccttgtgacccccacccctgcccacaagagaaaaacaccctttgactgtaattttccactacccacccaaatcctatgaaatggcctcacccctatctccctttgctgactctcttttcagactcagcctgcctgcacccaggtgattaaaaagctttattgctcacacaaagactgtttagtggtctcttcacatggatgcacgtgacatttggtgccatgactctgatcgggggacctcccttgggagatcaatcccctgtcctcctgctctttgctctgtgagaaagatccacctatgacctcgggtcctcagaccaagcagcccaaggaacatctcaccaattttaaatcgggtgagtggcctctttttactctcttctccaacctctctcactatcccttaacctctttctcctttcaatcttggcgccacccttcaatctctctcttcccttaatttcagttcctttccttttctggtagagacagaggagatgcgttttatccatgaacccaaaactccggcaccagtcacaggctcgggaagacagtcttcccttggtgtttaatcactgcgggatgcctgcctgattattcacccacgtttcagaggtgtctgatcaccgcagggacgcctgccttgatccttcaccttagtggcaagtaccactttgctggggcacaaataccccccaccccttctctccatgtctctaccctctcttttctctgggcttgcctccttcactatgggcaaccatccaccctccattcctccctcttctcccttagcctgtgttctcaaagacttaaaacctcttcagctcacacctgacctaaaacctaaacaccttattttcttctgcaatgctgtttgactccaaaacaaactcgacgatggttccaaatagccagaaaacggcactttcaatttctccatcctacaagatctagataattcttgtcataaaatgggcaaatggtctgaggtgcctgacatccaggcattcttttacacatcggtccctccctagtctctgttcccaatgtgactcaccccaaatcctccttctttcccccccacctgttccctcagtcccaac

SEQ ID NO: 1541 - DNA, 1243 bp, Homo sapiens
gggactactacaggaaagcgggaggagggcaaaaaagagactgatctccggagagggagctggggctcggagggcagacagggagatccgaaaaggatggggagactcagaaaggaggctgaggtctgagaggggcatgagagcttggagagcgtacaggagccctgacagagggacaggggctcggagatgttgggctcaggctctgagggcctacagtgccccaggcagcccggcagctctggaaggcagcagcttcctctcctctcggcacttcacacccctgcagggccacccggagctggagggactgacactctcaggcattagtcagctcgtggcggttaaaaaaagaaggctcgatggcacttgtgaagaacgtctcttccagctttgagcaccaatgggctgccacctccccgctgcaccactggccaaggatagaggaatcgggaacagggcggagggcccagaagctgggacccctaccccaacgagggcttcctcccagctcccacctcatgatgatgatgataataagatcccaccagtgctcccaatgggccagacccaatggaaagccagacaacaagggttcccttgattgacataatccctgcaggccaaccactcaggacagagagcaaggagaaggatgggaagaggatctgagaggagaaccacaagatctccagccaaagtcaagtacactttccttatctactgccttgtgcttgcagaggcatagtaggttctgttgtctatgccagcaaggtcactatggaaggtacagttgtcactacggctagttcatgctgcaggaacaaacaactcccaattctcaagacttcaaacaggttggcaaactatagcctgcaagctggtcactcatcttgtaaacaaagtttcatcgagacacagccacaaccacccatttacgtactgtctgtgcctgctttcttgctccaacagcagagttgagtagctgtgacaagcctaaaatattcattctctggccaagaaaatttgccaacccttggcttaaaaaaacacaggtttgcttcttactccggttccctgtccatctccagttggcaaggcttctcctccataacgtccacagtcaggggcccaggctggcgagccctcccttgaagaacccgccagtctccctggcaggggatgcagacaaaaaattgctcaccagctcttgaggctcccatcagaaagagacacacctcac

SEQ ID NO: 1542 - DNA, 1348 bp, Homo sapiens
cccaggtgatccgcctgcctcagcctcctaaagcgttgggattacaggcgtgagtcactgcacccggcctaaatttatcatctttattctcctttaacctggaacagttcctctatcttttggttggtttgattctcatggtgttgatatttgagagtacatgtcagagcttttgtgtcccacacttggatttgtctgtttctaattctcataattagattcaggttatgcatattttgagattaatacccaggtggtgttgcatccttcccactgcatcacatcaaggaggtacagggtatcagtttgtcccattactggtctcactgagtttaatcgtttgttcaacataggtataccagacctttccattgtaaggtatttttccctctttgtaaggagtcagtagtctatggagtggtactttacacagtacaggactagtaatattttttttcttcaacagtctttcacctagtgcttttagcattcattgatcgttccctaaatcaaatactgtattagactgaaggttacaaaatgattattttctagttcttttgtttttgtttttttgagatggttgagatggagtcttgctctgttgcccaggctggagtgcagtggcgcggtctcggcccactgcaagctccgcctcccaggttcaagcacttctcctgcttcagcctcctgagtagctgggattacaggcatgtgccaccacatttggctaatttttgtatttttagtagagacggggttttgccatgttggccaggctggtcttgaactcctgacctcatgtgatccacccgccttggcctcccaaagtgctgggattacaggtgtgagccactgcacctggacacacacgcacatttttgagacaggaactcactctgtcacccaggctgcgtgtagtggtgtgatctcagctcactgcagccttgacctccccaggctcagatgatcctcctgcctcagcctcccaagtagctgggaatacaggcgtgtgccactatgtccagctaatttttgtagagacagagttccacagggtttcccaggctagtctcgaattcctgggctcaagccatctgcctgcctcggccccccagagtcctgggatttcaggtgagccactgcgctcagtcccagaaatatataaattaagatactaatgggtagtgccagacaggaggaattatagctgatcttaatttcgtttctctaattccatattttctatagtatgattatatttcttctattatatttttcccaatacaactttgtgggccctgccctagaaattctgattgtaatcctgggattgggcctggagaac

SEQ ID NO: 1543 - DNA, 724 bp, Homo sapiens
cccgagcccagcgttcccgagcgtctctgcgcgcgggtccgggcagagcccgggagccgccggaggcagctgcgcatcagcggactcgcggcccgggtcggagcccgacgatgaccatcaccgctgccacgtactgagcaccttctaggccaggctgcttctcctcgtcgtctaatcagatcatcatagccaatctgtccttctgcagaggagcctgtttcagagaagttaagcacccgatcttataatcaagccagtgttctgacaaagaaaagcattctgggagtggaggtgggatctaccagggcgtcctctcctattccagaagagtgggcaggggtgggggaggacaaagatgccctcccactctgcagaaggcagttaggtgacttctccacagggcagggttctgccagttctcctctggcagccagtgcccaggtcccatcctggttggtgggggctgggccaaccccttgtcatcctcggggaagcctgtatgtacaccagcacctccactgggtgccaagtggccatctcggccagcgagtgtcccctgagaactgagggggagtaggctgagggtgcacctgaggggcacgctccggagcctgttctcactcctgggcctgggcctgggccttccatggtttcgatgacatgagcaactcccctctccccccaggatgataatgtgtaccaaaaaatagatttttcagtagcc

SEQ ID NO: 1544 - DNA, 733 bp, Homo sapiens
cccgagcccagcgttcccgagcgtctctgcgcgcgggtccgggcagagcccgggagccgccggaggcagctgcgcatcagcggactcgcggcccgggtcggagcccggtttccggggcgggggttccgggaaggagagaccctcgccttccgcccgccctggatccgggtcccgccggacccccggctcctgccgttcgtcgcctggaagcggggcaggcgcacagtccagacgccagggagagacgcctcgccgacccagaccgtggggtcagggcccgggaggcaagaacgccccacacacagcagggcaccccaggcaaccctcactccgtgctgaggcctcggctagggtgcaaaggtgtccgggaatggaagggacacgagggtgtggacgcctcgcactctactcacgcctggtgccttctgagaggctgggcgtggggcagagggtaggggacaagggggtgacattccttaaggtcctccccccaacaaaagtagggcctgcagttccagcttgattcgttgattgttgggtggaaccgcctcacatcaaaggcatcgtggctccaaacactgtcccctttacttttctaagcccccgcttcaaaaccagctgtcggtgggccggtgagggcgtctgcagtacccaggctttccgcggggcggcgcggttggataagaaaaggcttcccggctggggcgcgcagcgcagctcagacacctgcggg

SEQ ID NO: 1545 - DNA, 4254 bp, Homo sapiens
attccttacaataaacctatatatattcatgcaactgataaatattttgttgttacagatttggctaccatgttctttttgtgcctattttaacagagtctcagtcatagcctgccttcatctctgaagggaccaggcgacccacggagtgcctcggcagccttgttattgcatgcaatcttcacagacaagatctcactgcaaccaggtttctacaggagcacaggtgtgacattatagtgatgacatcattctcagagaaaattcattttacgcactaaggacacacagatacaaggaggcttacacaaagggaatggacctttccacaacacagatgtgcaaggccctgccactttgcttcaattcctgaaaattccttggtaaacatggagctactctattcctgacactttcaagaaatagttattgatcctctcagcgtccacaatgttaatacaagcccaacattctttaatttgtgttttgttttttggaggcacagtcttgctctgtcacccaggctggtatgaagtggcacgatttcagctcactgcagcctcgacctcctgagctctagcaattctcccatctcggccttccaagtagctaggactgcaggtgtgtgccaccacactcagctaattttgtttatttttttgtagagaaaacgtctcgctatgttacccagactggtctcaaactcctgggctgaagcgatcctcttacctcggcctcccaaagttctgggattacaggtgtcagccactgttcccagccctttaattctttacttggggttcaggtgacaacatatttcttatttacaaatcttacttaatctcactgatgctttctgtcattggctaactgatccaccttgaatgaagcctcctccaacaagtctggaatctgtccaaatctaaattaacaggtgcgcctatgaattccctcagagaacacactgtggatgctttagcaacctcttaccatgcctcctgaagtatctggattgcatatggtggccataagtagtccatgggcttctgatgtaaaaaacaaacctgccccttttcactgtgttctgtacagcatcagggcagttattgctgaccacatactggaccctctggaaacagagggctctgcatccatgtccacgagccttcatgcccatctggccatcaggccttgggaagcagcaccccacagccttggcacagctacagagacctccttgcctcaggatggagtcaaacctggaccccctgccattctcatctgcaggaaacactggcctccttcatcctcaggctgtgttgctggaagtcacccatctccgaggccccttgggatcgactgagtgaccagcagtgaagttcatccaccttctgaatggatgccatcatctgaagtgatggagctcagtgggatgttgttgcggtcttccctcccttagccaggatgtccctgataaaggatgacacccaagcctcagcacaactggccaaacttgaggtggtcatctcagcactgatgctgggccaacaattagccccatttgtacatttttacaaatttttggcaattgccaagaattatccaccttccctccccattgaattaaagaaacttcttgcctcatggatactcagaatacaatcaaggctatgagcagagatggacgaggtggctactgtaatggatcaaggctatgagcagagatggatgatgcatcggctgtaatggattaaggctatgagcatcttgtgaagtaggatgttaaatctgtaaatgtcagaatgaatccaaacttaccaattcaaaattggattgtaaaacagctcaaaaaagactgaaaacacagctctacactttaggaggctgaggcaggcagattgcttaagttcaagagttggagacaagtctaggaaacatggaaaaaccgtctctacaaaaaaaatatatatttttaatgagctgggtatgatggtatgagcctgtggtcccagcttttcaggagtctgaggtgagaggattgcttgagcccagaaggtagaggctgcagtgagctctgatcatgccactgcattccagcctaggtgacagagtgagacccgtctcaaaaacaaacaaacaaaaataacaaacaaaaacagctctaaacgaaagtggttagaaaagtagctcaagttgttcctgtctggttaaatagaaacataaatgaattacttatgtgccccagtggcttcataatgctgagagcaaagtcaattattctagcaggttctagaaaactttatcatatcatggggttcaatgaaaatatcaaatcataaatataataatcaaatctgaaagtgaatctagtttcaaagacctcaaaagccagtgtttaggaagctcttttcagatagagacaagggattatttgacttcttatctctgttgtctagcacaatgtccagaacacaacagatattccacatgcacagtcacatcctatgtatgtgtatttcttttccggcaaggactagaggtcctaagctttgtttatttggtgagccagtgcccaaatgagcaggagaatcttagcacagtcagctacacactcatttcagtgctctggccccttatccaagctagtcaaagtgtggtctatggtttttcattgcaagggatccccgggtgaatcttgtgtctgtcaaaggaggagaagcactgccctcaaaatatagaaaaggtgaactaatttatccaggcagcctggctatttatttatgtatttatttatcttgttgacgggaagattcaaattgacatacacaatcaccctcataaggatttcaggtaaaaaacagacaaagatttagatatcagatgtgttttacaattaccgcaccagtctttttctacagaatctagtagtatatttccaatagatctaggtgaaaatttctatctcatgagccttctgtcagtatttttaaaattggatactctattagtggccaaattgaatctcttacagacatctcactcaaactgcagtcatactttccaataggccccgtaaaaatccttcttctggagcaacctaatatatttatccacctctttagacacttaggtaagtataataatacaagttttgtgtgtgtgtgtgtgtgtgtgtgtgtattgtgtaccttgtggccttttgtccagtttctgcaacacctgacgctgaggcaagtttaatgtaaataacgtccagcaatcttagaaatgttgacttttatttgcccatcgggaaaaaaaaggtgaatgttattgtagaggaaattttcattctggaaaaaatgcctactgtttgaatattactttcatgctttccacagatattatacacagatattatattgcaaggattatgtttcaaagtcatcaaaaatagaaaattcattttatatttctagctgaaaataataacagtaattagcctacctttggggaaatgtgataaaaatactaatgaccatcacaactcattaaaagcataaaatgtgcaatgatttaaactacatgttctttctatgaatctgcgtagaaatgtagacacatttgataaatgctatttaaagtctgagtgctttggttaatgattcatctataggttgaagggattacttttatctgccttcatagtgagaattagatttctgttctttataaagcagggaatacagattgtgcatggagtaaaagcattcaatccttaataatgatggtagctgtgttgcagaaaagaaagcctgtcagagtaacgtgttcagttttacatcataatcagagtgtgtccatctctgttgaaggcagaattaaaaacgccttcaacatttttaaaataatagatgaaaaacatctcaaagtcacttttaaaatttgaattgacgattccacataacaggaaaaggaccaggaacatcttaaatacttcacgatggaagtgatgttttaagtgtaatttcatcaaggagaagtttttccagaaagtcttttgacttcagtaagaagcttatttactctggtaaatagtttctagtaagatgagaaagacttgattttttaaaaaacaattaaaaatttacattgtttaatctaatgctgtgatttcgaaagtactacctttgcccttatagttacgcatgtgtatttatatgtattttcttggttcattcaaacgccaataaaatactttactatccaggcccc

SEQ ID NO: 1546 - DNA, 2391 bp, Homo sapiens
caggccgaagctggactgtactgctgccatctcggctcactgcaacctccctgcctgattctcctgcctcagcctgccgagtgcctgccattgcaggcacacgccaccacgcctgactggtcttcgtatttttttggtggagacggggttttgctgtgttggccgggctggtctccagctcctaaccgcgagtgatctgccagcctcggcctccggaggtgccgggattgcagacggtgtctggttcactcagtgctcaatggtgcccaggctggagtgcagtggcgtgatcttggctcgctacaacctccacctcccagccacctgccttggcctcccaaagtgctgagagtgcagcctctgcccggccgccaccccgtctgggaagtgaggagcgtctctgcctggccgcccatcgcctgggacgtgaggagtccctctgcctggctgcccagtctggaaagtgaggagcgtctctgcccagccgccatcccatctaggaagtgaggagcgtctctgcccggccgcccatcatctgagatgtggggagcgcctttgccccgccgccccgtctgggatgtgaggagcgcctctgcccggctgcgagcccgtctgggaggtgaggagcgtctctgcccagctgccctgtctgagaagtgaggagaccctccgcctggcaaccgccctgtctgagaagtgaggagcccctccgcccggcagccaccccatctgagaagtgaggagcccctccgcctggcagccaccccatctgggaagtgaggagcgtctctgcccggcagccaccccatccgggagggaggtgggggtcagcccccgccaggccagccgccccatctgggagggaggtgggggggtcagtcccccacctggccagctgccccgtctgggaggtgagaggcgcctctgcccagctgcccctactgggaagtgaggagcccctctgcccggctagccgccccgtccaggagggaggtgggggggtcagccccccacccagccagccgccttgtccgggagggaggtggggtgatcagccccccacctggccagccaccccatccgggagggaggtggggtggttaaccccccgccaggccagccgccccctccaggagggaggtgggggggtcagccccccgcccggccagccgccccgtccgggaggtgaggggcgcctctgcccggccgcccctagtgggaagtgaggagcccctctgcccggccagccgccctgtccgcgagggaggtgggggggtcagccccccacccggccagccgcaccgtccgggagggaggtgggggtgtcagccccctgcccggctagctgcctcgtccgggaggtgaggggcgcctctccctggccacccctactgggaagtgaggagcccctctgcccggccagccgccctgcctgggagggaggtgggggggtcagccccccgtccggccagccgccccgtccaggagggaggtggggggtcagccccccacccggccagcctccccgtccgggagggaggtggaggggtcagccccccgcccggccagccgccctgtccgggagggaggtgggggggtcagccccccgcccggccagccgcccggtctgggaggtgaggggcgcctctgcccggccgcccctactgggaagtgaggagcccctctgcctggccaccaccaagtctgggaggtgtacccaacagctcattgagaacgggccatgatgacaatggcggttttgtggaatagaaaggggggaaaggtggggaaaagattgagaaatcggatggttgccgtgtctgtgtggaaagaagtagacatgggagacttttcattttgttctgtactaagaaaaattcttctgccttgggatcctgttgatctgtgaccttacccccaaacctgtgctctctgaaacatgtgctgtgtccactcagggttaaatggattaagggcggtgcaagatgtgctttgttaaacagatgcttgaaggcagcatgctccttgtttctttgttcacttgtttatctgctgaccttccctccgctattgtcctatgaccctgccaaatccccctctatgagaaacacccaagaataatcaataaaaaaaaaagaccctgtcccctccaaaataaataaataaataaataaataaataaataaataaaaagactgagatttgctaagcacaaagttctttgattatgacacaaacccactgcatgtgtagtattcatctggactgagtacaaacaagatgctcatgctgtgtgctgtgctgtgagtaataaagtcctttgtctctgaaaaaaaaaaaaaaaagaaaaaagaaagtatgttatagcagatgctcactcatcaacctgcc

SEQ ID NO: 1547 - DNA, 764 bp, Homo sapiens
ggatcttctggacaattcccggaatttcttgcagggcagcacttccccttaagtcgtctctttctcgtttggatagtcagtatttatatagtcactattctcttttggttagccatctaattttatactgctagtcaagctctactcccttccccctagagtttgaatttatttttcttcaaacgctacacaaacccaaataaactcaaccaaagcggactttacctaccttcctacctacctaccaagaaaatatcccacaaaggagagaacggagaagcttgcaatacaggaagaaaaaaaaagaattacagaatggaagggatgtgtgcgctaaaaatgcaggtacttaaaggaaattgggctgatttgtactggacaccgaatttgaggaatacaggatctcaacctttctttgactggattacttttttattccattttggtgtggacgcgtctgaaactgatagtgctgctgctacctaccataatgtgtttgttgcaagatccacaagaacgtggatgccaagaatccacaaaaaaaaaacagatgcaaccgttgatgaggccataagcagaaacaaaatctgaagagacacgcctgcccactcttcacagagggaaacatcttctaaatgtggggaacactgttcttgaaggttcatgatataatcctgactcacacttaaatcccggatcctttgtttccaaatctgccagcaatgaagcacttcttgagaaaggtaacttaaccccgttccctg

SEQ ID NO: 1548 - DNA, 503 bp, Homo sapiens
gaatgcaatggaattgaatggaatggaatggaatggaatcaacgcgagtggaatggaattgaatggaatggaatggaatgtaatcaacccgagtggaatggaatggaatggaatggaatggaattaacccgaatggaatggaatggaatggaatggaatggaatggaatggaatggaatggaatcaacccgagtggaatggaatggaatggaatggaaaagaatggaatggaatggaaccagtaagagtggaatggattggaatggaatggaatggaatgaaagagaatggaatcaacccgagtggaatggaatggaatggaatggaatggaatggaatggaatggaatggaataaacctgagtagaatgcaatggaagggtatggaatcgaatggaatggaatggcattgaatggaatcaacacaggtggaatggaatggaatggagtggattggaaagttatggaatcaacccgaatggaatgtaatggaatggaatggaa

SEQ ID NO: 1549 - DNA, 308 bp, Homo sapiens
cctccacgtcagcgatgtcactgctgcagctggaggcagtaactgtgggcctcccggaggactcgctgcccaacaggaggttgaccgaaatgctgatgcccttgacactgacatcaaaggagccctgtagtttgctggaggagatcgcttccaagataaagtattgcactggaattcttgccctaaagtctgcttctgtgggaagcaaaccaaggagacatgatattaccgcacttagccctcccatgactccatcaaggaagcaggcccgtcccctttgggagatgaggaagtagagactcagagac

SEQ ID NO: 1550 - DNA, 310 bp, Homo sapiens
ggctcatcagtgataacatatgtaccacactaatgctagttgttaataacaggggaaaccagggtggaggggggtgtatatgggaaatatctgtactttccactcatttttctagagttctaaaactgctcggaaaaaaaaaatctattagtttaaaaagaaaaaaatccctgctgggtgcagtggctcatgcctgtaatcccagcactttggtaggctgaggctggtggatcgcctgaggtcgggagttcgagaccagcctggccaacatggtgaaaccccgtctctagtaaaaatacaaaaattagct

SEQ ID NO: 1551 - DNA, 2106 bp, Homo sapiens
ggggtttcaccatgtggctaggatggtctcgatctcttgaccttgtgatccacccacctcggcctcccaaagtgctgggattacaggcatgagccacggcacccagccaaaaattttttttaattagccaggcatggtggtgcatgcctatagtcccagctacccaagaggctgaggtgggaggatcgcttgatcccaagaggtcaaggctgcagtgagctaggatcacaccactgcactccagcccaggcaacagagtgaactcctgtctcaaaaaaaaaaaacaaaaaaaaactactgctatatgccacaacgtgggtgactctcacagatgtaaaaaaagccagacacgaaagaaactgcagggtcattcatatgcatatacaaaattaatctttagaactcaaagttaaatagtgactacatttggagtgggggaaaggacggagagagaacatggatgatgaaaatgctctatgaattcatctgagtgtgtacatttgtaaaaggttgttgaaaatctcatttaagatttgtctacttggccaggcatggtggctcacacctgtaagcccagcactttgggaggtccaagtgggtaaggattgcttgaggtcagaacttcaacaccagcctggccaacatggtgaaaccccatctctactaaaaatacaaaaatccaccaggcgtcgtggcgggcactagtaatcccaactactcaggaggctgaggcaagagaatcgcttgaacccgggagcacaggttgcagtgagctgaaatcacaccactgcactccagcctgggtaacagagcgaggctccatatcataaaaaaataaaaaaataaaaaaagatttgtctgctttaccatacttaagttacaccacaatcacaaaggaaaaataaataaagcacagctgggagacatctgaaatgtgatttgatactgatctacatctcttttctcaccaatcctcagactaaggggccaggcagaacaaatcttccctacgtgccctctccatcaccagctggtggctttgatgtggcctccccttgggcaggcaccttcacacctcctggtgagacaggcagtaggtgaccccactgttcgtgctgggaagcagggtccctctgagacacgtgggcatgctcggtagctaatcaatttcatcccaccaaggctaaactctctaggcatgttttcatctgttcgtggtgtagtggaagaacgaaaatggcagaccacttctggtacagttaacttctccctcatcctcagcaattccactccagccccaaacttgttcactccactcagcaagaaagcagccatgctgagtgagtgtgttggttctgggttaagtagtgtccctcaaaaattcatgtctacctggaatctctgaatgtgactttatctagaaataggtatttgcaggtgtaataaattaaattaagattaggtcatactggattggcatgggctccaatccaatgactggtgtcctcataagaggaaaaaacaggctaggtacagtggctcgaacctgtaatctcagtactttgggaagccaaggtgggaggatcgcctaagcccaggaggttgaggctgcagtgaactgtcattgcaccactgcacgatcacagatcactgcactctagcctgggcaacagagtgagatcttgtctcaaggggaaaaaaaaaaaaaaaaaagaggacaatcagtgaagcctacacactcgaccactgcccataactgcctgcccagacagcacttgactgcaggagttaactgagcctttgctatgctaatctgagctgttgtcaagacaagaatattgaatgcagcagttcccaaagtggtttccttgcctccaccgcttaccttccaaccagccatccacaacgctggtggagttttcactcttaaaccaagtttgatcctgtatttcccttggagggaagcatctgatggctcccactgcctatgctgtccagtttcaagctctcagcctaaaccgtccaatatctgggccttgacattttagctttctctctggccagcctgacttccctcccctcccccaactcactaaatacccaatt

SEQ ID NO: 1552 - DNA, 476 bp, Homo sapiens
ggagaggactgagtggcccagatggaaagcagaaatgcagacagaggcctgtggaagaagaatcttaaaataactaagcaactccaagaaaacaagtgaggatttattggaaacaactgccttgaaagaagaaaaaaacactccaacttgaaaatttgagaagataatacagaaagctcatatacttcaagctatgggatgaattgtgttcaacaaagaaggaaagaacctttcctggctgaagtcagaggctgaggtcagaggaagacgtgactatagaagaatgatcataggattgcaatattgctggtcttgaagacagaggaaggatgtgggttacatctagaaactggaaaaggtgaggaccacacgtggaaaagggaggctgagaatgtaagacatcagcagagtgtggatctgatagctgtgttgggactaatggaagatagatggtttgagaggtaaggagatggctg

SEQ ID NO: 1553 - DNA, 7610 bp, Homo sapiens
ggaaaacatgaatctcagggtcacagctttattgtatagattttttaacacagccatgttacaaacattgtcagggaacatttacaagaataaataagatggacttgcaggtgtaaaaagattacacttcactgtaatgtacagtcaaaaaatatatctgatattcattgacctgacattatttaccttctgcttttctgagctagaattgaaaagaaaaaaaaaacattgacagcacagtgctggcttttttaaaaagttgatttattttgttttctcttctcatacgtgctttatctatcaaacacccaaactgtacaagtgcaggccattgggattcatggaggaggctgcaaagagtgtggagactttggtctcatgcaatattatatgcccagtggatgtgaagatgtcagcctccctggagttgagcgggaaccttgggatagcttgtgagggtgtccagaagccaaggcaatggtagaggccacaactctttgtctttgattggctagtagaatgtagggtgaaaagtgcttttgagtatgattaccaatatgggttaacccggatttacatgggctagctcaggatccacctggtgatgaaatgtgtgcactggaaatgattataatcatgtgtaaattgagttactgtgcttttgcttttgcagtgtgctccaacaggccttgaatagggagtggggtagaaataacctctggagataatgtgtatggtaagaaaagccctgctctgtgtcctacttggaccttcactggttctggctgtcactcatggccctgttggtcagtgggtctgagttatggctgctctcatgagagatctacatgggtattgggtctatggcaaagcagctgttccctatggtttgctgtttggtgataaccagcctggatcagcccagtatatgtggccacaacagcatgttggcctgctcagtgggggcacttgggtgggagagcagggggcttcagcctgtacagaccaaacacaatctacttggattcgtgctctacaggtatgaatgagttcaaacatgatcccagctccacaagatctcacccatctggaatggaagtgacctgaaatccatttcaccaatgcttctcttccctttaaagagacacctgccttcttttagacagctgctgagatgggcagcttatcctctctggcagacagcaggttcttccttacagctattaagtttcactcatgggtcctagttatactcagaggagtgacctgggtctagcaaactgtgcttgacttcatccaagaatctgcagagctatggaagatatggacaccatattctgcctgacccctcagaagcctaactttacatggaatgacaccactctgccctctaagcctccagactgccctggggcctttgacccaaagaacacctgacattattcatcttccatgggagatacagggacagggtggacactgagagtttgttggaccatcatagagaaggcccactgattttcagtgccatgcaaaagcccatccctggttactaaaaaactagaagagtctgctcatgtgcacaaatatggcttagatatctctgctgtgcttcggaggatcagatccatgatcctgaaaaatgtgtcagaagaaactggagctagaacagctccccccacactccaccactaacctctctccctgctgttcagtctatgacctcaaaggcagatccctgcaagacaaagccaaggccttgcattctatcacttctagacatgtatacatggaaaacctccaacagggaaactttgcatgggaggagtaaacaaatctgaatctcagcttgtctcttctagttggatttacttttcctatttccttgttttacttggctgtgatttgaagctggtcacaggctaagaaggagctcagactgttaagtaatggggaagccaagtcagggatttgagatgacatgactatccacgtttatgttttttttcttctaacctaccctccagttgggttgaccatttttttccctggggatcctggcccagcacaacctgttgacatgacttaggaacagcgtcctgttcatgcttcctcttgggctcacccatgtcttccagagtgttactcctggttgagcttggtgctgatgacctgtttacccagcccaggagtggcaagctgcagcctaaggaagggtggctttcttcattttgtcccaaggcagtgaggtaccaaggaattatcatttccttcaatgtctctggatctgggttgggcagtcactcctgcagaggtaacaggataagggcctggctgctactccctgggcctcacttctgttgtgtagagcagtcttactggactgatacctctatgtactctaaggggttcccaccagcgacgaggaaatgtagatcctggtgaggacttacagcaagagctagtgtggcaatggggagtggaggatgaataaacatgatgggtcagagggaaatgcatcatcttttgccccagacactgagatttgcccttgttccaagtggctctggcaagctgttacccatcctttctccagctatgtcacagaagtgaccattttgctaaataagtcatctgcatcctcggttctgagtattcactgggttccagtttcctggccttgcgttcctgttttcctgcctaaagtgctccaaatctaccccttctaatgttgatgagggtccttttttcatgtatgtttttcatgtatgtatgttttcgttcaaactaaagactgagctctgtccaccacaaccccatgccttacccaggaattaattgtgccatagtaatctcgatttcctaatagtgccccctccaaggtgctaggtgctgtaggcacccagtaattatgtgtggctagggtaaagtgaggagccttccagaccccagctgctcatgaagtgtgtcctcagacttgcccacattagcaaccatgtgactccacttggacaacaggcaccactttccagcctagcattcaggaatctgctgagtacagctgtgtccagcttctcttttccctttagggttttgtgggctcatccttctccacgccagatgagcaaatcctcatcattctagtgtgagttaatgggttccttccagcacccaactggaagatgccttagttgaggtcccctcatgaacagtgaggtcagagcacccacacaccaaaggagctgcctaggagaaggtcagttggtcttgatcttgagcctataactggctctgggaggcagcagggtcactgctcctagagtcaattctagggtcaagctgaagaccagctgacctagggtccgtcatagcggggtgaacagaacagaacaacatgaggaacagagcacatttttttttgaaatattcatagagtcatattaaaaccaacaaggctaaatcagaaagtggaatgcaaattttgcatgaattgtgaacgtaaaacatgagactatgaaggaattttaagcttactgttgtttgctttgagctttatccactgacgtatctgttccactctagtctcttctgttatgggtaacctcctgggaaaaatgtgagatacaatggtggaaaaatattgtctctgtagtgagaaaaaaccggtttaaatcctggttcattcactcactagctgtggaactgtgggcaagtgatttctcccctaggagccttagtttcctcatcagtaaatggtgacaatcacaaaccctcctttagaatgctggaagaatttaatgagctcacatgttagagtccccagcatagggtctgttggttcctttgcaggccacacccacagagagggccagcactaaaagcaaactgtccccttccattcccacaaagagaggcctactgtggccttctagaggcccaaggacccctggttggcccagattcttcaccccagaaaggatgcaatgttggagtgcagctaagatacatcctgaagctatttaggccataaacacaggtggagaaatttcctgggcttctcattacttccttgcatcttccccaaacagagcccacatctatgaggtaagagctcctgttgtaaagactcagagagcattaataatattttcctctgctcatgacaggctgagctcaccctgtaaatggggtggggtggggagaccccctgggggtggtggtgttggctccggagatttcctgggtaaaggaaaatgttcaaattcctgggcactggtgccccatctcatccaagccttgccacatccttgtcccatgggatcttagggaagtcatccccatccataagcctcaatttcttcctgtgtgcactggcctaagacctattcactgtcctgctttagagaatggttgggttgtgggaaaataaggggatgagctgggggaaatcatcactggcccttgctgggttaccccaacatggcctgagattttttttttttgcaagtttgtttctccctgaagtcacaccttaaattcctaccatttaaaatgataaaagccactgtcttttgtatctgccagctatttcaccccttcctgagcagaaaaaaatcttaggatttgtgttaaatagctctccctccaccctcatcctgtctggatgtaccaagatctaagaaaatagcatacagcaggcagatttgccatgctacaggctccttgcaggctggggaaggccagctggggcattgggctggagccgagggaggccagcaggcccagtgggggtgggtccccggggtctgctgaaatacacctggggagaggctcatcaaaggaaaagagcaagttcatcgtggggttcctttgcttgcctttgctttgaggcacttccttttgaacctctaaagtgacagcccttccttgatcaagtctggtgtccctggacttctggacagctccagagcccatgccaatggaagcaacttttgtcggctcctttcatgttccatcctcatgggcctggagatctgggttggtgaccctgctccgtggtaaagcagagaccctgggtttctcatagaatctgagtctcatgatccattgcatatttagttccagcaacaaaacaatgagcagacagacaaatagatgtgatattaaaaagtgcacgcttaagggaatgttttcacagtgtctgatgaaaggaaaagaggcagccccattggcccagaaggagtcttggccaacacgaagctgagtgcatctctctaaagctccatggactccttgttgccaataggacaaagtctgtactcgcgatgggcatctgtctcctggaccctggctcatctcttgctgctccccgtgttgtgctgtgcccgcactgggctggcctcccccagactgcttctcccaatgccttttcacatttctttgccattgcacatatggatccctttgcctgagtttcctttttttcctttttatgcttgttaagacccagcaggaatggacgtccccttctccaggaagcccgaggccgaagagactttcttgctcctaggctcatggaacactcatccactccacactactgcaccatggttccatttccccagcatacagtgggctcttgagggccaaagctgtaccttcttgaattctctgcccctcatgccctgtctggggctagaccagccttcaagatggagcttcctaggtcccagcccacctgaggctgtcagatattgggcctaagcactggctagagatcaaggtcgagagtttccctggctggtccattcatagcctgaaggaacagggaattgtttttactgactaagaaattagatgagactggctttcctggggagctgggaatgtgttactaaaatatatctgaaattctgcgcttcccagaagaactggcatcaggaagaaagtactaaatttccatttgtggagttatctgctcagaagtttctggccttattttccctccataaaataattgcttggcttagagaagatgaagaaaacagcacggagaagtctcattgccattacctgcccctttggaacccaggatttcattactaaggaaggtgcgtgggtttcctcattggaggagatgatcaaatggagatgataacaagtcagtagctctctcctgggggttctaaggactgtgtgaaatgtcctatggaaagtgccaagcatgatccctggcatacagtagagacttagcaaatgttggttccctctcattgactcactcacactttggacaagaccctagatctccaggcctgattctcttggcctattttaaatcaaagtataatgggctccacaatggcctttttcaaggtggctgctgggtttctttaggaaggagttcaaatttggacatccaaattatgcacaaagctggtgctctatttgccccagaaaccaaagggaccatcttcaggctcacccatctctccttgctcagtggcatgctgtcccagggtgggagcttttaaggacattgccaggaaaaaataaaaggcccgagagatttgtcttagaggtacatactcaaactcccccgcccccttctttttgacataagagactaagattttacaccctccaaaagaaagtttcttttcacatacactttggaaaataatcaaatcttatcttgtttgtctcttccaaagaaagctaccaccaaagaaacacaggggttacatcctacaggtcagcccaagccctgccccagggaggtggtccctttttacaaagacaaggaggagcagagaagttccctgcagttccaccccctcccactgaccacacaaaaaagcaaagaacacctttatcaaaaactgctgtggacacagctggccggccagtgaatgctggacggtcaaggcccaggctggggaaggggtacagaatggttgtgggcgaagccccatgcaggttaggtgtgaggatggggggcctctcttgtggcctagggaacatcgtaaggtcacactggtccagactgcaaatgtctggtgccagaggcccctgaaggaggttgcagggggcagcagagcagtgacccccaagagcctcaatcttttccatgacgtagaggagcagaacacacatctcctccactcctaaggagaaggagggcaggggagcctcccactccccagcacctgcacagttggcttgccaagagatccacaaactcagaacaaaagcaggtggtctgggagccagaaatccaaggccttgcttgtgggtgtacttctgcttgggcccttggctgtggctggttaggttgaaaaggaagcctgggccttttggagcagcatctcccacggcaacaggagacccctcagaaggtgcagagccccccgtggaacacagggccaccagtcttctccttggagtcaggcagggtgccacctcagagctcctgagcccagttactgccattcacacaaaagggggcttggtcacagcagcctctggactccggcaggttccccatcccattgagctaaaaggagcttaaatattccagtgccacctcgtatacaaatttatactgttcc

SEQ ID NO: 1554 - DNA, 1007 bp, Homo sapiens
tgcttggactcacagtacatcttcagatcttcagagaagttgtatgaactaccctgtcttggaacatcctcaggaggagaaactggaacacacttttttctcctgcctttggacatcggaactccaggctctccaggctttccagactctggacttaacagcagtctctggacttacaacagcagccccctggatcctcaagcctttggcctcagactaataattatatcagcaacttcctggttctgaggcttttgggcagccatgctactagcaacccagcagttccagcagaaggcctgttgtgggacttctcagcctccatgagcatgtaagcttgcttaaaagaactccagatggcccgggagctgcaggaccctttgccaattatcagaggaagataaggcctgtgtgaaaccgggacaaacctgaaccagcgaccccgtgttacctttagatcattaacatatcatcataatgctaaaacctcacccatagaagataattgctgccattttctgaatatacattatatgaagaagcatgttcatgatctgcacctgcacatctggagttcctccccatacatgtttacgtacctccctgccccacatctaactccttaaaatcccccagcttctcatatctcagggagaaggagtctttagagaaagagctccctcctccattcctggccaggaataaaacctgcttgccttttttcccaattaggtgttacagtagaactcagttaccctgtaacaataagaattgcattaaatccttatatcaacttgggaagaattgacagctttaccatattaagtcttctaatccataaataagtatgttcatccatttttttagatttttgaaatttctttcatcagcattttgtagttctttgcctcactatctagatcccaaatattttctgttttttttttctgaaagttttatctcttacaatttaaacctgagtagttctcagcatgcaagccccatac

SEQ ID NO: 1555 - DNA, 810 bp, Homo sapiens
ggtgtgatctcggctcactgcaagctctgcctcccgggttcgtgccattctcctgcctcagcctcctgagtagctgggactacaggcgcccaccaccacgcccggctaatttttgtatttttagtagagatgggggtttcaccatgttggccaggctaatctggaactgcagacctcaggtgatctacccacctaggcctcccaaagtgctgggattacagatgtttgagccactacactcagcccattcttaattcctcctttgctctcatgcctgaatttacccaaatcttcaggaagaactctgcactcctcttcctaaacatatcccaaatctctgcactcatctccacctcccctactatcaccctagtccatgcatctcaacagggaccatatggcccccaacggggcaaaaataatttttagggggtgaaaaaatcttatcttactattccttttatgtacaaagcactctgtgtgtgtgtgtgtggtgtgtggtgtgtatagacagtacataaacagatctacaatattttcaaatttcatgaaagttcactcttaggtaagtacctatccaaaattgaaaataggtacacaaacaaatccttggatacgaatgtgcacaagcagcactgttcacaataggcaagaggtagaaacaactgactgtccatcaatggacaaactgaagtatccccacaatagaacgttaccgagccataaaaggaatgaagttctgatacgtgctgcagtgtggctgacttgaaaacatgatgctaagttaaagaagccagacacaaaaggccc

SEQ ID NO: 1556 - DNA, 250 bp, Homo sapiens
gaggctgactgggcagggtgttttaagaacatcagagaaggctgggcacggtggctcacacctgtaatcccagcactttgggaagccgaggtgggcagatcacgaggtcaggagatcgagaccatcctggctagcgcggtgaaacaccatctctactaaaaatacaaaaaaaaaaaattagccaggcttggtggtgggcgcctgtagtccctgctacttgggaggctgaggcaggagaatggcatgaacc

SEQ ID NO: 1557 - DNA, 4158 bp, Homo sapiens
atttagtgagaggaaattaaatatcttctagaaacatctagtaacttttaagctaatgtaatagaggaaatactacattatatgactttgtaaaaagtatttctaaaaaaatttaaagggggctgggcatggtggctcatgcctgtaatcccagcactttgggaggccgagatgagtggattgctttagtccaggagttcgacaccagcctgggcaacatagcgaaactccatctctacaaaacaaaaaattagctgggcatggtggtatgcgcctgtagtcccagctactagggaggctgaggtggcaggatcacttgagcccgggaggttaaggccatagtgagccgtgattgcaccactgcactccaaccagggcaacagagcaagaccctgtctcaaaaaatataaaaataaaataaagagactttgaaatcatatcacctaagtaattttttgacaattgaaatggtggtgggagcggggaggaagaacctaacatcaagacatccaccttgtggaaagatatggtaattacaggcctacatttattatacattggaagtaaagtcaaagtttttagctatgtacctacagtccttcaacaacaaattcaagctcagaaatgcaaaatcctaatcgtactattaaaactgctattactatatgcttccgatacccatttgtctagtttttttccagagacctttttctccatttttcatatgaaaacatctcagaagatattcgtaagcaagtgaacatatgaaactgaatatatgaaaaatattttcaaaaagtagatttctataaatcccatttgcttatttagctgcaaatttatttacagtgatgatactaggaacatactactagttcaaacaaaaaatgtttgttcgaatgaacaacagaaagtactggttagcagttccatagttctatgaaaatagagcagtatttttaaagtaataaaaattttcttaaaaaaccttttcaaagtttttaatctcaactgtaaatcttaaagatataaatggggaaattctaaaaattcagttttcttactaagcaatgggaggaaagaaatctggatatatggtacatatgacaataatttaatgtttcaagttgcagacatgttacatatgtgtattattcctttctaaatgcagtttattatcccttctcaaaaatacatacactgaatgtattactacaattcaggtgtgttccctaaaagactggtctataccaccagtccattctctgctttccagatagcctacttcttaattataatggtgacacctgatgtggcagaaagcacaatctccagaaccacctatcatcttgcttcaatttttacattccaagttagatttgtttgttgatattatttgctggtattttattttgctcaaaattctacttgtttattcatagcatatatgattcttccatactttaagttttaattagataagaaacttatacactaactgtatgtggtttaactgttaataggtggtaacagaatggttaaagaactaactccagcaactgtgaagctcaacactaggcactgaactcagagttggcagaatttgtcactgtagactacaaatttcatgttgaattaaatgctgtatgaaaaccactccatctattattcatttaaaggatctgctggccttttaagttggtgttggccatccataatactacgatttggtggcaatgagatcactacagtaatggctgtagaatttagtatttaggtttctgcctagctatactaacgtaaaatttcttctcttccatgtccttttccatgtgtacttctgggacagttaccaccttacagctctatttggttgaggacatgcggtaaacctacaccagggtgttagattacaatccagatatctgtccctaccccaatctcatgttgaattgtaatacccagtgctggaggtggagcctggtgggatttgtctgggtcacgggagtggatccctcatggcttggtgctgtcttcacaatagtgcttacagctataaatatccctccgagcactgctttcaacggatcacgttttggtatgttgcattttcatttgtcaaagtattttctgatttcccttatgagttgtcccttgacccactggttaagagtgtgtgtcactggagagttttatgtaagggagtgacatggtatgatttatgctttagcaagacagtgttggctgctaagtgaaaaaagtgtggaagggaaagtataaatgctgaaaagccattgtaagaggccgttgaaattgtctgtgtgagaaattatactgacattgtcacagagacagtgcaagtggcagaaagtattcagatgtgggtcatattttggcagtagaatctataggaattgttgatgaatttactgtttggctaaaaggaaaataattcaggaattactgttaggttttggtttgaatagttgggtagttaaaagtaacttcattgagataggaagacaaagtttactttttctttgatgaagagaaagaatggtaagggagacaaatcaagttattttgagagttgagattcttattagaaacgtcaatacagcagtatttataatgttctgatgtccaaagtgaaggtcagaacgtttataaatttgagatcatcaacacagaaatagttattatatgggactagatgaaattacttaaggtgaaagtactgactgaggaaaagaaagagactaggaatgaacccaaggaaaagacacagaagagtagcaaatacatgccagcagaggattttaagcatgaaatgccactgagaggctatgttgccaaatctaatctgtttttacttaaatgactgttgattttgataaaagtagttttgatgaaatagtaggggcagagctgcattgagggaaggaagcaaagaagttgagatagtaacctgagaagattattctgatatattctctgtaaaagtgaatggataattatatgggtagggcagtggtttcaggagaacttgatgtcaatggaagcctatttatttacttatttacttatttaattaacatggactataaaaatcaggagaggaaaatcaaagataatgggattaaaacccattaatcactagtagggtgattgttcttaaataaacaaatctgctattggactgaaagagaaatcagaaaatgctggtcttgatgcaggaaacatgttagattttagggtgaagatgagaaaattatgaggttagacaatcagctcaaaggtaaagaatcaaggaaagaggtatttatatgcaataatactctggaaatgtggtaaagccaattaaagagagcagagtaaggactgttgagcaatgttgagtgcccatttgaagtacgtggccatacatttaaagcctgattgtattattttctcctgtgctgttcaattggtagaatgacagctaagaattagtggataaggttgacaggaagagaaagggcaagagagtattattttgaactctggcatctagaatgggtaaggaaggaaggacagacaagaaggtaacaggaatagagaaaaagtataaatagcctgagactactatacaaagcaagttggaaagataggctggagtgataatgttggaaattgaggtttagaggggcacaactgctggtaatgataggattttagaagagttggaaagaataaagaacctgggatggattacacatatagtacagtattgaaatcaagtatgaggtatgatttaggagtcttggaaatttggctgacgatgaggtaaacagggtgataagacatgatgcaattagtctcacagggcaagatggatttgcaagtcctgagtggtatttaatattgtaacgctgtcactctcttaaaatagcaaccccgctactctatcaataaatcttagctgatgctaataattgcataaagctgaccaaaatgagaagggttttaagaagccagttttcccactgtttaattactggtattatttttgaataatactctgctaccattaaatagacaagggatagtaaagctacttagcattatactttggatcaaataaatatccttcttcagatacccaatgttcacaaaata

SEQ ID NO: 1558 - DNA, 1871 bp, Homo sapiens
gttaccaccttacagctctatttggttgaggacatgcggtaaacctacaccagggtgttagattacaatccagatatctgtccctaccccaatctcatgttgaattgtaatacccagtgctggaggtggagcctggtgggatttgtctgggtcacgggagtggatccctcatggcttggtgctgtcttcacaataccttgcatcccagggatgacgcccacttgaaaaagagcccgcattgccaagtcaatcctaagccaaaaaaacaaagctggaagcatcacgcctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggtaataccattcaggacataggcatgggcaaggactgcatgtctaaaacaccaaaagcaatggcaacagaagccaaaattgacaaatgggatctaattaaactaaagagcttctgcacagcaaaagaaactaccatcagagtgaacaggcaacctacagaatgggagaagatttttgcaatctacttatctgacaaagggctaatatccagaatctacaatgaactcaaacaaatttacaagaaaaaacaaccccatcaaaaagtgggcgaaggatatgaacagacccttctcaaaagaagacatttatgcagccaaaagacacatgaaaaaatgctcatcatcactggccatcagagaaatgcaaatcaaaaccacaatgagataccatctcacatcagttagaacggcgatcattaaaaagtcaggaaacaataggtgctggagaggatgtggagaaataggaacacttttacactgctggtgggactgtaaactagttcaaccattatggaagtcagtgtggtgattcctcagggatctagaactagaaataccatttgacccagtaatcccattattgggtatatacccaaaggattataaatcatgctgctataaagacacatgcacacatatgtttattgtggcactattcacaatagcaaagacttggaaccaagccaaatgtccaacaatgacagactggattaagaaaatgtggcacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacaatgagaacacatgggcacaggaaggggaacatcacacaccagggcctgttgtagggtaggggaagggggagggatagcattaggagatatacctaatgttaaatgacgagttaatgggtgcagcacaccaacatagcacatgtatacatatgtaactaacctgcacaatgtgcacatgtaccctaaaacaaagtataataataaaaaaaaaagataagggaaagcttgcagcttcttagagattggttaagcggttgtgaccacaatgctgatagtgatatggacagtgaagtctcggttgaagaggtctcagatggaaatgaggaacttacaaggagctggagcaaaggtcacacattttacgctggatgc

SEQ ID NO: 1559 - DNA, 492 bp, Homo sapiens
gttaccaccttacagctctatttggttgaggacatgcggtaaacctacaccagggtgttagattacaatccagatatctgtccctaccccaatctcatgttgaattgtaatacccagtgctggaggtggagcctggtgggatttgtctgggtcacgggagtggatccctcatggcttggtgctgtcttcacaatagtgcttacagctataaatatccctccgagcactgctttcaacggatcacgttttggagagataaaggaggatacagatacaaagatgtttggagacggagggtcaaaatgtgtaagtattcttacctgaaaaattcatgttcttctgaattaccacatcatagtgaaagcaaaaaaggcaaggttaaggataacttaaaaatttaaatagcagctgttagacaactggagagggatggcaactatggacatggaagactgccaagtagcagtgagagtccaaagttggaagctggag

SEQ ID NO: 1560 - DNA, 5050 bp, Homo sapiens
cttttatttcattgagcagtgatttgtagttctccttgaagaggtagttcatgtcccttgtaagttggattcctaggtattttattctttgaagcaattgtgaatgggagttcactcatgatttggctctctgtctgttattggtgtataagaatgcttgtgatttttgcacattgattttgtatcctgagactttgctgaagttgcctatcagcttaaggggattttgggctgagacaatggggttttctagatatacaatcatgtcatctgcaaacagggacaatttgacttcctcttttcctaactgaataccctttatttccttctcctgcctgattaccctggccagaacttccaacactatgttgaataggagtggtgagagagggcatccctgtctcgtgccagttttcaaagggaatgcttccagtttttgcccattcagtatgatattggctgtgggtttgtcatagatagctcttattattttgagatacgtcccatcaatacctaatttattgagagtttttagcatgaagcgttgctgaatcttatcaaaggccttttctgcatctattgagataatcatatggtttttgtcattcgttctgtttatatgctggattacgtttattgatttgcatatgttgaaccagccttgcatcccagggatgacgcccacttgaaaaagagcccgcattgccaagtcaatcctaagccaaaaaaacaaagctggaagcatcacgcctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacgattccctatttaataaatggtgctgggaaaactggctagccatatgtagaaagctgaaactggatcccttccttataccttatacaaaaattaattcaagatggattaaagacttaaatgttagacctaaaaccataaaaaccctagaagaaaacctaggtaataccattcaggacataggcatgggcaaggactgcatgtctaaaacaccaaaagcaatggcaacagaagccaaaattgacaaatgggatctaattaaactaaagagcttctgcacagcaaaagaaactaccatcagagtgaacaggcaacctacagaatgggagaagatttttgcaatctacttatctgacaaagggctaatatccagaatctacaatgaactcaaacaaatttacaagaaaaaacaaccccatcaaaaagtgggcgaaggatatgaacagacccttctcaaaagaagacatttatgcagccaaaagacacatgaaaaaatgctcatcatcactggccatcagagaaatgcaaatcaaaaccacaatgagataccatctcacatcagttagaacggcgatcattaaaaagtcaggaaacaataggtgctggagaggatgtggagaaataggaacacttttacactgctggtgggactgtaaactagttcaaccattatggaagtcagtgtggtgattcctcagggatctagaactagaaataccatttgacccagtaatcccattattgggtatatacccaaaggattataaatcatgctgctataaagacacatgcacacatatgtttattgtggcactattcacaatagcaaagacttggaaccaagccaaatgtccaacaatgacagactggattaagaaaatgtggcacatatacaccatggaatactatgcagccataaaaaatgatgagttcatgtcctttgtagggacatggatgaagctggaaaccatcattctgagcaaactatcacaaggacaaaaaaccaaacaccgcatgttctcactcataggtgggaattgaacaatgagaacacatgggcacaggaaggggaacatcacacaccagggcctgttgtagggtaggggaagggggagggatagcattaggagatatacctaatgttaaatgacgagttaatgggtgcagcacaccaacatagcacatgtatacatatgtaactaacctgcacaatgtgcacatgtaccctaaaacaaagtataataataaaaaaaaaagataagggaaagcttgcagcttcttagagattggttaagcggttgtgaccacaatgctgatagtgatatggacagtgaagtctcggttgaagaggtctcagatggaaatgaggaacttacaaggagctggagcaaaggtcacacattttacgctggatgcattctgttcatgccttagggatctgtggaagtttgggcttgagaatgatgacctaaggtacctggtcgaagaaatttctaagcagcaaagtgttcaagaagtgacgtggctgcttctaacagcctatgctcccacgtgggaacaaagaaatgactcaacattggaaattatatttaaacagaaaatggagagtaaaagttttgaaaattcacagcctggctgtgtggcagagaaagaaaaagctattttgggagaggaattcaagcaggctgtggagcaaccacttactagagatagtggcataactaaaagggaaccaagtgctactatcaagacaatggggaaaaggccttgaaggcatttcagagaactttcattgcagcccctaccacaaggggcccagaggcctagggtggaagaatggtttgtaggccaggcccagggcccatatcctgtgcagcctcaggacactgctccttacatccctgactccagctccagcctcagctcaaagggccccagatactgcttatgccaccactctggagagcacaagtcaccgtaagccttggtggtttccacgtggtgttaagcctacaggtgcttacagctataaatatccctccgagcactgctttcaacggatcacgttttggtatgttgcattttcatttgtcaaagtattttctgatttcccttatgagttgtcccttgacccactggttaagagtgtgtgtcactggagagttttatgtaagggagtgacatggtatgatttatgctttagcaagacagtgttggctgctaagtgaaaaaagtgtggaagggaaagtataaatgctgaaaagccattgtaagaggccgttgaaattgtctgtgtgagaaattatactgacattgtcacagagacagtgcaagtggcagaaagtattcagatgtgggtcatattttggcagtagaatctataggaattgttgatgaatttactgtttggctaaaaggaaaataattcaggaattactgttaggttttggtttgaatagttgggtagttaaaagtaacttcattgagataggaagacaaagtttactttttctttgatgaagagaaagaatggtaagggagacaaatcaagttattttgagagttgagattcttattagaaacgtcaatacagcagtatttataatgttctgatgtccaaagtgaaggtcagaacgtttataaatttgagatcatcaacacagaaatagttattatatgggactagatgaaattacttaaggtgaaagtactgactgaggaaaagaaagagactaggaatgaacccaaggaaaagacacagaagagtagcaaatacatgccagcagaggattttaagcatgaaatgccactgagaggctatgttgccaaatctaatctgtttttacttaaatgactgttgattttgataaaagtagttttgatgaaatagtaggggcagagctgcattgagggaaggaagcaaagaagttgagatagtaacctgagaagattattctgatatattctctgtaaaagtgaatggataattatatgggtagggcagtggtttcaggagaacttgatgtcaatggaagcctatttatttacttatttacttatttaattaacatggactataaaaatcaggagaggaaaatcaaagataatgggattaaaacccattaatcactagtagggtgattgttcttaaataaacaaatctgctattggactgaaagagaaatcagaaaatgctggtcttgatgcaggaaacatgttagattttagggtgaagatgagaaaattatgaggttagacaatcagctcaaaggtaaagaatcaaggaaagaggtatttatatgcaataatactctggaaatgtggtaaagccaattaaagagagcagagtaaggactgttgagcaatgttgagtgcccatttgaagtacgtggccatacatttaaagcctgattgtattattttctcctgtgctgttcaattggtagaatgacagctaagaattagtggataaggttgacaggaagagaaagggcaagagagtattattttgaactctggcatctagaatgggtaaggaaggaaggacagacaagaaggtaacaggaatagagaaaaagtataaatagcctgagactactatacaaagcaagttggaaagataggctggagtgataatgttggaaattgaggtttagaggggcacaactgctggtaatgataggattttagaagagttggaaagaataaagaacctgggatggattacacatatagtacagtattgaaatcaagtatgaggtatgatttaggagtcttggaaatttggctgacgatgaggtaaacagggtgataagacatgatgcaattagtctcacagggcaagatggatttgcaagtcctgagtggtatttaatattgtaacgctgtcactctcttaaaatagcaaccccgctactctatcaataaatcttagctgatgctaataattgcataaagctgaccaaaatgagaagggttttaagaagccagttttcccactgtttaattactggtattatttttgaataatactctgctaccattaaatagacaagggatagtaaagctacttagcattatactttggatcaaataaatatccttcttcagatacccaatgttcacaaaata

SEQ ID NO: 1561 - DNA, 7182 bp, Homo sapiens
ctcctcactcactgtggcccccagccccactgtttcacaacaccccagctcgttcgtgccctgaggagagggaccatccgtccccacacccggtccacagcaccgcacccgactcagccccagcatcgaccagaagtccccggccctcagaccggccgcccagagacagtgggagtgaggaggccacacaccgtccaggttgaatcactgcgttttactgagtgcacaggtccacctggcgtccgaactcgtccccgtggcagcagggatccccagaaccttccacggccatcgcggccgcaggaccccacacccgaagtcccccgcaaacccgcactggcgcattcttacggctctggcatcaacctgtccgtgtgagtaagttaatatctcagctaatctgttagaaaactagagttcattccctgggcgtctatccctagaaaatggacggtgcacaaagttgagattgaagtgtgcggggtaacacatccaccaaaaaaaggcctggtcactacggcacaaggacacatacaaaatggtcagaagtgtacgtcggtactgaaggcattatgaaatgttctttggagcatgaacaaaagtgcagacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcctgcctggtagccccggggaccggcccctccttgctggcgcctggccgagagtcagacgctgaggacctctcaggacggggcccctggccagagccagtctcctcggccagccaggggcaccacggcaagtgtccaagcccagagcacactcaactccaccccacaaacgccttttaaaactctgaagaggcccctccatcccaaatggtcccctcccgtctctcctcctccaccgttgcccacaacctcccccggcgatgtcacctcctcccagggtcggccgtcagcccccacccttacaagacggcaaagttcagcaaactggaacccccattcactcatgctcccgggtcatggaaagctcctgggtgtgcagcttctctaggtctcccggagggacaggaacctgcgtattccctcgaccccggagtccaccatcccacatccttcaggaagccgccctggctgtctctccggctgcttagcgctttgctggggccgaggtggagactgcgcgctgggtgggaatgcaggatggctgcccggcacagccacacaggctccccaggcggccattccgtcctgcagcccctaaaggccctgaccaggcctcttcacgccacccccatgccctggacatacgtgcatgtgacctgggagttctgcatgggtgtgggggttgggggaggcaccggacaggatcagaggacactgggggcacccgtgcactgagcacccacccctcagagctcagccccctgctgggcaccctccacagcaggtccaagcctcgtgagccgtccctctcacgccacgtctgccgggcaccctccacggcaggtccgagctttgtgaaccgtccctctcacgtctgctttgagggtttgtgtcaatggggctgtgcagcatcaacctgtgatcttgccaatgccccagcctctgctctgtacggcattcatagctcaggagggcggggacaagggcgtttctgcaaagctctcacagctccttctgctcctcggcttctgggaagcaactagaaatagctgagagcccagctctttctagagagaagggggtgtcctttatgggggtccctgactgtgggggaccgagcccagctggagtcctcctccccttctctccggcagcaggtctctctggcagcagggtctggaatctagaaacactgagacctccagccccgaagggggcaaacattaaaccacacgccctggctgtgcctctcctccgggcgggacttggggtgatcagacccacagctcaaagggtgccccctggagaagccctcacagtgcctggggtgatttcagcctccaagggggggcttgagacgaggccccccaaaaggtaggggcatcgctgaggggcagcgtgtcctccggtggggggtgttgggcacctgccctgctcagacggctgtgtgcaggaggcatgggaggagccctcccccagcgtgtcccagccgtggtggcagctggaagactcacggactgtgattttatgcagagggagaaggagaagctgggccaggaaaccacaacaggcagcagcacctgcctgggctggggcctgggattcgaggctgagccacccatcccaggagggcccagcacctccagggcagaccaaacacaggacccaaccggacacccatacagacaccggggcaccttggcatctggtagagcccctcctctggatggctgccaggctgtgggagggaagggcagcacgagaccctgattgggctctgcctggcgctctgccactgcggaccaggagcccggacagtcggataccccacgacggcgcttgacattccagcatcaccacgacccctaaagccacaattactccttgtagcccctccccaggcagcttacactcagcagggtcaaagagaaagaccagagacagaagggctccaaggctggaagtgcgaggagtgtgcatgcacgcgtgtgtgtgtgcatgtgtgcagtgtgctctgtgcacttgtgtgtgctgtgtggtctgtgcacctgtgtgcatgtgctgtgtggcctatgcactttgtgtgtgcatgtgttagtgctgtgtgtggtctgtgcacttgtgtatgtgtatactgtgtgtgagctacacgtgtgtgcatgtgtgtgatctgtgcacgtgtacatgtaagcgtgcatgtgtatgcctgtatgcaggcatgtgtatgcacgtatgtgtactgtgcatggtctatacaggtgtggtcagtgcacatgtgtgctatgtggtctgtgtgcatgtgtgcaagcgtgcatgtgtacgcctgtatgcggacatgtatgtgagcacgtgtgtgtgccagtgggcacgtagggatgtgcactctaacaaacactgcgggagctctttgccatgaggtggcactggtccttggccacgctcattcacgcagacacccgaggcagcgccgcaccacctccagcctccttcccgctgcacttctctgaggtggggcagtaggtggctgcactgctcaggctagagtctgggggggcccaagacagaccctctacccctttgtctcccaaaacagggccccgcaaccatcccaggacgtgcaccttccctcttcccagggcccagagacttcccaggggacacaccacacgttccttgctggacatgagtctggcctcagtccctcctgctgggcggccagcttctgggagggaagggattggcctgtcttcctcatcctgcagagccccaacctgtgcccaggtgctcatgcctcagcggccccatgggaggaaagagcaggcggggcctcacctcgggggaggaaagagcaggtggggccatactgggagggaggaaagagcaggtggggtcacacctcggcaggggaggaaagaacaggtggggccacaccttggggggggaggaaagagcaggtggggccatactggtgggggaggaaagagcaggcggggccacacctggcgggggaggaaagagcaggcggggtcacacctgcagggggacacacagcacagcctccctccactgccaggtctcccttctccagggtcctggagtccaggtagctgagacggaactggggacacggggagcggtggccggggctggtgctgcgttgggtgggacgcactcatacccctgcctgtgggccccgctatggattccctgccccatgacgggacggcaaagggacatggaccccaggctcgagccagcccaagggagacagcaagggcaccgccgtgaaacgctgcccccaaaacacgtagcgatgcccacaccagaagggatgcttcatgccaccgcagggcccgaggccacacacgctgcctttgggaacagagcagacaggcagtgggagcctggacagtggcttccgaggcctcccagttggcacctttttgggacaggctccagcacagggaggggtgaggagacagcccagcggaggcacctcaatggcgacagggcctgggagtgccctggccgggctgggggtaggcagagaggccagggcagcagctccccacaatggacgccagacatggctccccgaacaccctgagcgccaggacccccaccagccaggggcgtacgaccctcaaatgctgctttcaaagtcctctccctcaggactggttcccctgctggcctcagggcctcaggacctcccagccaagccaagtgcactgaaaacgcaggtggaggagaaacgggcccaggactcccctgcacttgctctgcaggagtatttgcgcccacgaccccagccctgctcactcccagggaggccactctccagggagcccaggcccgcctgcgacgccgtcacgccaaatgccagatgctcccggggtctggttcttaagtctggagctagggactcgctcccgcattagagccgcctgccccaagggccacggtgcccacaacaggacgggcatgggacggtgcacccgaggcccgagaccccaagaggccccgctaaggaatcggtcagtggagaaggggccatcagctccagggggcaggagagctagggagggcgcacagctgggctgaggtgggagtggtttcctccggaaaggcggggagggcggccctgtgctgacggtggaggctatcctggcccgctgcatcatggcccagccctgccccaggtctgtcggggcactggtgggacacaggcgaggtggggccctggctaagaactgtgaggcctgctcaccaggtgggtctcgcagtgccggcacccggccagggcagtcaggagagaggggaggacttggggtcctgcccccccggtctccaaggctggggtgctgctggctctcacgcacccacagaaaggccagggcgaggcagctggagcccccaaggaccccctttttgaagaccctttggagccggctccctggccccaccgtgagccaggccctccctctggaggccaagaccagagggctggacgtccactctggctccagtttggttcccaggccccacccgctcctcggctgcaggcgaaggtctccacctcggggctggcttccatggaaagagccctcagatcccagaaggtacagggagaagacgccaaccaatagctctgtatttgggcgcccctgaggtggggaacaggaaagcccgccgggcaggtcaggtgtgaaggcagaggccacgcacagcggccggccacacccgcctgtagctgcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagagtggacagggcagccttgctcctgcacgctgctcctggagccacagggccctgcccagccctccagcccctgttggaaaataacttttgtaaaaggtcactgccaggagcccccatccttcagcccacatgggcccctccagggcccacccttcccgccacactcagttactgtaagaaaagggccccagagggttcccgcctcaaaacctcggaggcaccgtgctgaggagggccgcgggcgggtccactggcccagcgccgcctcacttcctgggcccggcccagcccacgtcaccaaagggaccctcgccggtggccgagcgtggcgggggcccgcacggggtacagaggtcggagtcggtgtctgactctccctccgcaatgtagggcctgactttggcacaaggcgccacggccgcgtagcagctgttgagagcatccaggttctccttggactgggagatgctgaagccgctgaaggaacgctccagctcctcgtggtccacggacgggatggagatggacgtgtcgctgtcccgcaggttcccctcggggggcctgcagcccggggtgtcctcctgccgcaggaactccatgctggcgcggttgcccccgccgtaggcggacagcgaccgctcgtgggcaggcggcggcgggatgcgcaccagggagccgtggtcccccacgggggaggtgccgtggccctggcgcgggtggctctgtggctgccaggaggtggagggcggacactggacagggggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccatccgctgcatgtagatattcaccaggaagtccagcttcttctccatggacaagacctgcaaaaggggctgctgggctggggtgcgagggcccgtcccaggagatgtggggacccaggctgctcccaggaaatgggggggcccaggctggttccaggaaacaggagagacccaggctagtcccaggaaacgggggacccaggctagtcccaggagatgtggggacccgggctgctcccaggaaatgggggggcccaggctggttccaggaaacaggagagacc

SEQ ID NO: 1562 - DNA, 7529 bp, Homo sapiens
ctcctcactcactgtggcccccagccccactgtttcacaacaccccagctcgttcgtgccctgaggagagggaccatccgtccccacacccggtccacagcaccgcacccgactcagccccagcatcgaccagaagtccccggccctcagaccggccgcccagagacagtgggagtgaggaggccacacaccgtccaggttgaatcactgcgttttactgagtgcacaggtccacctggcgtccgaactcgtccccgtggcagcagggatccccagaaccttccacggccatcgcggccgcaggaccccacacccgaagtcccccgcaaacccgcactggcgcattcttacggctctggcatcaacctgtccgtgtgagtaagttaatatctcagctaatctgttagaaaactagagttcattccctgggcgtctatccctagaaaatggacggtgcacaaagttgagattgaagtgtgcggggtaacacatccaccaaaaaaaggcctggtcactacggcacaaggacacatacaaaatggtcagaagtgtacgtcggtactgaaggcattatgaaatgttctttggagcatgaacaaaagtgcagacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcctgcctggtagccccggggaccggcccctccttgctggcgcctggccgagagtcagacgctgaggacctctcaggacggggcccctggccagagccagtctcctcggccagccaggggcaccacggcaagtgtccaagcccagagcacactcaactccaccccacaaacgccttttaaaactctgaagaggcccctccatcccaaatggtcccctcccgtctctcctcctccaccgttgcccacaacctcccccggcgatgtcacctcctcccagggtcggccgtcagcccccacccttacaagacggcaaagttcagcaaactggaacccccattcactcatgctcccgggtcatggaaagctcctgggtgtgcagcttctctaggtctcccggagggacaggaacctgcgtattccctcgaccccggagtccaccatcccacatccttcaggaagccgccctggctgtctctccggctgcttagcgctttgctggggccgaggtggagactgcgcgctgggtgggaatgcaggatggctgcccggcacagccacacaggctccccaggcggccattccgtcctgcagcccctaaaggccctgaccaggcctcttcacgccacccccatgccctggacatacgtgcatgtgacctgggagttctgcatgggtgtgggggttgggggaggcaccggacaggatcagaggacactgggggcacccgtgcactgagcacccacccctcagagctcagccccctgctgggcaccctccacagcaggtccaagcctcgtgagctgtccctctcacaccacgtctgctgggcaccctccatggcaggtccaagccttgtgaaccgtccctctcacacgtctgccgggcaccctccaccaggtccaagcctcgtgagccatccctctcataccacgtctgctgggcaccctccacggcaggtccaagcctcatgagccatctctctcccaccacatctgccgggcaccctccatggcaggtccaagccctgtgagccgtccctctcacaccacgtctgctgggcaccctccaccaggtccaagtctcgtgagccgttcctctcacaccacgtctgctgggcaccctccacagcaggtccaagcctcgtgagccgtccctctcacgccacgtctgccgggcaccctccacggcaggtccgagctttgtgaaccgtccctctcacgtctgctttgagggtttgtgtcaatggggctgtgcagcatcaacctgtgatcttgccaatgccccagcctctgctctgtacggcattcatagctcaggagggcggggacaagggcgtttctgcaaagctctcacagctccttctgctcctcggcttctgggaagcaactagaaatagctgagagcccagctctttctagagagaagggggtgtcctttatgggggtccctgactgtgggggaccgagcccagctggagtcctcctccccttctctccggcagcaggtctctctggcagcagggtctggaatctagaaacactgagacctccagccccgaagggggcaaacattaaaccacacgccctggctgtgcctctcctccgggcgggacttggggtgatcagacccacagctcaaagggtgccccctggagaagccctcacagtgcctggggtgatttcagcctccaagggggggcttgagacgaggccccccaaaaggtaggggcatcgctgaggggcagcgtgtcctccggtggggggtgttgggcacctgccctgctcagacggctgtgtgcaggaggcatgggaggagccctcccccagcgtgtcccagccgtggtggcagctggaagactcacggactgtgattttatgcagagggagaaggagaagctgggccaggaaaccacaacaggcagcagcacctgcctgggctggggcctgggattcgaggctgagccacccatcccaggagggcccagcacctccagggcagaccaaacacaggacccaaccggacacccatacagacaccggggcaccttggcatctggtagagcccctcctctggatggctgccaggctgtgggagggaagggcagcacgagaccctgattgggctctgcctggcgctctgccactgcggaccaggagcccggacagtcggataccccacgacggcgcttgacattccagcatcaccacgacccctaaagccacaattactccttgtagcccctccccaggcagcttacactcagcagggtcaaagagaaagaccagagacagaagggctccaaggctggaagtgcgaggagtgtgcatgcacgcgtgtgtgtgtgcatgtgtgcagtgtgctctgtgcacttgtgtgtgctgtgtggtctgtgcacctgtgtgcatgtgctgtgtggcctatgcactttgtgtgtgcatgtgttagtgctgtgtgtggtctgtgcacttgtgtatgtgtatactgtgtgtgagctacacgtgtgtgcatgtgtgtgatctgtgcacgtgtacatgtaagcgtgcatgtgtatgcctgtatgcaggcatgtgtatgcacgtatgtgtactgtgcatggtctatacaggtgtggtcagtgcacatgtgtgctatgtggtctgtgtgcatgtgtgcaagcgtgcatgtgtacgcctgtatgcggacatgtatgtgagcacgtgtgtgtgccagtgggcacgtagggatgtgcactctaacaaacactgcgggagctctttgccatgaggtggcactggtccttggccacgctcattcacgcagacacccgaggcagcgccgcaccacctccagcctccttcccgctgcacttctctgaggtggggcagtaggtggctgcactgctcaggctagagtctgggggggcccaagacagaccctctacccctttgtctcccaaaacagggccccgcaaccatcccaggacgtgcaccttccctcttcccagggcccagagacttcccaggggacacaccacacgttccttgctggacatgagtctggcctcagtccctcctgctgggcggccagcttctgggagggaagggattggcctgtcttcctcatcctgcagagccccaacctgtgcccaggtgctcatgcctcagcggccccatgggaggaaagagcaggcggggcctcacctcgggggaggaaagagcaggtggggccatactgggagggaggaaagagcaggtggggtcacacctcggcaggggaggaaagaacaggtggggccacaccttggggggggaggaaagagcaggtggggccatactggtgggggaggaaagagcaggcggggccacacctggcgggggaggaaagagcaggcggggtcacacctgcagggggacacacagcacagcctccctccactgccaggtctcccttctccagggtcctggagtccaggtagctgagacggaactggggacacggggagcggtggccggggctggtgctgcgttgggtgggacgcactcatacccctgcctgtgggccccgctatggattccctgccccatgacgggacggcaaagggacatggaccccaggctcgagccagcccaagggagacagcaagggcaccgccgtgaaacgctgcccccaaaacacgtagcgatgcccacaccagaagggatgcttcatgccaccgcagggcccgaggccacacacgctgcctttgggaacagagcagacaggcagtgggagcctggacagtggcttccgaggcctcccagttggcacctttttgggacaggctccagcacagggaggggtgaggagacagcccagcggaggcacctcaatggcgacagggcctgggagtgccctggccgggctgggggtaggcagagaggccagggcagcagctccccacaatggacgccagacatggctccccgaacaccctgagcgccaggacccccaccagccaggggcgtacgaccctcaaatgctgctttcaaagtcctctccctcaggactggttcccctgctggcctcagggcctcaggacctcccagccaagccaagtgcactgaaaacgcaggtggaggagaaacgggcccaggactcccctgcacttgctctgcaggagtatttgcgcccacgaccccagccctgctcactcccagggaggccactctccagggagcccaggcccgcctgcgacgccgtcacgccaaatgccagatgctcccggggtctggttcttaagtctggagctagggactcgctcccgcattagagccgcctgccccaagggccacggtgcccacaacaggacgggcatgggacggtgcacccgaggcccgagaccccaagaggccccgctaaggaatcggtcagtggagaaggggccatcagctccagggggcaggagagctagggagggcgcacagctgggctgaggtgggagtggtttcctccggaaaggcggggagggcggccctgtgctgacggtggaggctatcctggcccgctgcatcatggcccagccctgccccaggtctgtcggggcactggtgggacacaggcgaggtggggccctggctaagaactgtgaggcctgctcaccaggtgggtctcgcagtgccggcacccggccagggcagtcaggagagaggggaggacttggggtcctgcccccccggtctccaaggctggggtgctgctggctctcacgcacccacagaaaggccagggcgaggcagctggagcccccaaggaccccctttttgaagaccctttggagccggctccctggccccaccgtgagccaggccctccctctggaggccaagaccagagggctggacgtccactctggctccagtttggttcccaggccccacccgctcctcggctgcaggcgaaggtctccacctcggggctggcttccatggaaagagccctcagatcccagaaggtacagggagaagacgccaaccaatagctctgtatttgggcgcccctgaggtggggaacaggaaagcccgccgggcaggtcaggtgtgaaggcagaggccacgcacagcggccggccacacccgcctgtagctgcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagagtggacagggcagccttgctcctgcacgctgctcctggagccacagggccctgcccagccctccagcccctgttggaaaataacttttgtaaaaggtcactgccaggagcccccatccttcagcccacatgggcccctccagggcccacccttcccgccacactcagttactgtaagaaaagggccccagagggttcccgcctcaaaacctcggaggcaccgtgctgaggagggccgcgggcgggtccactggcccagcgccgcctcacttcctgggcccggcccagcccacgtcaccaaagggaccctcgccggtggccgagcgtggcgggggcccgcacggggtacagaggtcggagtcggtgtctgactctccctccgcaatgtagggcctgactttggcacaaggcgccacggccgcgtagcagctgttgagagcatccaggttctccttggactgggagatgctgaagccgctgaaggaacgctccagctcctcgtggtccacggacgggatggagatggacgtgtcgctgtcccgcaggttcccctcggggggcctgcagcccggggtgtcctcctgccgcaggaactccatgctggcgcggttgcccccgccgtaggcggacagcgaccgctcgtgggcaggcggcggcgggatgcgcaccagggagccgtggtcccccacgggggaggtgccgtggccctggcgcgggtggctctgtggctgccaggaggtggagggcggacactggacagggggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccatccgctgcatgtagatattcaccaggaagtccagcttcttctccatggacaagacctgcaaaaggggctgctgggctggggtgcgagggcccgtcccaggagatgtggggacccaggctgctcccaggaaatgggggggcccaggctggttccaggaaacaggagagacccaggctagtcccaggaaacgggggacccaggctagtcccaggagatgtggggacccgggctgctcccaggaaatgggggggcccaggctggttccaggaaacaggagagacc

SEQ ID NO: 1563 - DNA, 783 bp, Homo sapiens
aatgtaacggaatcaaatggaatggaattgattggaaacgaaagaaacagaattaaatggagtgaaacggaaaaatgtctaatggaattaaatggaattgactcgaatggaatgcactggaatggaatggactcgaatggaatggactggagtggaatggacacgaacggaatggaatcgaatggaatggaatggaatggaatggaatggaatggaatggaatggaacataatggaatggaatggaatggaatggaacggaatggaatggaactgtatggaatggaatggaatggactcaaatggaatggaactgtatggaatggaatggaatggactcaaatggaatggagtcgaatggaatgaaaccgagtgggatggaatcaaatggaatggaattgaatggaaatgaaagtaacagaatagaatggagtgtaatggaataatatggaatggagtggaatggaatgcagtggacacgaatggaatggacacgaatggaatggactggagtggaatggactctaatggaatggaagcaaatggaatggaatggaatgaaatggaatggaatggaatggaatggaatggaatggaacaaaacggaacggaacagaaaggaacggaacgaaatggaatggaatggaatggaatggaatggaatggaatggaatggaatggaatgaaatggaatggaaagtaatagaatggaatggaaccgtttggaagggaatggaatggaatggagtcgaatggaatagaatcgaatcgaatggcatcgaat

SEQ ID NO: 1564 - DNA, 605 bp, Homo sapiens
cgaaagttgatagggcagacgttcgaatgggtcgtcgccgccacggggggcgtgcgatcggcccgaggttatctagagtcaccaaagccgccggcgcccgccccccggccggggccggagaggggctgaccgggttggttttgatctgataaatgcacgcatcccccccgcgaagggggtcagcgcccgtcggcatgtattagctctagaattaccacagttatccaagtaggagaggagcgagcgaccaaaggaaccataactgatttaatgagccattcgcagttcactgtaccggccgtgcgtactcagacatgcatggcttaatctttgagacaagcatatgctactggcaggatcaaccaggtaggtaaggtagagcgcggcgaggacgggcccggcgccccgcaagcgaggaggacgacggacggacggacggacgggggaggaggaggacggacggacggacggacggggccccccgagccaccttccccgccgggccttcccagccgtcccggagccggtcgcggcgcaccgccgcggtggaaatgcgcccggcggcggccggtcgccggtcgggggacggtcccccgccgacccca

SEQ ID NO: 1565 - DNA, 2771 bp, Homo sapiens
actgcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggcccggcgcgccgggggccgctaccggcctcacaccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgagggaatcctggttagtgtcttttcctccgctgactaatatgcttaaattcagcgggtcgccacgtctgatctgaggtcgcgtctcggagggggacgggccgctcggcggacggacggacggaatcgcgccggcccgaccgcccgcccgacgctccgtcgggagacgggcccggcgagggggagaggcgacgggagagagagcgcgcggccggcggcacccccgcgccgccccgccggagcgggacgaccggagggaggggcacgggccgggggcgggacgggcgccgcacgccccgacccgtctcccccgcggaggtcggggggacgggtccgaggacgcggcggcggagccgccccgccccgacgcggaagctcgggacggggccccggcgcggcgcggcgcggccgcgagccggaggcgggcgcgcgacggcggacgacaccgcggcgtctcgcgggtcgccgccggggacacgcgaaccccggcgccgcggccacgggcgcggccgggcgggccgcggggcgggctcccggccccggccgacgcgccgcgaggcgagccgggcgggcgggcgcgcgcgcgtacgcgcggggagggcgaggaggggcggcggggaggaggaggggcgcgggagcggcggtcggccggacgccgggccgccaccgggggcgggcggcgaaccgcggcgaccgggacgcgctcccccgaccctctctccccgccggcacccttccccttccggacccgccttcctcctcccccaccaccacaccgcacgcaacacgcccccaccgccgacgacgcgcgacgacgacgacgacgacgggcacgggaccttccacccggccggggccgacgaaccccgacccccgagccgcgcgcggcgcgagggagccccaccgagggaggaacccggaccgcaggcggcggccacgggaactcggcccgagccggctctctctttccctctccgtcttcgcgggcggcggcggcgccgccctccccgtctctctcagccgggcgcgcccccctctcccccccgccacccgacgcgtgaccacgcagggcccgcggggggagggggaaggggcgggcgcggcggcaagaggagggcggacgccgccgggtctgcgcttagggggacggagggcccccggcgggccctgcgagggaacccccagccgcgcaccccgaggagcccggaggcacccccgggggcgattgatcggcaagcgacgctcagacaggcgtagccccgggaggaacccggggccgcaagtgcgttcgaagtgtcgatgatcaatgtgtcctgcaattcacattaattctcgcagctagctgcgttcttcatcgacgcacgagccgagtgatccaccgctaagagtcgtacgaggtcgatttggcgagggcgctcccgacgacgcaccgggaggaggcccttcctggcgcggcacgtcccccccccccccgcccaagaggagagggggttgcctcaggccggccagacgagacagcaaacgggaccggactccggagaggggtcggaaggtttcacaccacggggaggcgcgcgccgcccacgcgggggcgagcgcggacaccaccccacaggcgcccgggggttcccgcccccacggcgcggggcgcacgccacacgcgcggcaggcgcgcgacggccgccgggtaaagcccccacccgacggccgccgcggcggcggcggcggcgcggccccggccggggagcggagtccgcggtggaggcgcgggaggggccgggcccctcccgacgggactcccccgcgggcccaccaccgcccccgacccacgggcggacgggcgatccccccaaggggtctttaaacctccgcgccggaacgcgctaggtacctggacggcgggggggcggacgaggaggcgggggaggggaccggcgtccggcccccgaccctcgagacgccctagcgggaaggccggggagagcgagcggggccgtgcccggcggcgcggagcggcgcggcggaggcgacgggaatccggccggccccgaagacggggagccggcgcggcggggccggacgacgggccccggcggggaggagggcaccgagacccccccagacccgccgcgacgccgccgagaaccgcccccgcgcccgccgacacccacgtcgtcggggccgcggccggggaccgctccccgccgcccgccggccccacgacacgcgcacaccaacgacacgcccttctttctctttctctctctctctctctctcccccgtctccctcccgagttctccggctctcgcggccggcggggccgggcggcgaacgaacgagcgagcgaacgaacgggcacgcgggccccgcccgcgcacgcgccgcgtcgcggtgggggg

SEQ ID NO: 1566 - DNA, 2664 bp, Homo sapiens
gtaacggcgagtgaacagggaagagcccagcgccgaatccccgccccgcggcggggcgcgggacatgtggcgtacggaagacccgctccccggcgccgctcgtggggggcccaagtccttctgatcgaggcccagcccgtggacggtgtgaggccggtagcggcccccggcgcgccgggcccgggtcttcccggagtcgggttgcttgggaatgcagcccaaagcgggtggtaaactccatctaaggctaaataccggcacgagaccgatagtcaacaagtaccgtaagggaaagttgaaaagaactttgaagagagagttcaagagggcgtgaaaccgttaagaggtaaacgggtggggtccgcgcagtaaaggggcggaggattcaacccggcggcgggtccggccgtgtcgccggcccggcggatctttcccgccccccgttcctcccgacccctccacccgccctcccttcccccgccgcccctcctcctcctccccggagggggcgggctccggcgggtgcgggggtgggcgggcggggccgggggtggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtccgtcctcctcctcccccgtctccgccccccggccccgccactcgccgaatcccggggccgagggagcgagacccgtcgccgcgctctcccccctcccggcgcccacccccgcggggaatcccccgcgaggggggtctcccccgcgggggcgcgccggcgtctcctcgtgggggggccgggccacccctcccacggcgcgaccgctctcccacccctcctccccgcgcccccgccccggcgacggggggggtgccgcgcgcgggtcggttagcggggcggactgtccccagtgcgccccgggcgggtcgcgccgtcgggcccggggggaggttctctcggggccacgcgcgcgtcccccgaagagggggacggcggagcgagcgcacggggtcggcggcgacgtcggctacccacccgacccgtcttgaaacacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcgcgcgcgcgcgtgtggtgtgcgtcggagggcggcggcggcggcgggggtgtgtggggtcctcccccgccccccccccacgcctcctcccctcctcccgcccacgccccgctccccgcccccggagccccgcggacgctacgccgcgacgagtaggagggccgctgcggtgagccttgaagcctagggcgcgggcccgggtggagccgccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaaatccgggggagagggtgtaaatctcgcgccgggccgtacccatatccgcagcaggtctccaaggtgaacagcctctggcatgttggaacaatgtaggtaagggaagtcggcaagccggatc

SEQ ID NO: 1567 - DNA, 395 bp, Homo sapiens
ccttcccccgccgcccctcctcctcctccccggagggggcgggctccggcgggtgcgggggtgggcgggcggggccgggggtggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtccgtcctcctcctcccccgtctccgccccccggccccgcgtcctccctcgggagggcgcgcgggtcggggcggcggcggcggcggcggtggcggcggcggcggcggcggcgggaccgaaaccccccccgaaaggggtggctggccgggcggggggctgaccccccacc

SEQ ID NO: 1568 - DNA, 392 bp, Homo sapiens
ccttcccccgccgcccctcctcctcctccccggagggggcgggctccggcgggtgcgggggtgggcgggcggggccgggggtggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtccgtcctcctcctcccccgtctccgccccccggccccgcgtcctccctcgggagggcgcgcgggtcggggcggcggcggcggcggcggtggcggcggcggcggcggcggcgggaccgaaaccccccccgagggtggctggccgggcggggggctgaccccccacc

SEQ ID NO: 1569 - DNA, 1259 bp, Homo sapiens
gtggggttgtcgcggccgccccgggcgcccgcagcggagagcgcacgggggcacggtggccctcgccgccttccccgccgcccccgggtgggtcagagacccggacccgggccggcaccgggagtcgggacgctcggacgcgcgagagaacagcaggcccgcgggccccggcaggcggctcaagcaggagcgcggccggctagccgggtcaccggtaggccagagccccgcgcgcatccggaggcccaacctctccagcgacaggtcgccagaggacagcgtgtcagcaataacccggcggcccaaaatgccgactcggagcgaaagatatacctcccccggggccgggaggtcgcgtcaccgaccacgccgccggcccaggcgacgcgcgacacggacacctgtccccaaaaacgccaccatcgcagccacacacggagcgcccggggccctctggtcaaccccaggacacacgcgggagcagcgccgggccggggacgccctcccggccgcccgtgccacacgcagggggccggcccacggggaggaggaggacggacggacggacggacggggccccccgagccaccttccccgccggccttcccagccgtcccggagccggtcgcggcgcaccgccgcggtggaaatgcgcccggcggcggccggtcgccggtcgggggacggtcccccgccgaccccacccccggccccgcccgcccacccccgcacccgccggagcccgccccctccggggaggaggaggaggggcggcgggggaagggagggcgggtggaggggtcgggaggaacggggggcgggaaagatccgccgggccgccgacacggccggacccgccgccgggttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggcccggcgcgccgggggccgctaccggcctcacaccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgaggga

SEQ ID NO: 1570 - DNA, 820 bp, Homo sapiens
gcgcggcgaggccccgacgcggccggacggccggccggggggcctcgcgaggacgggcccggcgccccgcaagcgaggaggacgacggacggacggacggacggggaggaggaggacggacggacggacggacggggccccccgagccaccttccccgccggccttcccagccgtcccggagccggtcgcggcgcaccgccgcggtggaaatgcgcccggcggcggccggtcgccggtcgggggacggtcccccgccgaccccacccccggccccgcccgcccacccccgcacccgccggagcccgccccctccggggaggaggaggaggggcggcgggggaagggagggcgggtggaggggtcgggaggaacggggggcgggaaagatccgccgggccgccgacacggccggacccgccgccgggttgaatcctccgggcggactgcgcggaccccacccgtttacctcttaacggtttcacgccctcttgaactctctcttcaaagttcttttcaactttcccttacggtacttgttgactatcggtctcgtgccggtatttagccttagatggagtttaccacccgctttgggctgcattcccaagcaacccgactccgggaagacccgggcccggcgcgccgggggccgctaccggcctcacaccgtccacgggctgggcctcgatcagaaggacttgggccccccacgagcggcgccggggagcgggtcttccgtacgccacatgtcccgcgccccgccgcggggcggggattcggcgctgggctcttccctgttcactcgccgttactgaggga

SEQ ID NO: 1571 - DNA, 1713 bp, Homo sapiens
ccggccggccggcctccgctcccggggggctcttcgtgatcgatgtggtgacgtcgtgctctcccgggccgggtccgagccgcgacgggcgaggggcggacgttcgtggcgaacgggaccgtccttctcgctccgccccgcgggggtcccctcgtctctcctctccccgcccgccggcggtgcgtgtgggaaggcgtggggtgcggaccccggcccgacctcgccgtcccgcccgccgccttctgcgtcgcggggcgggccggcggggtcctctgacgcggcagacagccctcgctgtcgcctccagtggttgtcgacttgcgggcggcccccctccgcggcggtgggggtgccgtcccgccggcccgtcgtgctgccctctcggggggtttgcgcgagcgtcggctccgcctgggcccttgcggtgctcctggagcgctccgggttgtccctcaggtgcccgaggccgaacggtggtgtgtcgttcccgcccccggcgccccctcctccggtcgccgccgcggtgtccgcgcgtgggtcctgagggagctcgtcggtgtggggttcgaggcggtttgagtgagacgagacgagacgcgcccctcccacgcggggaagggcgcccgcctgctctcggtgagcgcacgtcccgtgctcccctctggcgggtgcgcgcgggccgtgtgagcgatcgcggtgggttcgggccggtgtgacgcgtgcgccggccggccgccgaggggctgccgttctgcctccgaccggtcgtgtgtgggttgacttcggaggcgctctgcctcggaaggaaggaggtgggtggacgggggggcctggtggggttgcgcgcacgcgcgcaccggccgggcccccgccctgaacgcgaacgctcgaggtggccgcgcgcaggtgtttcctcgtaccgcagggccccctcccttccccaggcgtccctcggcgcctctgcgggcccgaggaggagcggctggcgggtggggggagtgtgacccaccctcggtgagaaaagccttctctagcgatctgagaggcgtgccttgggggtaccggatcccccgggccgccgcctctgtctctgcctccgttatggtagcgctgccgtagcgacccgctcgcagaggaccctcctccgcttccccctcgacggggttgggggggagaagcgagggttccgccggccaccgcggtggtggccgagtgcggctcgtcgcctactgtggcccgcgcctcccccttccgagtcgggggaggatcccgccgggccgggcccggcgttcccagcgggttgggacgcggcggccggcgggcggggcccggcccctcccgcgcctccaccgcggactccgctccccggccggggccgcgccgccgccgccgccgcggcggccgtcgggtgggggctttacccggcggccgtcgcgcgcctgccgcgcgtgtggcgtgcgccccgcgccgtgggggcgggaacccccgggcgcctgtggggtggtgtccgcgctcgcccccgcgtgggcggcgcgcgcctccccgtggtgtgaaaccttccgacccctctccggagtccggtcccgtttgctgtctcgtctggccggcctgaggcaaccccctctcctcttgggcgggggggggggggacgtgccgcgccaggaagggcctcctcccggtgcgtcgtcgggagcgccctcgccaaatcgacct

SEQ ID NO: 1572 - DNA, 4590 bp, Homo sapiens
ggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtccgtcctcctcctcccccgtctccgccccccggccccgccactcgccgaatcccggggccgagggagcgagacccgtcgccgcgctctcccccctcccggcgcccacccccgcggggaatcccccgcgaggggggtctcccccgcgggggcgcgccggcgtctcctcgtgggggggccgggccacccctcccacggcgcgaccgctctcccacccctcctccccgcgcccccgccccggcgacggggggggtgccgcgcgcgggtcggggggcggggcggactgtccccagtgcgccccgggcgggtcgcgccgtcgggcccgggggaggttctctcggggccacgcgcgcgtcccccgaagagggggacggcggagcgagcgcacggggtcggcggcgacgtcggctacccacccgacccgtcttgaaacacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcgcgcgcgcgcgtgtggtgtgcgtcggagggcggcggcggcggcggcggcgggggtgtggggtccttcccccgcccccccccccacgcctcctcccctcctcccgcccacgccccgctccccgcccccggagccccgcggacgctacgccgcgacgagtaggagggccgctgcggtgagccttgaagcctagggcgcgggcccgggtggagccgccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaaatccgggggagagggtgtaaatctcgcgccgggccgtacccatatccgcagcaggtctccaaggtgaacagcctctggcatgttggaacaatgtaggtaagggaagtcggcaagccggatccgtaacttcgggataaggattggctctaagggctgggtcggtcgggctggggcgcgaagcggggctgggcgcgcgccgcggctggacgaggcgccgccgccccccccacgcccggggcacccccctcgcggccctcccccgccccaccccgcgcgcgccgctcgctccctccccgccccgcgccctctctctctctctctcccccgctccccgtcctcccccctccccgggggagcgccgcgtgggggcggcggcggggggagaagggtcggggcggcaggggccggcggcggcccgccgcggggccccggcggcgggggcacggtcccccgcgaggggggcccgggcacccggggggccggcggcggcggcgactctggacgcgagccgggcccttcccgtggatcgccccagctgcggcgggcgtcgcggccgcccccggggagcccggcgggcgccggcgcgcccccccccccaccccacgtctcgtcgcgcgcgcgtccgctgggggcggggagcggtcgggcggcggcgggcggcgggcggcggaggggccgcgggccggtcccccccgccgggtccgcccccggggccgcgcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactctgatcgttttttcactgacccggtgaggcgggggggcgagccccgaggggctctcgcttctggcgccaagcgcccggccgcgcgccggccgggcgcgacccgctccggggacagtgccaggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggcggaacgatacggcagcgccgcggagcctcggttggcctcggatagccggtcccccgcctgtccccgccggcgggccgcccccccctccacgcgccccgcgcgcgcgggagggcgcgtgccccgccgcgcgccgggaccggggtccggtgcggagtgcccttcgtcctgggaaacggggcgcggctggaaaggcggccgccccctcgcccgtcacgcaccgcacgttcgtggggaacctggcgctaaaccattcgtagacgacctgcttctgggtcggggtttcgtacgtagcagagcagctccctcgctgcgatctattgaaagtcagccctcgacacaagggtttgtccgcgcgcgcgcgcgcgcgtgcgtgcggggggcccggcggggcgtgcgcgtccggcgccgtccgtccttccgttcgtcttcctccctcccggcctctcccgccgaccgcgggcgtggtggtgggggtgggggggagggcgcgcgaccccggtcggcgcgccccgcttcttcggttcccgcctcctccccgttcaccgccggggcggctcgtccgctccgggccgggacggggtccggggagcgtggtttgggagccgcggaggcggccgcgccgagccgggcccgtggcccgccggtccccgtcccgggggttggccgcgcgggccccggtggggcggccacccggggtcccggccctcgcgcgtccttcctcctcgctcctccgcacgggtcgaccagcagacc

SEQ ID NO: 1573 - DNA, 1836 bp, Homo sapiens
ggtctgctggtcgacccgtgcggaggagcgaggaggaaggacgcgcgagggccgggaccccgggtggccgccccaccggggcccgcgcggccaacccccgggacggggaccggcgggccacgggcccggctcggcgcggccgcctccgcggctcccaaaccacgctccccggaccccgtcccggcccggagcggacgagccgccccggcggtgaacggggaggaggcgggaaccgaagaagcggggcgcgccgaccggggaggcgtgggggggggggcgggggaaggaccccacacccccgccgccgccgccgccgccgccctccgacgcacaccacacgcgcgcgcgcgcgcgccgcccccgccgctcccgtccactctcgactgccggcgacggccgggtatgggcccgacgctccagcgccatccattttcagggctagttgattcggcaggtgagttgttacacactccttagcggattccgacttccatggccaccgtcctgctgtctatatcaaccaacaccttttctggggtctgatgagcgtcggcatcgggcgccttaacccggcgttcggttcatcccgcagcgccagttctgcttaccaaaagtggcccactaggcactcgcattccacgcccggctccacgccagcgagccgggcttcttacccatttaaagtttgagaataggttgagatcgtttcggccccaagacctctaatcattcgctttaccggataaaactgcgtggcgggggtgcgtcgggtctgcgagagcgccagctatcctgagggaaacttcggagggaaccagctactagatggttcgattagtctttcgcccctatacccaggtcggacgaccgatttgcacgtcaggaccgctacggacctccaccagagtttcctctggcttcgccctgcccaggcatagttcaccatctttcgggtcctaacacgtgcgctcgtgctccacctccccggcgcggcgggcgagacgggccggtggtgcgccctcggcggactggagaggcctcgggatcccacctcggccggcgagcgcgccggccttcaccttcattgcgccacggcggctttcgtgcgagcccccgactcgcgcacgtgttagactccttggtccgtgtttcaagacgggtcgggtgggtagccgacgtcgccgccgaccccgtgcgctcgctccgccgtccccctcttcgggggacgcgcgcgtggccccgagagaacctcccccgggcccgacggcgcgacccgcccggggcgcactggggacagtccgccccgccccccgacccgcgcgcggcaccccccccgtcgccggggcgggggcgcggggaggaggggtgggagagcggtcgcgccgtgggaggggtggcccggcccccccacgaggagacgccggcgcgcccccgcgggggagacccccctcgcgggggattccccgcgggggtgggcgccgggaggggggagagcgcggcgacgggtctcgctccctcggccccgggattcggcgagtgctgctgccgggggggctgtaacactcggggggggtttcggtcccgccgccgccgccgccgccgccaccgccgccgccgccgccgccccgacccgcgcgccctcccgagggaggacgcggggccggggggcggagacgggggaggaggaggacggacggacggacggacggggccccccgagccaccttccccgccgggccttcccagccgtcccggagccggtcgcggcgcaccgccgcggtggaaatgcgcccggcggcggccggtcgccggtcgggggacggtcccccgccgacc

SEQ ID NO: 1574 - DNA, 7317 bp, Homo sapiens
catgcctgtggccccagccattggggagactgaggaaggcggatcatttgaggtcaggagttcgagaccagcgtggccaacgtggagaaaccccgtctctactgaaaataggaatatgagccggccgtcatggtgtgcgcctgtaatcccagctaccgaagaagaatcactggaacccgggaagcagaggtttcagtgagccgagagagcgccaccgcaccgcagcctgggtgacagagcgagagagactcagtccaaaaaaaaagaaagaaaagaagaagaaaaaaaaagaacgggcccaaatactgcattgtcgctgaacgttctcccaaaaggccagaaaccccctgactcaggtcaaggaggtggtgtttcgttttctctctccctcctctctctctctctctgtctctctctgtctctctctctctctctctctcctctcttctcccccctaacttttatttgtcgttcaagcatacatgtgcaagattgtgacataggtaaacttgtgacgggggtgttcagtgtgcagatgatttcatcacccgggtagtcagtgctgtgtccgacagtattcgtgttttgttttcttcctgaagctgtctctccttccacccctcctccctcaagcagacttccgcgtccccggtccccctcgttctgcccatgcaagaactgtcatctgtaagttcccacttctagatgagaacacgcggtatttagccgatccttgctgtcatcttcggtggtggtggtggtggtgaaagaggcatgacactaaatcgacccttaggacgctcccctccgtccccaccccgcaccccctccccacacacaccctcattcccgcaccccctcctcaaacgcaagaaaggaagaaatgaaagtaagaggtgagcctgcaaggcggtggaggcgggggatctcagagggcgagcaagcgatggcggtcgggggatgtgtcggctgaggtatcaaaaataggggacccagttttcagccccaacacaccccctaatcctcagccgcagccagcctctgggtggggttgcgcctgtcaaagcttccgaatggagagaagcccaaggctacggaaggcatcagctccaactccaggaagggaataaggctctgtgcatacgaatggggctttgaaaggcgttgccgcggcttccaaagcgatgcgctgtgcctcgcctcgcctcgccccgcccagagcgagactccgtctgaaaataagtacacaaataaatcataagataattcatcaagaaagaaagaaagaaagaaagaaagaaagaaagaaagaaaggatcagtagagcgatggtggtcgtgagtcattccccggagtccaggcgcagtggctcacgcccgtcacgccagcactttgagacgccgggcaggagggttgcaaagaaatgatgagaccccgtctgtgggaaaacatttaaaaatgaaggccgggcgcggtggctcacgcctgtcatcccagcacttccggaggccggggagggcggatcacctgaggtcgggagttcgaaaccagcccgatcgacatggagaagccccgtctccactaaaaatacgaaatcagccagacgtggcagcgcatgcccgcaatcccggctactcaggaggccgatgcaggagaatcgcttgaaaccgggaggcagaggttgcggtgagccaagatcgcgccaccgcactgcagtctaggccacgagagtgaaactctgtctcgggggaaaaaaaaacaattaaaaacggtgtgggcacagtggcgcgtgcccgcggtcccaggctctgtactctggaggctgaggtggaaggatcgctcgagtccaggagcgtccacgctgcagggagtgagttacgacggcaccactgccggggtgacggagcgagatgccgtctctaaatcagtcaatgagatcactggaaggcgctctctgcgtctcactttccaagagggtctctttgggccaagcaggcatggtgcctcccgccagtcatcccagcactttgggaggctgaggcgggaggaaagaaggaagggaggaagggaggaaagaagaaaagaagaaaggcaggaaggcaggaaagaaagaggggaagagagaaaaagaaaaagaaagaaagaaagaaagaaagaaagaaagaaaagagaagcaaaaagaagaaaagagaagggaagaaaagaaaagcaaacggggaaggggcatatctccttgaccggtgactgcccaggatacagtgggtcacggccgaccgaagcctcgacctgtggggcctcaagtgatcttctcctcgtctcagcctcccgagtagccgcgactacaggcggccatcaccgcgcacaactcatcttataataacatcatgattctctcgagacggggtctcgctccgtcatccaggccgcatcgccacggcacgatctcagctcatcgcaacctcggcctccccggttggaacaagtcgcccgccccagtctcccgagcggtcgtgattccaagcccacgccaccaggcccggctaatcgttctatttttcagagagacggggtttcgccacgtcggccagcctggtctcgaactcccggccccaagcgatccacccgcctcggcctcccaaagtgccggagtgacaggcgtgagctagcgtgcccggcccagatcatctttttcatcaattgtagagaaggggtttcgtcagccaacgggtggagggtggggcgggttttactcagcctgcgtactgtgaaaaggggaagtgagtgtgctctgtgaactagatatggaaattgtgtgtgtgtgtgcgcgcgtgcgcgtgcgagagagagagagagagagagagagagagagaccaatcccaccacgaggacccggaaatagtgtttgatctgtgtccctgcctagtcacctgtcttgtgtgtcgatgactgaggattccacaaatgaaggtcagcggtatctattgagctgtttctccctctcgtgcgtctcatctgtgtgctggagaaagggaagagaagaggttccgatgggaagttgtcttcacgcctgaggcagctgaaggcagaccgaagggaaggagggcatcctaggtgacatttccatacccacgcaccctttacaatgctggggctgccagtccaccctgtacgtcaacccacccccaagaacagcacggtccggggtggtccagtctgatcccaaccggcccacccggggcatccggtggaagtcttcgccggaggatccgaaggcagcatcaacgcggttcccctggggtcgcccggcaaaggccagccgggggagggtagcgggacgtgacgggggggtgggggtcgcatccgcctcagagctccctggaaggtggcaggtagccggtggggcacgccgagccagagacgtccggcaggatatagatctggaaggcgtgtcagtcctctcccatacctctcctatggaaaatgccagggcggcggtgggagcctcggctgggggagaagcggggacaagggggagagggaaggaggccctcgggaggtttcggcaccgaaaacccactcagccaagctccctccgtgtttccgggtccaaggtacaccccgggagacggcaagagaaacgttcacaccgtgctttccgtcttcgtgtttatttctttcatcttttccattttacgagagatgctcatttcaacaaccagacggcggatgtgacgggagaagcgtcaaggccaggagtttgagaccagcgtgagcaacagagcaacacacgtaggagagcccagctgaaagaaatgaaagaggaggaggaggaggaggaggaggaggaggaggaggaggaggaggaggacgacgacaagggggggtggggggggaggagaaggaaagaaaagaaaagaaaaaaaagaaaaaggaaaacaaccaccaccaagaaagttaagattctccaacggtcggaagttgaagaccagcctgaccaagatggagaaaccccatctgtagtaaaaatagaaaaattagccgggcacgatggctcatctctgtcattccagctactcgggaaggctgaggcaggagaatcacttgaacctgggaggcggagggtgcggtgagccgagagccgccatcgtactccaccctgggcgacaagagtgaaactccgtctaaagagaataaaaagaaagaacgaaaaggcggatcggtgagatgcgtctggaaattttcttcgttcgcagtccccgtattaaaaacggaaagaaccgacccacgacaaacacgaccagagcgtaccgtgcccacgcgtgtcatcacagcactccgggaggccgatgcgggaggatctctggagcctaaaagttcgagatcacctcgacacgtgagatgacgcctacaataataataatcatagaagtttgaaaagagaccacgtgtgcccagagcatggacaataaagcgagagcacatccgtactaaaaagaagacgattgataggcaggcaggcaggcaggcaggcaggcaggcaggcaggcaggcaggcaaatgtagaaggagccaggcgcagcgtctcacgcctgtaatagcagcagtgtgggcggccgaggcaggcaggcggattgcttgaggacaggagttcgagaccagcgtgggcaacatgatagaaccccgaaacccatctcactcacatacatacatacatacatagatacacacacacacacacacacacacacacacacacacacacacacacacatacctacctacggaaaacatgagaaacaacataaaagtcagccggtgtggtggtgcgcgcctgtagtctcaggtaatggggatgggagggatcagaggcagaacgaccgtttggtcggtccaaagcgttgaggttggggtgatcctgggcggcagagacagaggaagaccctgccagtaagggagggaaggaaggaaggaaggagggaaggaaggaaggaaggaaggaaggaaggaaggaaggaaataaacaggcaagcaggcaagcaaacgatgaacgtgacaatgacacagaagaacccatgagaataaacgagcaaataacagggtatgaatgaagctaaaaggcaattgagatcgcaatcaatcgttttctctgcaccccaccccaccgcagcccacgtaagctggagtggaagtgtgcgatcacagcccacgttaacctctccctcccgggcttaagagatccctgtagtcccagctatttgggaggctgaggtcaccagagcgcagagacagaagaccaggcgggccggccccaaaagaaaagaaaataaataaacgaaaattattaataaataatgaatgaaggaagggaggaaggatatacatacacgtgtatgtaaatgaaatggggcttcgatacatattcatccattaaaagtaacataatataaacgtattaattatggaaatatcatttacatagttttatcactacggggggtgtgtgtgtgtgtgtgtgtgtgtgtgtgtgtgtgtgtgtgtgtgtgtgtgtgtgtatgtgtagatgtatgttcatacacggcagcgttcagaaaataagattgaaaaaaggaaggaatcggccgggcatggtggctcacatctgtactcccagcagtctttgggaggccgaggcgggcggatcactaggtcgggagttcgagaccagcccggccaaaatggtgaaattacgtctttactcgaaatagaaaacttgctgtttgcttgaaccgtggaggcagaggcagcagcagcagcgagccgagaaggcaccaaggagggagggaggggagagagacagagagagagagagagagagagaaagaaagaaagaaagaaagaaagaaagaaaagaaagaaagaaagaaagaaagaaagaaagaaagaaaacgcaaggcaaaaccaaaaagcaaaaaaggaggaagcattactggctgacggcagcagtgactccctcttaaaagtcccgcggacgcaaactcgcagtggggctgaaaaaaatgtagaagagggagttccgcgtggtcccagctccaccgcgggccgaggccggtggaggtcgccggcgcgtgaaccggaatcgacgccctcgcgtcggtgcgccgcagcgtccggcggccgcctgctggtcgacccgggacacgtgcagacgccagctaagtccggagctcgcgggcggcagctggtcgaccccggaggtgccgaccgagacggggacgcggcgggtccggctcgtcccgacgggcactcttacacgccgctcggtggagaaggcccgccggtcgacccgggacacggcgagacagcggctaagtgtcaagagccgagaaggcaccaaggaaggggagagagggagggagggggagggagagagagagagagagagagagagagagagagagagagagagagagagagagacagagagagacagagagaaagagagagagagagagggcgagagcgagagacagagagagagagagagagagagagagaaagagaaagagaaagaaaacgagcgagggagagagcgagagagcgagagcgagaaagaaagaaagaaagaaagaaagaaagaaagaaagaaagaaagaaagaaaaaaaaaaaaaaaaaaaaaaggcaagacaaaacctaaaagcaaaaaaggaggaagcattactggctgacggcagcagtgactccctcttaaaagtcccgcggacgcaaactcgcggtggggctgaaaaaaatgtagaagagggagttccgcgtggtcccagctccaccgcgggccgaggccggtggaggtcgccggcgcgtgaaccggaatcgacgccctcgcgtcggtgcgccgcagcgtccggcggccgcctgctggtcgacccgggacacgtgcagacgccagctaagtccggagctcgcgggcggcagctggtcgaccccggaggtgccgaccgagacggggacgcggcgggtccggctcgtcccgacgggcactcttacacgccgctcggtggagaaggcccgccggtcgacccgggacacggcgagacagcggctaagtgtcaagagccgagaaggcaccaaggaaggggagagagggagggagggggagggagagagagagagagagagagagagagagagagagagagagagagagagagagacagagagagacagagagaaagagagagagagagagggcgagagcgagagacagagagagagagagagagagagagagaaagagaaagagaaagaaaacgagagagggagagagcgagagagcgagagcg

SEQ ID NO: 1575 - DNA, 881 bp, Homo sapiens
caaacattgagaccctcgtagcagtgttctggaatcctacgtgagacacaaacattcgtaccacagcagaagtgttccggaatcttatgtgagggacaaccattcagatcacagcaggagtgttctggaatcctttgtgagggacaaccattcagaccacagcaggagtgttctggaatcctatgtgagggtcaaacattcagaccccagcagtagtgttctggaatcctatgtgagggcaaacattcagacccacgtggcagtgttctggaatcctatgtgagggacaaacattcagaacctcgtagcagtgtcctgaaatcttatgtgagggagagacatttagaccctcgcaacagtgttctggtatcccatgtgagggacaaacattcagaccctcccagccgtgttctggaattctatgtgagggaaagacattcaaaccccagcagcagtgctctggaatctgatttgaggggcagacattcagaccccagcagcagtgttctggaatgctatgtgaaggacaaacattcagaccacgggagcagtgttctagaatcctacgtgaaggacaaacattaagactctcatagcagtgtcctggaatcatatgtgaggaacaaccattcagacaccagcagaagtgttctggaatcctaggtgtgggaaaaacattcagaacctagtagcagtgttctggaatcctatgtgagggacatacattcagaccacggcagcagtgttctggaatggtatgtgaaggacaaacattcagacccttgtagcagtgttccggaattctatgtgagggacaaacattcagaccacagcagcagtgttctggaatcctatatgacggaccaacattcagacccttg

SEQ ID NO: 1576 - DNA, 671 bp, Homo sapiens
attcaggtccacataaactagcaatcccttaaaaattttcataggcactcagacacccaaggagagagactgccagaaaagaaacagagtcatgatagttgtacctctatttccctaagtactatctaagtatatttcttcctatggacacccacttccagattctacttctgcagggttccacagaagtctccaatctttaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgattttccagctaatcatgcccctgacccagcccacatggacatgggaaggacatcagtgaactgtgaaaagaggcagagacggagattcactcttgttgcccaggctggagtgcaatggcacaatttcggctctccacaatctctgcctcccagattcaagctattctcctgcctctgtctcccaaggagctgggattacaggtaagcgccaccatgccctgctaattatgtacttttagtagagacgggggtttctccatgctggtcaggttggtctcaaactcctgaccccaggtgatctgccc

SEQ ID NO: 1577 - DNA, 1324 bp, Homo sapiens
gcctgctgcagaggcaaagcctcatggaaaagttctactaggacagagcacctgtggctttgcagggtttagcccgtgcagctgctctcacggtctgggctgttgttgagtgcctgtagcttttccacagagggtgtgagctgttggtgggtctatgaatctggtgtctggaggttggtggccatctgcctgggggcttcaagcccatattttccttccacacttccctggtagaggttttccaagaggctctgcctctgcagcaggcttctgtttggaaacagtgggagttgggggtgggtggttgttccttcctcaatgtttaagcaccatcttcatgatgctgaccttgtgatagtgagttctcatgagatctgtttgtataatagggtgtggtcctctctcctgtgtgtgtcttgtgcctactcctgccacatgaatcatgtcattgcccctggacattctggtatgattggaaggcttcctgagtcctcccagattcagaagccattatgtttccttatggtctgcagaatcatgagccaattaaacttcttttctttatgatcatagagaaaattagtagtgcaaagtggaactattaaatgtcattgtcgtggcaatcagcactcagcttcttttcattcaagtatgtgaaggcttcatgaattttcccctgaaaatggacttgttttcctttaccacattgccaggctgtggcaaagatagtgataatgtagaagcagattcagaagggagtagcggacagaggtcgggagagtttggagggcttcaaagacaagaagatgaaagaaagtttggatctttgtaaagaattgctaaacacttgtgatcagaaggctcacaggaaaatggttagtgaaagcccgacttagaaggtctcagatgaaaatgaagctcttactgggaacagaagtcaaagttacttttgtttccttagcaaagaacatggctgcacggtgacctcgccctggagatctgtgaaattttgaacttgagggtgatgatttactgagtatctggtggaatgaactgagcagcaaactcaagagttgtcctgtttccattgaacagcctgtgctcttatgtgggatggaggaaatgacctctggatgagacttacattaaatgagtcccaactcttacattacatgagaaacagaactcaaaagtttggaaaatttgcggcctggtcatgtggtccaaaagaaaagctgattttcagggggaaaattgaggaaggcttcggaaacttgcatgaaaaggagcccagtgctaatagacaagacaatagggaaaaggc

SEQ ID NO: 1578 - DNA, 1505 bp, Homo sapiens
ctgtctcaggcttctacttggaaacagtgggtggtggatatggggtggtgggcggatccttcaccaacagtgaagcaccatcttcttgatgctgatctcctgacagtgagctctcatgagatctagttgtataagaggatgtcgcacctctttcctctttctgtcttgcttctacttctggcatatgaaacatttcattgctgcttggcctctggtatgattgggaggcttcctgagtcctcctacaagcagaatccactatgctttctttatagcctgaagaactgtgagtcaactaaacctcttttctttatgtacatacagacaattaatgctgcgaagtgaagctatgaaatgacttctaggccttcccccaatctcttggttattagcactgagcttttttcaatgcaaatattggataccatcttgatgtttccccctgataatagacttttcttctgttaccacattgccaggctgcgaaaatgatacctgatagtgtagaagcaggttctgaattaggtaatggccagaggttagagagttcggagatcttggaagaaaacaggaagatgagggaaagtttggaccattgcagagacttgttcaatagttgtgattaaaaggctaacataaggatggacagtgaatgtcaggcttacaagatctcaggtgaaaatgaagtactcactgggaagaggagccaaggtttttttgttttgccttagcaaagtaattgactacacattgatcctttccaggagatctgtgaaactgaacttgagggtgatgatttagagtgtatctggtagaatgaacttctaagcaacaatgctcaagagttgtcctgcctacattgaacagcctgcgcacctatgtgtggtcaaagaaatgactataagttggaacttatatttaaatgagaagcagagcttaaacatatggaaaatttgtaatctccacaagtggtcagaaagaaaagctgattttcagggggaaagtcaagaaggcttcagatatttgcataaaaaggagccgagtgctaataattcaagataatgggaaaaaggccttgaaggcatttcagagactttttcagcagcccttgctatcacaggccctgaggcctgggagaaaagaatggtttccttctccagccccatgaccccgctgctatgtccatcctcaggacactgctggctggattcctgaagctccagctccagccatggttgaaagatgcacaggtacagcctgggtcactgcttccgagggtgcaaactgcaagccttggtggcttccacatagtgttaagccagcaggtgctcagagcacaaaactggaggctggggatcctttgtctggactccagagtatgtatggaaaaagttgggtgtccaggtcgaaatttttccaagaggcagagcctcctttactagggcagtacagaaggaaaatatagggttggaaccccaatacagggaggcaccattctgcaaaca

SEQ ID NO: 1579 - DNA, 1506 bp, Homo sapiens
ctgtctcaggcttctgcttggaaacagtgggtggtggatatggggtggtgggcggatccttcaccaacagtgaagcaccatcttcttgatgctgatctcctgatagtgagctctcatgagatctagttgtataagaggatgttgcacctctttcctctctctgtcttgcttctactcctgccatatgaaacatttcattgccgcttggccttctggtatgattgggaggcttcctgagtcctcctacaagcagaaaccactgtgctttctttaaagcctgaagaactgtgagtcaactaagcctcttttctttatgtagatacagaaaattaatgctgtgaagtgaagctatgaaatgacttctaggcctttcccccaatctcttggctattagcactgagcttttttcaatgcagatattggaggccttcttgatgtttccccctgataatggtcttttcttcttttaccacattgccaggctgcgaaaaagatagctgacagtgtagaagcaggttctgaattaggtaatggccagaggttagagagttcggagagcttggaagaagacaggaagatgagggaaagtttggaccattgcagagacttgttaaatagttgtgattaaaaggctaacataaggatggacagtgaaggccaggcttacaagatgtcaggtgaaaatgaaggacttactgggaacaggagccaaggttttttgttttgctttagcaaagtaattgactacacattgatccttcccaggagatctgtgaaactgaacttgagggtgatgatttagagtgtatctggtggaatgaacttctaagcaacaatgctcaagagttctcctacctacattgaacaccctgtgcacctatgtgtggtcaaagaaatgactataagttggaacttatatttaaatgagaagcagagcttaaacatatggaaaatttgtaatctccacaagtggtcagaaagaaaagctgattttcagggggaaagtcaagaaggcttcagatatttgcataaaaaggagccgagtgctaataattcaagataatgggaaaaaggccttgaaggcatttcagagactttttcagcagcccttgctatcacaggccctgaggcctgggagaaaagaatggtttccttctccagccccatgaccccgctgctatgtccatcctcaggacactgctggctggattcctgaagctccagctccagccatggttgaaagatgcacaggtacagcctgggtcactgcttccgagggtgcaaactgcaagccttggtggcttccacatagtgttaagccagcaggtgctcagagcacaaaactggaggctggggatcctttgtctggactccagagtatgtatggaaaaagttgggtgtccaggtcgaaatttttccaagaggcagagcctcctttactagggcagtacagaaggaaaatatagggttggaaccccaatacagggaggcaccattctgcaaaca

SEQ ID NO: 1580 - DNA, 566 bp, Homo sapiens
actgataataagcttttctttttgaccacttggccaggctgcaaattttcacaacttttaatctctccttgtcatttaaatatgtttcaccttgaggtcatttctttggtcacatataggaccacaggctgttcgacacagacaggacacctcttaagctttgctgcataaaatttccttccaacagatacaatctaaattatcaccctgatgttcaaaatttcacaggtctccaggttaaggacatcgtgccgcaacgttctttgctaaggaaaaaacaaaagtgaccttgcctcctgttcccagcaagctcctcattttcatgtgagaccttctaagcctggtgatcactgtccatccttctgtcacctttttaattacaactatttgacaagtctctacactgatccaaacttttcctcatcttcctgtcttcttccaagacctctaaactctccaacctctggccattacacacttcttaacctgcttctacattttcagctacatgtgtcacagcctggcaatgtggtaaaagaagaaaagtccatttcaggagaaaaatt

SEQ ID NO: 1581 - DNA, 451 bp, Homo sapiens
gttctcttcatgattttggagctgtgagactgaatgaacactgacctgcgggattttggatgtccattgggcctgtggtcccatttgtgttatttttcttggaaatttcttccctttggattgagaaagcttacccaatacctgtaccatcattgtaccttgaaagaaacgaacacccttttaacttcagggactcataggcagaagagattgtagccttgtctcagatgagactttgaactttttacatttgagttaatgcgggaatgagttaaggcttttggaaactttgaaaagacacgattgtattttattctgtgagaaggacatgagatttggggggtcaaggtcagcataatatgatttggctgtgtgcccctggaaaaactcatgtggaattgtaatccaaaatgttggagttggggtctggtgggagattatttaatcatgg

SEQ ID NO: 1582 - DNA, 443 bp, Homo sapiens
atgattttggagctgtgagattgaatgaacactgacctgcaggattttggatgtccattgggcctgtggtcccatttgtgttatttttcttggaaatttcttccctttggattgagaaagcttacccaatacctgtaccatcattgtaccttgaaagaaacgaacacccttttaacttcagggactcatatgcagaagggattgtagccttgtctcagatgagactttgaactttttatatttgagttaatgcgggaatgagttaaggcttttggaaactttgaaaagacacgattgtattttattctgtgagaaggatatgagatttgggggggtcaaggtcagcataatatgatttggctatgtgcccctggaaaaactcatgtggaattgtaatccaaaatgttggagttggggtctggtgggagattatttaatcatgg

SEQ ID NO: 1583 - DNA, 2067 bp, Homo sapiens
gtccctggctccccaaatctcatgtccttctcacattgaaaaatataatgatgccttccctacaatcccccaaaatcttatatcattacagcatttattcaaatgttgaaagcttaaagtctcatctggcacaaggctacagttgcttaggcccatgagcctctgaactataaagcaagttaactacttccaaggtacaatgtttgtagagccattgggtaagcattcccagccaaaagaaagaattttgccagaaaaaaaacaaaacatagacaggacttaccggtcccatgaaactccaaaaccaaaaggccagtcattcaatcctacagctccaaaatcaccctttttgaaaccctgtcccacatccagggcacaggggtgtgagggctgggctcccaaggccttgggcagcttggcacctgtggctttgcagggtttatgcccacggctgccctcaggacctcggctggtgttgagtgcctgtgacttttccccactaaggatacaagttgttgggggtctatgaatctggggtctgcatgatggtggcctccagtgtggaggctccaaccccatgttttccttctgcactgccctagtagaagtttcatataaggctctgcctttttgggatgtttttgcctggacacccaggcatttccatacatcttccaaaatctatagagaggtttccaagcctctggtctcatgctccgtccaccaatggcttaacacaatgaggaaattaccaaggcttctagctggcaccctctgtagcagtgacccaagctgtagctgtgcatctttcagtcatggctggagctggagctggagctggagctggagctgcagggatgcaggcagcagtgtcctgaggctgcacacagagggggggcatggaactggcccaggaaaccattcttctctcctaggccccagggcctgtaacagccagggctgctgcaaaggtctctgaaatgccttcaaggccttttccctattgtcttgtctattagcactgggctccttttcatgcgagtttctgaagccttcctcaactttccccctgaaaatcagcttttctttttgaccacatggccaggctgcaaattttccaaacttttgagttctgtttctcatgtaatgtgagagttgggactcatttaatgtaagtctcatccagaagtcatttcctccatcacacataagaacacaggctgtgtgatgcagacaggacacctcttgagtttgctgctcagttcattccaccagatactcagtaaatcatcaccctcaagttcaaaatttcacagatctccagggcgaggtcaccgtgcagccacgttctttgctaaggtaacaaaagtaactttgacttctgttcccagtaagtgcttcattttcatctcagaccttctaagtcaggctttcactgaccattttcctgtgagccttctgatcacaagtgtttaacaattctttacaaagatccaagctttcattcatcttcttgtctttgaagccctccaaactttcctgacctctgtccgctactcccttctgaacctgcttctacattatcgctatctttgccacagcctggcaatgtggtaaaggaaaacaagtccattttcagggggaaaattcttgaagccttcacatacttgaaagaaaagaagctgagtgctgattgccaagacaatgacatttaatagttccactttgcactactaattttctctatgatcataaagaaaagaggtttaattggctcatgattctgcagaccataaggaaacataatggcttctgaatctgggaggactcaggaagtctcccaatcatatcagaatgtccaggggcaatgacataattcatgtggcaggagtaggcacaagacacacacaggagagagggccacaccctattatacaaacagatctcatgagaactcactatcacaaggtcagcatcatgaagatagtgcttaaacactgatgaaagaacaaccacccacccccaattcttgctgtttccaaacagaagcctgctggacaggcaaag

SEQ ID NO: 1584 - DNA, 856 bp, Homo sapiens
tttgtgttttctgggaaattacttccctttggattgataaagcttacacaacacctgtaccatcattgtaccttgaaagaaaagaaatctcttttaaattcaggaacccataggcagaagggacagtacccttgtctcagatgagactttgaactttttacacaggaatgagttaaggctgttggaagttttgaaaaggcatgattgtattttgctctgtgttaaggacatgagattctggaatatcagggtcagaataatacggtttggctgtgtgtccctataaaaattcaggtgcaattgtaattccaaatgttgaaggtggggcctgggggagatcatttagtcattgattggaggaggttggggtggaaggaaaagggttgtaaccgagtgagttgtagagaaacgccaaaccatgagacgacttcaggagacctttattgccggcaactgagagaccgctggtgctcaaaattctcttggcctggaagaaggggctagattttcttttatactttggtttagaaaggggagggggagcctcgctgaaggactctcacagcagcaaaacaggcaaaaaagttaaaaagataaatggctacaggaaaacaaacatttccatgtgcaggggctttaaatccatccaaaggtgatagatgtgggggctttgggtgctatcaactggacacaaatgctggggttttgtgtactatcaaccgggcgaattcctgggaactgtggatatagcttgccagagtatcttatcagtaattgcattctttgatgtgctgggagtcagcttgcacaagttaagtccttgaggaaggggggtgggtaaggggctgcaagtgaa

SEQ ID NO: 1585 - DNA, 2217 bp, Homo sapiens
cacgacaattccacatgaatattggtagagagacagaatcaaatcgtattattctgactcttgctccccaaatcttgtatccttgtcacactgcaaaatacaatgatgacttctctactgtcccccaatgacttaactcattccagcatttactgaaatgtccaaggacttacagaccccatacaagtcaaaaacccagcaggccagtcattgaatcctacagctccaaatcattttttctgaatggatatctcacatccagagcacaggtgtgtcatggctgggctcccaaggccttgggcagctctgcacctgtggctgtgcacggtctatcccccacagctgccctcatgggctgggctggtgttgagtgcctgtagcttttccacaccaaggttggaaaagccagctgttggtgggtctatgaatctggggtctggagaatggtgcctccatgtttagggactccagtcttatattctccttctgtactgccctagtaaaggtttcccatgaggctttgcctcttggaaaagcttctacctgaaaacccaggtttttccgtagatactctggagtctagacaaaggctcccaagcctctagttttgttctttgtgcacctgctggcttaacactatgtggaagccaccaaggcttgaagcttacacccctgaagcatgatgcaagctgtacctgtgcatctttcagccatggctggaactagagctgcagggatgcaggcagcagtgtcttgagactgcacatagaggggggtcatggaactggcctaggaaaccattcttctctccgaggccccagggcctatgatagcaagggctgctgcaaaggtttctgaaatggcttcaaggccttttccctattgtcttggctattagcactgggctccttttcatgcaaatttccgaagccttcctcagttttcccctgaaaatcagcttttctttttgaccatttggccaggctgcacatttttgagttctgtttctcatttaatataagagttgggactcatttaatgtaagacccatccagatgtcatttcctcggtcacacataagggcacgggctgttcgatacagacaggacaccccttgagctttgctgcccagaagtttattccatcagatacacagtaagtcatcacccacaagttcaaagtttcacagatctccagggcagtgtcactgtgcagccatgttctttgctacagcaaaacaaaaggcaccttggctcctgtttgcagtaagttcctcattttcatctcacagcctctcaatctgatccttactgtctattttcctgtgagccttctgatcacaagtattcaacaattctttacaaagatccaaacttaccctcatctccctgtctttgaagtcctccaaactctccagaactccatctgctacccccttctgaacctgcttctacattatcagctatctttgtcataccctggcaatgtggtaaaggaagacaagcccattttccggggaaaaattcaaggaggtttcagatacttgaataaaaagaagctgagtgctgattgccaagacattagagagaaggccttgaagacatttaatagatccactttgcagtaataattttctccatgatcataaagaaaagaggtttaataggttaatgattctgcaggctgtaaggaagcatagtggcttctgcatctgacaggactcaggaagcctcccaatcataccagaacgtcaaggggcaaggagatgtctcatttggcagaagtaggagcaagacagagaaaggaaacaggtgtcatgccccattacacaagcagatctcatgagaactcactatcacaaggtcagcatctagaaaatggtgcttaaacattggtgaaggatccgccccacacacccaactcccactgtttccaggcagaagcctccttcagatgcagagcctcttggaaaacctctattatggaagtgcagaaggaaaatatgggcttgaagtccccacacaggtggccaccaacctccagaccccagattcataggcccaccaacaactcacgcccttagtgtagaaaagctacaggccctcaataccagcccaccccacgagaacagctgaggggctaaaacctgcaaagccacaggtgcactgccctagtagaggttttccatgaggctctgcctctgcagcaggctactcc

SEQ ID NO: 1586 - DNA, 1582 bp, Homo sapiens
cttcaaagtcacatccagagaatcatgtcactcttgtgctgaagaacctcttcacacaaattagtaagggcctcagagaacttttatgttggcaggtatgtctgctaatatttaccacttcagaaattaaaaatgtaattgaaaagtgacatgtctatgtaacatttatgttagcataaatattttaagtgaaaaatggctaaattttttgcctagcccttcttttggaggcttgtagggaaataaaatactgattatatctgtccctgtactcacacttcaagaataacacatagaattaacttggaatttggactagcaaagactgaattattgatcatcttaaaaatggatggaaatcatttttcatggtagtcgtatgatttcttggcaattagctaatttctcaggaaaattaagggtgacagtgtggaaggtaggcatctccgtcagtgtggaaataccaccctctaagacaactgctttatgcgtgggttgtacttcccttgccgcatagtttgaaaatgtctccaggaagaaagtttaccgggtgtgctttactgctctcaagtattgcagccttgtgctatccattgtccagacactgaaaagaattgcttcatatatttttacccaactttgattattaatggcaggaaagttattcagataccaactgttccatgatggttaaatctcagaaatctataattctcatagaagataccataggagagtatctttaaatcttggaataacaatgggtctcttcatacacacacacacacacacacacacacacacacacacacacacacacaaattaaacatggtggaaatttttgacaaatttaaccacattaaatattctgtccattaagattccccaaagatggtggaaagatggcaggttagtgggagaagatatttgcagcatgcaaggcaagatgacaatgcactaataacaaaatttcataaaacaatggacttggggcttgggaaaaataattatgacatgctttctgaagtgtccccagatagtttcataaaaaatggagcaaataggctaaagaaaaacccatagacatcatgttcaaaagaactgatgacaaggcatgttcataacccataaaatacaagtggatgcagctaaataactgcaatacttttgaaagagtttggcaggtttcgaagatgtgaggagctacaaagcagattaaaaaaaaaaaaaaacctaccacacatacatttaaatcaatacaaacatgcctgataattaaaacaaaaaaggcttgaacaagcactttaccaaaaaaaaaaaaaaaaaaaaaaacaacgaaaaactaatcaacgtggaatggtgttcagtcttattagcagccaggaaaatgcaagttaaggccacaaggagataacaccaaacacatgtaaaactgaaaaaaaacatttagccatcctcactagcaaatgttggtgaagatgtatctgtagtagtgggaacactcattatactggtgtgtgtgtaattcagtccaaccactttggattactttaaaaatctgaagttatgagtatattcagc

SEQ ID NO: 1587 - DNA, 1689 bp, Homo sapiens
gttttctgtccactgggcagctgcacaagcaatgcaagcctgacaatgttctgggcaatgttgtctggaactccagagcaaacatcgcttgccagtgttgttccctatcgagatgaaatgtccaggcctttacatcctcacctccgcttataactggatatggactgtcctgggtgacatgtgaccttcagggaggcagctgtctgccgctgagacaaaccacagaaaggtgacagttggagatgtctacagactgcgttccctgaagcctggcagcgagcactttctcgaaggggcatctagaaggaacatccccctgactaccacaatgcactccctttgcctctcggattcactttttcatatactttcagcaattagctctccatgaattcacgacactcttttttttggagagtaaaagtataacagattagttaagtgaactatagccctggtgctgtacttaattttcagggaccaagtgatacttatagactccttcttccacttttcattttctttcccctttatcctcagctactccctctgctggcctcaccgatgacttacctcatgatgagaccgagaccatcatccctgagggtgtgacttcctgttcatcacagcttctctggccagattgccgtatctgtctttttgcaattgtcacaattgggtgaagaattaccaagacctacttaactagattatctgggtgccacgaatattcactgctccattgcataacaccacttttgccttttcatcaacatgaaggtcaattaccattgccaagattgtgactccacttcttgtctgcttgtccttgaaacaaaaacctcagagtgcccaggggacagctgtgcccggtttctagctcagttggaaacttgctttttctaaccccttggggaacctggatgtctactctaaagcgtccagagtcgcaggcatgggaagtacaaagtcccatggtgggtcatgagaataatgacctctgcttcccttccttatatcacaaaaccatgtactctttctttaggccacagaatcacataatggtgtttgatgcaatgtatatcctacctcctagaggatggcatctatagtagtctgttctcacgctgctaataaagacataccagagactgggtaatttataaagaaaaagaggtttaatggactcaccgttccatatggctggggaggcctcaccatcagggcagaaggcaaaaggcacatcttacatggcagcaggcaagagagaacatgtggaggggaactcctgtttataaaatcatcagatctcatgagacttattcactatcacgaaaacagtatgggaaaaacccgcccccataattcaattacctcccaccaggtgcctcccaccaggtgcctcccatgatatatggggactatcacaattcaagaatctgtgactgttagttgatattgcaagaggaactttgcagttgtgataaagttaaacgaggagattaaccaagattacccaggtgggcccctctgaagtcagaagacaatgtaattacagaagcaaaggggtaagtcagaagacaatgtaattacagaagcaaaggggtagagaatgagacttgaagatgttgcgcttctagctttgaagacgtctagaaaggcagtctctggaaaccgggaagggcaggg

SEQ ID NO: 1588 - DNA, 674 bp, Homo sapiens
aggcagtggtgctagggtggatatttccaactctggtattacgctttcttttccttgggggtggggggaatccaagcaaatggtggattacctcgaaccacctcttccacagactctgtggtggtggtggtggtggtggcaatgctggtggttctctctgtggcttcttcgtagggttcctcagcctcttcctctacctcatcaccatcctcatcgtcctcgtcatcatcggcttcttcttcttccacctcagccacttcttcctcctctgctacttctactactttgtcttcactcccatctgcaaacaattccatgctttcactacatatgcctgtctccctgaattaaaacaagacaaacaactcacggcatcctcacctgcatcaaataacccatttatgaaacaaagcctggttgctaagcgcagccactccctggcattcagccagaaggaaatgtggccacattaaacattgccatccaagggttaactcccttttcctgagtgaagcctccaagaaatgacttaataaatgatacacagggtcctattcaggatctgttaatatggacactcttaaaattgaaatcttttaagattcaatttacctgccaaatacctgaaatctggcaggtatttgctgccagtaaaaaagcacagtcttacaaag

SEQ ID NO: 1589 - DNA, 1210 bp, Homo sapiens
cctcccgctctgcaatgcgacgttttgcatgctcttgatacagtgcccgatcgcgtccaaaggagtcaagatttggtgccatcagagctttgtctgcaaaacaacaacagttaaaattaaaagccatctttcaacaatcttgaggaaagagtttgcacagaataagccattacgacagactgcttgctaatctcaacggcaagattctgcaataactggtaaaccaggttggtccttatgatcatcgttaactgcctgttcatatagaagagcaagactggaagctgtgtgtgtgggcaggagctgtctaacagaggtgtctccgtcggatcactaggtactgagccagttcttttgttggggatccccagattttagtgtttcagggtctttattttggacctactctctttaatcaaaaaagactcccctaatctcttgcctaggtaaaagaaggggtgggggaaacatctgtccactatacttccctcatttctacgttttagttccacactatgaagatatgacagtaaggggaggcaaacaacccaaacgactgggtgagaggggagggaggtgagcacatgcaagatgaaagacatccaagttaagacttgcatatttttttacttatcaattgatatttactgatatcaacagagatgtgtcaccaaaatcagcaacaggaaaaacaaaaccaaaatttagctcttacttcagaatatcctaattatcagaccttactatctatctatctatttatttattgagacggagtcttgctcttgtcgcccagaatggagtgcaatggcacaacctcagttcactgcaacctccgccgcccaggttcaagcgattctcccgcctcagcctcctcctgagtagctgggattacaggcacccgccaccagctaatttttgtatttttagagacggggttttgccatgttggccaagctggtctcaaactccgcctcggcctctcaaagtgctgggattacaggcgagagccaccgtgcctgaccagaccctactatttttaaaagttgacttttttttttactgagtttttcattcatatttcaaaatagctctgaaattaggaaggaggtatgttcctgagtgcatcaattacaatgaaaaattactaaaccagaaagatttcccagccctagatgtgagttcactacacaccccagatgaattagct

SEQ ID NO: 1590 - DNA, 3491 bp, Homo sapiens
gaagtgggaagctgtgcccaggaaggggagtaactgtgcaaagttttatgcagtcagtgccagaattggattacatcacctgggggaggcgccttcaggaccaggaaatggtacatggagctttgaggtgaaaactcatcttagaaacccacaaaaagtcattcccccagcctgacatcagggacagaccacacccatggggcagaaaccgggcttggttgttgcagtgggaagagaaggcacgactctggtgcaccgagcacctttcctcgtggctgtttccaggcactgggctggatgtcctcagaaccccctgtcccctgcccactcctcaaacccttactgacccacccctctcgcctggtgctgtcccaggccctgggggtgagggggaggggactccaacgtgggcttgccctccagtgtggtgggagggaaccgcgtggccacttggcttagccgtgctcatggtgcagacgtggaacgcggaggcagggagaggctccgtgacgtccccagggccccagaacgaggaaggagcggagttgggattccagcccagttggacgctgaagtccctgttttgtttactgcctcctgttcatggcgtatgaatgtatctgagatgctttgtaaggcataaagtgcaatactagcttagtggctgttcgttcagtgattccttctgttaccaaacaggtggctgagatgagagggcaacccaagcctaacgcccttcagtggccttgcatcagagtactcgtgacaggtacctctccgtggagaggggctgtcctctgcccttgcctgctcctcctattgcaacagtcctgtggactagctcaggctctacaggggctggtgtgtgtgtgtgcgtgtatggtgtatatgtgtctacctacacacaagcacatgtgcacacatgcacacacatgcatgcaagcacacgcacacacacacatgcacacacactcacatggacacacacatacacacacatacacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgcaagaagaaaagaaaaacctctctcattccaggtctgtggtgcagatgggaagagtatagtcaaaacccattaaggccttagtcaaatgccagccgaattagaacgcaatgaacgttagacaaaacaacccaactggccaggcgggggaggcgcagagcgtataaatataaagttagatacttataaagaataaagactctaataaaatattttatataaaactttttacctgtgttcagcgtcagatgcttcaagtgattggctttgcattctcctaagtcgatggattcttaggctgtgtctagaatgcgtttgttgtccctctgggaagagcactgatttgtcgctcatgttctggtccaagacgtggctgtagatgagccctttctcgatgatgttcatgtattatgttgaattgtcttaaagttttgtgttttctgttctcccagaatcctcacccatgtcctcctgcctcgtgatgttggccatgacctcgaaatgtgcctggaggaggctcgaggcagggctagcaggagggcactgggccacaccttccctttggtcctctccacccttgcaggggctccctcaaccggggctctggggcggtagctctggcagggcgacgtcgcttcttccttactctgctttgctggaaacccatctcccaggctgagctctgtagaggcagctgctagtggggaaggcagcccctctagaggttttggtcccaaagttgaggtgagcagggcctagcagttgctcagtgttatgtgctgcattagcccatggttccccgagctccggccaggcagtgaccctcagagtgaagactttccgggacaccagtggcttagaactgggctttcaaatccagcttccctcccacctctgggacacagagcagagagccgggctgggtgaggtcacagaatcggcccgcagtggcccctgcactcctcctatggcgggcaggcacaatcgaaggctgccccaggcgtgcacacaagctcgcgatgcacagttttcttcccccctcggtaaccccagcctttctggacggcccggccgccctgggtcccagtaatgttaaagtcacggtcctttccaagccactgtacttgggctgtcccgtcagggaggttcctccaagataattgccccctgcaaagacaggggcttctgatgtccacttgtggggctgacctttttggggaacctccctgggaccagaagcagggaagaaataagagaccctgcacccccatggcacagtctaattttcacttacaagctcaattcaggctgtccttaaaatccacgtgtcctgggcaggaaggaaatgtggggacaggcacacacgcacatccttctgctatgctgacctaaagttcctaatagctatcctacatcctgcccgtttcttttttccatatttgaggaaacagaagggtttagccttagcctagtttttttatgttatctctgaacaggccaacctggaatcacccctcacacagacacgtgtggcctgccccagtgtgcctgaggcccacccaggaaccctgctttgcctggggtttatgtgaatgacacacatgtgagcagaggctggggttaggaccctgaggcttccctgttctcagaaatactctcctggcatcaaaaggagaaaacggtccatgccactggctaccacattccagcctggcaagggtttactgtttatagaggcaccgtttgggggcttttccatgtagaatggccgttgtaaagctgaagagaaaggaacagaagcacaaaagcaccttgattcttcgcaaacacaggcaggggctgccggctggacgagggcgctgcattttgagggcgtgctggacccgctggcagagcccgccctgagggttttctctgcagctgtgggctaagcttgcccaagcccctccccttttccagaaagccacccccatggccacttgcctttcaggtccaggttgaggacacagccacgggcatatatgtatttgtttcactggggttcatggttctggggacagtcttctagcccccgagatcttgggaaaggcatgagctcaagccacataaccaaaaagtagcaaaactcaaaattattactttactttcagctgttttctctcaatagcgcgccaccatcgtctgtgtgtctgcactgaacaaacatacgagagaatctggctgatcactttgagtgcctttggcctaaactttgcacatgactttaaacgtggccctgatactgcacacaatttctgcttctctttccttttgctttcaacagcccc

SEQ ID NO: 1591 - DNA, 367 bp, Homo sapiens
cctcgtagcagtgttctggaatcctacgtgagacacaaacattcgtaccacagcagaagtgttccggaatcttatgtgagggacaaccattcagatcacagcaggagtgttctggaatcctttgtgagggacaaccattcagaccacagcaggagtgttctggaatcctatgtgagggtcaaacattcagaccccagcagtagtgttctggaatcctatgtgagggcaaacattcagacccacgtggcagtgttctggaatcctatgtgagggacaaacattcagaacctcgtagcagtgtcctgaaatcttatgtgagggagagacatttagaccctcgcaacagtgttctggtatcccatgtgag

SEQ ID NO: 1592 - DNA, 342 bp, Homo sapiens
cacagacctttggggcactgcctcgctttgggacaactcgggaccgcatagacgggatcatggcacaagttgcagtttccaccctgccaatggaagatgaggagtccatggaagatgaggagtccattgaagatgaggagtctgttgaagatgattccgtggagagcaggatggtggtaacatttctcatatcagctctcgagtccacggatcatggcacaagttgcagtttccaccctgcccattgaagatgaggagtctgttgaagatgaggagtccttggagagcaggatggtggtgacattcctgtcagctctcgcctccatggtcagaccttctgtt

SEQ ID NO: 1593 - DNA, 1179 bp, Homo sapiens
cacagacctttggggcactgcctcgctttgggacaactcgggaccgcatagacgggatcatggcacaagttgcagtttccaccctgccaatggaagatgaggagtccatggaagatgaggagtccattgaagatgaggagtctgttgaagatgattccgtggagagcaggatggtggtaacatttctcatatcagctctcgagtccacgtatgtcccggagaaagtgtcagagcctttacgtggaccttctcatgaaaaaggaaacagaatagtcaatggaaaaggaaaagggcctcctgcaaaacatccttccttgaagcctagcactgaagtggaagatcctgctgtgaaaggagcagtacaaagaaagaatgtacagacattgagagcagaacaaaccttaccagtggctttagaggaagagcaagaaaggtgtgaaagaagtgaaaagaagcaatcacaggtcaaagaaggaaataatacaaacaaaagtgaaaaaaatacaactatcagaaaatgtatgtcatagtacatcttctgctgctgctgacagattaaccaaacaaagaaaggttgggaaaacgtatcctcggcaatttcccaagaaactgaaggaagagcatgatagatgcatcttaagacaagaaagtgaagaaaaaacaaatgttaatatgctgtacaaaaaaatagagaagaattagaaaggaaagagaaacaatataagaaagaagttgaagcaaaacaacttgaaccaactgttcaatcactagagatgaaactgaagactacaagaaatactccaaatcagataaatcaatctttggattttcataatcacgaagaaatgaaagatctgatggatgaaaattgcattttgaagacagatattgctatactcagacaggaaatatgcacaatgaaaaatgacaacctggaaaaagaaaataaatatcttaaggacgttaaaattgttaaaaaaacaaatgctgcccttgaaaactatataaaactcaatgaggaattgataacaaaaacagcattccggtatcaacaagagcttaatgatctcaaagctgagaatacaaggctcaattccgaactgttgaaggaagaagaaagcaacaaaagactggaagctgaaattgaatcatcagtctacactgactgctgctataagt

SEQ ID NO: 1594 - DNA, 2880 bp, Homo sapiens
tgagaattgaattgtgtcatcagcaggaatgattgcttgtttgttggtggggaaaaactctccacacatttggtcacagaagccttctttgttgatgtttgttgctgtggtgtgacagcagagaaaaacgtgtcaagtatgtctttctgcgcatatagtggataaggggtactagtgtatactctgttgtaatggcccctcatattttggtccagaaatcatgctctttgacactgttgactcatcacacctgttctgctaacaataccatttttactcaatctcataggctttggctaggatgacttgtatactgcagttcacttgtagataccaaattttaataaatttattcttctttgcatctaataaacacagagggaagagttcttactgcattaattacctaccaatacgtttaatgaatgttaattctaataagatcccaggcatgctcccaaaggaatgctttgtaacaaagcgtcagtcttatgctttaaaaaaccaaaccaaaccaaaacaacaacaacaacaacaacaacaaaaaacaggatctaaagcatacacacaagtgtgcacaatttttttatgaaggtagagtcttactatgtttcccaagctggtctcaaacttctgggctcctcaagtgatcctcctgcctcatcctcccaagtagtttggattagaggcatgcatcactgtgcattcttatgattttaatattctgtacatttattattgatttaaaatgcattttacctttttctttaatagatgttggaatttctgatgaatctgcagtcagtctctctccttgggtgtctgagtgcctatgaaaatttttaagggcttgctagtttatgtggacctgaataaggtaggacctatagagtgaaaataatgggattttataattgttaatattttaatctttctgggaaaagtattctcaataagaacatacacctttgctatttgacttctgtacatttagctttcatacatttcaaatattgtgggggctttcctgtaccaatttagggtaaaggaaagcaataggaccttcctaagttggatccaggctgaggaatcaagactaccattttgaagtgatgtagattagtcttttatccagagacagatcatggaaaagagacagtggatctttctaccttgttttaggtcatcagttttattccagtttagggaacaaaatttatgtcatccattaattgaattttaagttcagcttcaggacagataatttgtgagggcacattattgtcaggctctgccaatatattgactgtcactatttgttataaacctcaaggttagttttcattgaatattttatagatttagacaggtggaggcagaaataggtaactaaaatctatttttagaacagaggacatattttaattatatcaagaatcataatttaatatatagatcactgacctttccccagattatgttttcctttttttgagggggaagctggatataaactggcagttaaaaaaattgtaaagaaatcaacttgctcattttcattgtgtatttttgctctcaagcattttgcatgaactgtgtgtggattcattgcctacattggatgatgaagtcttgagtgttgctactaaggtaaagtggtctcttgtaaaattaatcttctcactctgagtgtagttttgcatagcatttacttttcaaatttagcagtggtttacctatcattgttttatggtggtaatggaaagctggtcagagaaaaacatacccatggctagttgattcaaaaaatgtgtttaactttggtaactaataaagattggtaagtactgtgacagggtgggagctgaaaaataaatgaactggaaaataagtagtcacaggaaaatcacattaggaaatgctttctccaatagaggaaatatgaaatttggttaaacttcatttggataaatactaatactttgacttttaaatcacacaagtgtgactttcttaatatttattcctgtataaatcttcagtggatcaaattgtttgcagtaatcatggaatcctcctggtaatttttagtggcagaaatgttcagcacatagcatataggttttgttcttggaaacttatcattttggtgtcatatagtttttaggagagattgtttctctacttatattattggttctgtagtgagactaaaaaagtattacaaattatagaaaaatagctgagtttggtggtgtacacctgtagtccctgctacttgggagtttgagacagtaagattgcttgaacacaggagcttgagaacagcctgggcaacattgtatctgatttaaaaatataaattgtggaaatgtagaaatttaaatttatgttctcaagatttgtattgcaaaggggtttttatgtgatttattagttgtccatgaagagtttatataaaacacttcatctaattgaataacatgtattttcctgcaaataaccagttctagaagcagagactcttaataccaatatggtaagtctttatcatcataattttgtcattgtagtttatttaaaatatttacttggccaggcgtggtggctcacacctgtaatcccagcacttttggaggccgaggtgggtagatcacctgaggtcaggagttccagatcagcctggccaacatggtgaaaccctgtctctaaataaaaaaaaaaaagcacaaaaattatccaggcatgatagtgcatgcctgtaatcccagttgctcaggagaccaaggcaggagaatcgcttgaacccaggaggcaaagattgcagtgagccaagatcgcaccattgcactgtaggctggttgacagagcaagactaca

SEQ ID NO: 1595 - DNA, 2323 bp, Homo sapiens
cactagccaccgcacccagcaacatatggggattttgtttcaaaagttctgtttcctggatctaccaagctcatgagaaaatagagcaaacaagtcatttgcataggtaagaaactttggatttatagcttgtcctcactactctagaagattatcatcatgttttgcaaagcaaaatgttaaacacagacataaggggaaaaagaaattaaaactataggggtgggtgaaaaaatattgcataatttattactgttgacctcatcatatgactgattaagggccctgaatttaacttggatgtgaagtagacctcatattagctgcagttaatcagtagaccaggcgtcatagcagaattaaatttgatgctcctgtgttatctttaaatgacacagcttttctgaaaacccttactcatagtgcatgattatccattaagaaaaggtgatggaatatgtgaatacagctgaggagacaccacaaggcagatgctcagtggttcccattaatattgggaaaatcaaccctataaaacagaaagccatagacattatttaatatttggttttgggaggtatttttagtgacactgcatacagttgtacctaataattgctaaattagagacgtaaaagtaaaacaaagtcacattgtgtttgagtaggaaatctatagacatctagctggttttcccatccagccacaaaattctaaatataatcatggtacctgcactcaaatttatgttaaataccaacctcaatgaaatcactctttcttctcattctctttgttatttatatgttgctttccttaagggaagaataaaaatgccttgctaagaaccattctgtttggttgtaggctgcataaggggagtaaacacaaagtacatttgaccacaaaatgactttttaaaagtcagaactatggtagcatgaagccaaacgagattctacttctgcagggttccacagaagtctccaatcttcaaatcttcagtgtatgaaagcacagattcctgaaagaatggtctcaaatgaccaggagtaggagctctgtatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagaggtgaggagacacctgccctgtgccacacatctatgtagttcagcaatttccagccccttagtactccaggggctctaagccacccctttgtaagtcaggatggaagtagatgacaccacatttctatctgctgtagacattcttcccagtgtctcaaaatgttttggcatctttcagtaaaaatcttcaagtttgtcagtccttgatttaaaaaaaaaaaaaaagcagcaaaatttttagagctcccttgaaccttctattttaatgtgtctttgtagataattcccaacatcttgtgtccttcattttataatttatctttatcaaacttgtcataaaccccaatactttgatctcttgtagaagagtccgtactcctatccaatccagtgttgtttatcttcaaacttggacttcccctgctcattccattcttatctacttccattgggttcaccagctaattccattctcattctatccacaggcttactcccgtttgtattattaaaacacacgccaataggacataaaaagaagcaagagtactgggctttaccatgagttcaaatctcatttctgccaattcctatgtctaaaaaaaaaagcttcctaatctctttgagcctcacattctctatctagagaatcacttgaccagaatgttcaatgcagataaaaatactagaaggtattttaattcattccaagattccttaaaattctgtaattctatgtcctcttgattctgtctatagaaaaacttggaatacataggcagcagagtttgaaaaaataatagaacaaaagaaacacccagaaaaacagagaagaaagttttaaaaaatgaagacaagattatataaaagtcatggaaaaagcaacaagactaaaaaatgtattatggaagtaagcagaaatacttgcctaaatggaaaaccaaactgggaagtcaaataatttgtctctaagacttgcctaaacttgctttggtaaaacttacagtcctatggccaaagctaagtcagatctgccctagagcctttgaaggtaaaaataagatactggttaccactgaaatcgtc

SEQ ID NO: 1596 - DNA, 965 bp, Homo sapiens
tgaacacaagacgtttccgtacaagtaaaaatgagttctgatatttccgaagtagaagataagaatgaatttcttactgaacaactttctaaaacgcaaattaaattcaataccttaaaagataagttccataagaaaagagatactctcagaaaaaagtcattggctttagaaactctccaaacgacctaagacaaacacagcagcaaataaaggaaatgaaagagatgtatgaaaatgcagaagctaaagtgaataattccactggaaagtggagctgtgtagaagagcggatatgtcaactccaacatgaaaatccgtgcattgaacagcaactagatgatgttcatcagaaagaggatcataaagagatagtaactaatatccaaagaggctttattgagagtggaaagaaagacctcatgctagaagagaaaaataagaaactaatgaatgaatgtgatcatttaaaagaaagtctctttcaatatgagagagagaaagcagaaagagtagtggttgtgagacaacttcaacaagaagcggctgacagcctaaaaaaattaactatgttagagtctccattggaaggtatatcacattatcacattaatttggatgagacacaggtcccaaagaagaaattatttcaagtggaaagtcaatttgatgatcttatggcggagaaggaagctgtatcttcaaaatgtgtcaatttggctaaagagaatcaagtttttcaacaggagttattatctatgaaaaaagtacaacaggaatgtgaaaaacttgaggaggataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggtgagttgtttaaatcag

SEQ ID NO: 1597 - DNA, 524 bp, Homo sapiens
ggatatgtcaactccaacatgaaaatccgtgcattgaacagcaactagatgatgttcatcagaaagaggatcataaagagatagtaactaatatccaaagaggctttattgagagtggaaagaaagacctcatgctagaagagaaaaataagaaactaatgaatgaatgtgatcatttaaaagaaagtctctttcaatatgagagagagaaagcagaaagagtatttgatgatcttatggcggagaaggaagctgtatcttcaaaatgtgtcaatttggctaaagagaatcaagtttttcaacaggagttattatctatgaaaaaagtacaacaggaatgtgaaaaacttgaggaggataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggtgagttgtttaaatcag

SEQ ID NO: 1598 - DNA, 1133 bp, Homo sapiens
gttgattcctttagaccttgaaccctggccagtgatttgaaaccaagcagtacctatctccagatctctagtaccaaattaatttggggtggggggtaacaggtttattgagaaataatgaacacaccatgcaattcactcatttaaagtatagaattcattaactttagtattttcagagagttatgccgtcatcattacaattaattttagaacattttcatcaccctaaaaacaaaccccacagcatttagccatcttcactagttttcccttcctccctcagccctagggaaccacccaccttctttgtatagatttgcctataagcctctgaaataaaaagcaagtggtctgctgggactggcttatttcacttagcataatttttcatgctgcatctgtgctgtagcaggtattgatgccgggtttttgctccttagttcagctacatctgggttcttctctcgtgaccaggaaaaattaagcatgcagacacattgaggagggcagaatttattatgtgaaaggacagctctcagcaaagagaggggtcctgcaaagaggtttccacctcacaattgaataccaggatcacatgagctgaagcggccaggctcctcctctgcataaggcgtgaattcctggtgactccaccccatccccccactgcatgtgggcctccggtctgctgtgggcatgtccaggcaagacaagtccaggttcccttatctgcacataacatctggtgtaaacacttgtggggctggttggagattctccagggacccttccgtatctgcctaggcattttgctgtctcctcctaatacgtttgatgatcttatggcggagaaggaagctgtatcttcaaaatgtgtcaatttggctaaagagaatcaagtttttcaacaggagttattatctatgaaaaaagtacaacaggaatgtgaaaaacttgaggaggataaaaagatgttggaagaagaaatattaaatcttaagacacatatggaaaacagtatggtagaacttagtaaactacaagaatataaatcagagctagatgaaagggcaatgcaggcagtagaaaaattagaagaaatccatttacaggtgagttgtttaaatcag

SEQ ID NO: 1599 - DNA, 1815 bp, Homo sapiens
cccaggtaatgtgtctagagtgttgggcagaagaatctgggaccacaccacaccagttctctccttaatccacgtcatttgccttctatcccagctatgtttccagtgtcccctgggtgtttccaagagcaacaagaaacgaataaatctctgccataggagttttagccaattcagaggccttgctgcccacaatttggaaaattcctttggatttgaccaagtcaggaagagacgggagaaaagtgaaacaacaacaataaagccccaagcataaacaaacaaaaagagttaagcaaaacaacaaatgcacaattcatatgattactgagtgttctaatggtaaggagaaactaaaagcagaaattaaaagcagctggtgagtaatcttaaattttaatcattaaggaaaaattttaagacaaaactctaattcagctacttacctggaaacaaggctcaggctggtgatcgttctctgccatcttagaagctggaaacaacttacactcaccttccctgtcagaagcaagctgaaactcaggaaaggaggtgcctgctctccatcaccacagaagcaggaaaacttgccttccttgttggaaatgagtaaaacttcagaaaaggagttgtacagcaaaatcaaacttagatctcaaccagattttgggagatcagggactctttgcaggggagaagctccacaacctcagcaaattatcctgttggtttgggcaataaagatagcccaggttggtatcaatcaataatgagatttatcaaaggtcaggaccacctttgtaatgtccttctctgtctttttttatctttattggtatatacgttttgtcgaaactgggagtgtaacacctgatttcttctgttttccattggcttgaaagatttttcaccattccttcattttgagcctatgtatggcactgaatgtgagatgggtttcttggagacggcatactcaaatgggtcttggttctttatccagcttgcccccctgtgtctttcaatcggagcatttagcccatttccatttaaggttagtaatggtatgtgtggattagatcctgtcgtcatgctgtcagctagttattttgcagacttgtgtatgtggttggtttttagcattactggtctgtgtactttggtgcatttttgtagtggctggtgatggtcttttctttccatatttagtgcttcattcaggagctcttgtaaggtagatctggtgataatgaattctctcagcatttgcttgtctgaaaaggatcttgtttctccttcacttatgatgcttaattttgctggacatgaaattctgggttgaaatttctttttcttttaaccatttataataacaccatgttattatatggtatatctgtctctgccatactacatgaaatttcttttctttaagaagttgaatatcttttctggcttgtagggtttcagctgagaagtctgctaagtctgatggaatttcctttgcaggtgacgttgcctttctccctggctgcctttaacattgtttctttcattttgaccttggagaatctgatgattatatgtcttggggatgatcttctcgtggcttatcttactgaggttctctggatttcctgaattggaatgttggcctgtctggataggtttgggatattctcatgaatgatattctgaagtatgttttccaagttggttccattctcctcatctctttcacgtacactaatcagtcatagatttggtcgtttatataatctcatatttcttggatgttttgttcattcattttcc

SEQ ID NO: 1600 - DNA, 498 bp, Homo sapiens
tggtctgtgctctggaagttcacggagaggagcagcggtagcctatggtgttctgcctctgagtgtgtcagagcaggagagggagcagccctggcttccccagcctctcctgccaggcccacctcagaggatgaacacagcagctgtgggaatgctgagcgggaactcatctgcctggggacctgtcagataatgatcctgtttcatgaaggaacatttctggttgttgcttggaaaagaagtgtcggggcaagaatgctacaggagggccggcctggaggacagggcgggactgcagggctggctgtgcgggggcaggagcctgtgcttgcatcagagctgcctgggagaccctggctctggggtggaggcctgagtaagggggcctcgctggggatttggggacctctgtgtgctggtgccttcccgcctccgttcctctcagccctgactggctctgtcttggaaccaggtaactacctttatttgagaacctgc

SEQ ID NO: 1601 - DNA, 255 bp, Homo sapiens
gtccctctattcgcttttctccctccctcaactccttccagtttcctttcttgcagctaacaagcatgaacaaacctgctttaaaaacacagtacaaggctgggcgcagtggttcacacctgtaatctcaacagttttggagaccgaggcgggcggatcacctaaggccaggagttcaagaccagcctggccaacatggcgaaaccccatctccactaaaaatacaaaaattagctgggcgtggtggcccacgcc

SEQ ID NO: 1602 - DNA, 218 bp, Homo sapiens
cccttcttcctcccccaggaggcctcccctggctttctctttctacagaaacaccaaggaggcagccaccaaggacgaggggaggcccaggcattataccaggcagcggagccagccagtccccccagatggtggagggaggtggtggaggtgtctgggaccagaaaatagtgaggaccctcttactgaagtgaggacgggtggcataaactgaggcc

SEQ ID NO: 1603 - DNA, 475 bp, Homo sapiens
cttggctctcagtttgctctcccttctctcctctgcctgccccaagcccctctttctaaaaaagtgatggaatattcatggggttatttcttgaaaatacttggcggcctccatgcttctgttttctttgagccaggtggtcaggagggcttacaaagaatgcctgggctcccccgcaggtgccggcagatggggtagcgaatggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggacacggattgtccagggattacattccagcatcttattagatggggtttgctgcattgcccagactgatctcaaacacctgggttcggttgtcctgccttggcctcccaaagtgctgg

SEQ ID NO: 1604 - DNA, 1060 bp, Homo sapiens
cctgtatcaaaatatctcatgtaacctataaatatatacacctactacatatccaggaaaataaacaaaaaaaaaaaataaaaaaaatttaaggccgggtacagtggctcatacctataatcccagcactttgggaggctgaggcaagagaattacttgagctcaggagttagaccagcctgagcaacacagcaagaccccatctgttcaaaaaatttaaaaaagtagccaggtggccgggtgtggtggctcatgcctgtaatcctagcactttgggaggccgagacggaagaatcacttgaacccgggaggcggaggttgcagtgagccgagatcgcgccactgcactccagcctaggcgacagagcaagactctgtctgggaaaaaaaaaaaatggttttgccatgttgcccgagctggtcttgaactcctgggctcaagtgatctacctgcctcagcctcccaaagtgctgggattacaggcgtgagctaccgggcctggccacaagactatttcttttgggtcttcaagtatgtgctattcaaatagatcctcaaccaacattagctctaccaattaccctgaaaaggtggtgtggtaactaccctttggctagagatcatgccccaagccaagactaaagggacaaatatagggtggacacatatcttagtacaatctttcaggagctgcccgtggccttcagagtaacactcttcagtctgccagcaagacccctcttcgatcaggcagctgtctccctcaactcatctgccttcccaccatacccccaatttagtgctgctgttgttgtccctgctgtcatcaccattgtaataacaatttattgagtgcttactatgttccaggcacagtgctcattcacaggcatctcatttaatccccacaaccaccctgcaaagctggtcctattattatcgcttttggatttgaggcttagagaggttcaataacttgcccaaagacacaaagacaaatattcaaatatgtgtgaaatgaacacgaagcctgtacttgctaactctgctatactgttg

SEQ ID NO: 1605 - DNA, 3129 bp, Homo sapiens
ccggctttccaactttccgggggtcattagggaaaaacattcgttgaacagatgtccttagggtcggcgcttttatctctgaaaggaagaacacttggaaaggaagctgcgtgtttttcctcttgcccggaagagccagcctgtatgtctcccttttgacccgaggccaagcgcctgaagcctcttggacttagttaacattagtccgttttctatgcgtttgtccttggcttggtttatggtgtttgttgaaagagatggggtctcttctgttttcccatgatggtctccaactgctggtctcaagtgatccttctgcctcagcctcccaaagtgctggtatgacaggtgtgagccactgtacccagcctaatttatgctgtttgaagaagcagagaagctgacaggtggaaggaaggagagagagttctgtggattgcggagggcttgtaacaaagatacagtaggagaagccaaggatgacagctggtgaccaattactaagcacactacactgggcgccccaggctgccctgccatcaccctgcaagggtctctttcctaggcccttgctgccagccaccccccaactgctccccaaagggaagactgggatttgggtactgaaggatttttcatctgttcacacgcgggcgttcaagctcaaaagcctaaccactaccactcccaggtaagtgctgaaccctgcacatgggaacaaccaagtgtgtccccaagatgcagcctcagacctagacagctacagtcctatacgatcatctgaaggtcctgacagctctgcacagtacaatttcatttatcaagggaaatgagtaaagtgccagattctagacccattttggctatgaattgaaggggaggtgggaagcacagtatctcattatgttgcctgtactaggaacagataaacacaaacacacaggcaacagggatttggggaaacaccgtgtcagcgctgcagtcagccaagcgcagtgccggcgctatcccccaaccctcaaagtgccttggcccaggagaaaagaaacccgctggccattcactgcagctggccagagaggggaacctcgaccatgtctggtgaaaggagtgaactcattgggacacagcctcgaaaaagcagtaacaaaaacacgtgaatgcctacgaacattcactgtgttttctccgtggactccctactgctattccacggtctccactttcagctctcgctgtttctcgtgtgagcctatccctttggacagtccactttgggagggggtcatggagccagggctccctctcaataggaatggaaaggaccctgcaagaatcaacacctatttttatcctagttgtgaaaacaaggtgcctccaattctctatgtccatcacagctgaataccaacaaggtgcagttcagtctgtcagtgacttctggtttttgttggaagccaacgcaatacagaactcaacatgcaggtcagaagagaaacactgaggaagtgaaaggaaacacctggagtcgggccaatgtctaaagtaaaaagagaaagcaaaggagaaaaatgatgcagtaccgcagcccaaacgactcccccacatggccacctccgatcctctggggaaccccatgtgctgctaggaaaacgagctgggaggaaaaggacagaaggaaaatggggaagcagtggtagaaagaaaaaaacgcacaaacaggcactagatagatacagcaaagcccagaatgtactaaaaaccacttgttgacagctggcatgcactcacaacaagctgtgtttccactgtggggaggccagtggcaggtatgggagtggaagctgcaggaacatggcccaggggttcaccaggctgtggtcctgctccaaccccccatgttccattccctcccaaccgcaggctcattcttgctccttgtgaacgaattccactctgggtctggcacccctgaagatagcagagttgggatcggctacttcattgaggggcgtcacaacattcgaggtttaagctggagtcgtggtctttgtgctcttccctcctctgtcggttctttgaaatccatgttggatcgtggaagggaggaccatctctgaagtggctgcccagttgggggcctgtttcccagtcacctgggtgactacctcccctgcctcctaagaagtcatccctgaagcttcgtcatctggtacaccttttctgaatccaaagccacctttatcttgttttctgccttctgcaatgtccacatgaagtgactgattgcccaacagtgcaccatcgtatgtcaagcttccttaagggaatccacttcatcgaattctatatagcagaatcctttaaatttatctgtgtctttgtctctgactacccgtacactccttatgctgagatccttaaagatagcatctatgtcgccctgaaccatattaaaaggtagattccctacatatgctgtgtgtggggctctgtgagcgactccttctggctacgggaaccatggccaccagtactgccgtgggaccctctgttttttttttttggttttttttttttcgttttttttttttttcttatattgctaagatttacctacgttgcttcatgttactggggtttagttttagctactgtatatattccttcatgcgaatgtaccacagttattcattcaataaatttgtgttgtttccaagtttttgttattggaatagtctcatgcataagtcctgttgtacatttgcaagaatttctcgagtatatttttacaagtagaattactgggttatgactatgtgattgttcatctttttttgtggggggacagaatttcactcgtcgtccaggctggagtgcagtggcaccatctcggacactgcaacctccacttcccaggttcaagcacttttcctgcctcagctttccgagtagctgggattacaggtgtgtgccaccacgcctggctaatttttatatttttagtagagacagggtttcaccaggttggccaggctggtctcgaactcctgacctcaggtgttccaccggccttggcctcccaaagtgctgggattacaggcgtgagccaccacgcctggtggaaag

SEQ ID NO: 1606 - DNA, 769 bp, Homo sapiens
tggctagcccaacatgctgagggctcactaatattgcaacttttgattctaggtcactgtatttactttgccttctccaacactgttgcatcagagaatgaaaggaaggttgaattcaaggtatagaggtgtcaagagagaagcagatcacgaatgaaccatccctactgaggcatttgttcattgaaaatagattagttgaatgcaatcccatgcttggcatgtgtgacagtaatgggcaagacaatatgtctcctgctttcatggaatatatgttctccttcccagtattgcatcttccacagcatgtggacaggaatcagatgggcatagggcatctggtccatgatcatcctttgttcgtgctgatctctgatgaaatatctgaagaagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattcttatcaagacttccacctgggaccacccatcattctgccctttcgaattctgagctgacatcacctctgggtatatcaatgaaccacacagactcagccaacagaaaaccatggagaagagatcttgttatcattactgaaattttgattttaaatggaaagtttgttttcagccaagaaaaagctggtgag

SEQ ID NO: 1607 - DNA, 726 bp, Homo sapiens
cacagaaagtgctcccggtgcctgtggtccatagagtggagtgagtctctaagcaaatctggagggactctgggagctgaagattcagaatatctccacttattcttgccatagcctttgctgctcaactgttgggtgccatgatgatggagtcttgctctgttgccaggctggagtgcagtggcgcaatctcagctcaccgcaaactccgcctcctgggttcaagtgattcttctgcctcagcctcctgagtagctgggattacagggacaggaatcagatgggcatagggcatctggtccatgatcatcctttgttcgtgctgatctctgatgaaatatctgaagaagaaggagaacaccatgtgaagctggaggcagagattggagtgacacgcctacaaactgaggggcaccaaagaccaccagcaaccaccagaagctggaagaggcatggcacagatgaccacaagagcctccagaaggaaccaaccatgctgacgccttgattttggacttccagcctctcaaattcttatcaagacttccacctgggaccacccatcattctgccctttcgaattctgagctgacatcacctctgggtatatcaatgaaccacacagactcagccaacagaaaaccatggagaagagatcttgttatcattactgaaattttgattttaaatggaaagtttgttttcagccaagaaaaagctggtgag

SEQ ID NO: 1608 - DNA, 1264 bp, Homo sapiens
agcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctcatagggaaaccgaggacagatcttgcagcaagaacccccgacccccaacccagcggagaggagaccagggggccctcacctgtgagcaccccagcggtcagggcgctgaaggacgaggggaggacgacgggtcccacctgactctgcacctctgcaggctccctctgaaggacaactgctggcccctcagggcctcaggtggaaggcgtcgggaagtggagcaggctatgtgagtcaaggatggaacgatggtcccagaacatcccaggagggtgtgacagcctccatctagaaggttctatcctcaggtccccaaggcatctgcagcacaccgtcctctgctgtgggtctgtgaagcagccactccagcagcaggacagtggtgcctgtccattccctctgctagctgccagccctgctgtcctccgcactttctggcaacctcactgtatgaaactccccaaatcctcctccacgtcaagtgtcaaaacagcccagtttaagtgctttcaggatttccacggagcctgaccgcaaagagcacgcggttctggagcatcccccgggcctggccgggcggggacacgggggtcagccaggtccgggcggctccctgaatcctggggacccaaaatgacaccctcgacctgagagctcaggccctaccagctcgggacgaccggattttctagctggaaggagccagaagccagctcaccgtccaacccgcaccctctacttttggcaaaggcacctccattttccacgaagagcttcctctgaccccccgcttcccgcgtcaatgtgtgtgctttgagcggggctgtcctcaccgcccagcttcaggggtaggggtggcacccaggcctggccactcaatcaccccatcctccttcctgcagcgataggctcaggaatggcgcttagatagaaactacgaccaaagaacccagtcc

SEQ ID NO: 1609 - DNA, 1628 bp, Homo sapiens
caggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctcatagggaaaccgaggacagatcttgcagcaagaacccccgacccccaacccagcggagaggagaccagggggccctcacctggcgctgaaggacgaggggaggacgacgggtcccacctgactctgcacctctgcaggctccctctgaaggacaactgctggcccctcagggcctcaggtggaaggcgtcgggaagtggagcaggctatgtgagtcaaggatggaacgatggtcccagaacatcccaggagggtgtgacagcctccatctagaaggttctatcctcaggtccccaaggcatctgcagcacaccgtcctctgctgtgggtctgtgaagcagccactccagcagcaggacagtggtgcctgtccattccctctgctagctgccagccctgctgtcctccgcactttctggcaacctcactgtatgaaactccccaaatcctcctccacgtcaagtgtcaaaacagcccagtttaagtgctttcaggatttccacggagcctgaccgcaaagaggtgagcacatttaagcccctactcccagcccagccccctgcatcagagttccagggctgactctgcagaggggaagcagcctcctcccagaggcaggcacacagtaggtgctcaagcaataggatttctgccatttccacacttttggaagaacctgcccatcccccatcctctgcccgctctcaaggaccgtcatcctgaacttggtaaggcggctcttcctactcccactgaatgaatgaggaaactgaggcagggtgcgggggtcgggaggagaggagcattgtccgaggcccccgggggaggccagggaaacctcagtccggcaggtccccgggttcccggcccccagggccttcttctcaacccacccccggcccctccaaggctcccactcacgcggacgagccctccagcttgccgtagagccagccgttctgggcctcgggcaccaacacctccaccacgtccccagcggagaagcgcagcagcgtgtggttggcgccctccgagtgggagaccagggcgcggactctcctggcgcccccgccgccgcccgggcgctcgccaaaggagttggagcgcgagctttgggcgctgccgctgtagagcgaggctgtgggcgggagagcgcggcggcacgtgggcaggaagttcttcctggcgtctgccctcgatccctcctgctgcagccccacccccgcgcctctcccggccctcctgccgccccggggcgggggcactcacaggccgacggcgtgcggggcagggagcgacggtctggctctagctgggacgcgg

SEQ ID NO: 1610 - DNA, 1263 bp, Homo sapiens
ggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctcatagggaaaccgaggacagatcttgcagcaagaacccccgacccccaacccagcggagaggagaccagggggccctcacctgtgagcaccccagcggtcagggcgctgaaggacgaggggaggacgacgggtcccacctgactctgcacctctgcaggctccctctgaaggacaactgctggcccctcagggcctcaggtggaaggcgtcgggaagtggagcaggctatgtgagtcaaggatggaacgatggtcccagaacatcccaggagggtgtgacagcctccatctagaaggttctatcctcaggtccccaaggcatctgcagcacaccgtcctctgctgtgggtctgtgaagcagccactccagcagcaggacagtggtgcctgtccattccctctgctagctgccagccctgctgtcctccgcactttctggcaacctcactgtatgaaactccccaaatcctcctccacgtcaagtgtcaaaacagcccagtttaagtgctttcaggatttccacggagcctgaccgcaaagagcagcacgcggttctggagcatcccccgggcctggccgggcggggacacgggggtcagccaggtccgggcggctccctgaatcctggggacccaaaatgacaccctcgacctgagagctcaggccctaccagctcgggacgaccggattttctagctggaaggagccagaagccagctcaccgtccaacccgcaccctctacttttggcaaaggcacctccattttccacgaagagcttcctctgaccccccgcttcccgcgtcaatgtgtgtgctttgagcggggctgtcctcaccgcccagcttcaggggtaggggtggcacccaggcctggccactcaatcaccccatcctccttcctgcagcgataggctcaggaatggcgcttagatagaaactacgaccaaagaacccagtcc

SEQ ID NO: 1611 - DNA, 3556 bp, Homo sapiens
gccggggcaccgacaagggctgtgcgcaccaggacatggggagtgtcaggtcaagtgcatcgctgggaggcagccggcccagtcccttctcccataaactcctgggaggggcattccccctttcgtgctccttagagaatcaaaggggtcttgggccaaggttaggggtctcccagggctaacaggcagggtgtctcagttacatggggaaacctgggatccccgaggctttgaagatcaagaatcaccagggaaggatggagtagggaactaacgtcagtcccctgggaattagcccctcaactgcgacacccccaggtggataggagccgtgcaggcaggacagtctgtgactgcccaggatgagccaactcagaaggcagaagacctgactcctgaacctctccctctgtgcttgaccttggacaagtcgctgtctccctaccccagactctgccgactctaagcgtccttgcgactctacacttatgtgaaaccttttttcctgggccctctcttgtgcttgatggggaggagggagccaccctgcagggtccagctgcaggagggcccttctccaaggaaagctttgggagcaagggagaagtaggggagggcagctgggaggaaaagggataccggacagagttgggcctggggttccccaggggctgtcctctgccaacagaaggagcgagtttccccatgaaccttccagggcagagtcaggagccctgggtcccatccaaatctcgccctccatctctcaccctctctcatctccatcctgggcaggtccctgccagagcccagcctgatggggaagatcatgcctggaagggcttctgggctgaacccgggaagagtgagggattcttcgtgagatgactcagcaccccccattcctggcaggagtcttgacagctttccctgcctagggtggcaggcagggcctgtcacaaacacccaagatggagttaagcttacctggtaccctgccctccggctgaggatcaccagcagctggctggcacccgaggagaaacagatgggcagtaccctgaggtctcctagtgcccatcagcaggagaggcttttggtggacagtgggtgagggtcagaacatctcacagcctcttgtggtgggcacagaacttcactctgccataaacactcctgccctcactcacgccctcacctttggcctggtacaggtttcactcttcaggccaacagataacctgcccccatgctggtcccatgtgggccacctggcggcgggggactgtggacagagccccttctccggattggaaaatgaagtcagcaacaaccagctgtcacacagctggctggggtcctctccatcactgctgtcctttgggaggacttggacacacctgagtttagatccgtgttccactgccaactcgcctatgcttgccgagcctcagtttcccttctgttaaatggggataatggtgctacttctctgcttaggacttcctcctctttcccttaactctggcccagctttggggccatcgaagcagggaccacccatgcccttggtatctccagcacaggggccgggtaactgctgagtgagtaagcaggtgagggatcgcctgcctcttaggattcttagatgggggatggggggatggtggtgaaaacacccagcactgggcccgtccaccacctgctctgctctgctccctgaaggacaggccagtggacactgggtggacagggggatgggcccccagcgctctcccatacctccctgtcccttatggctcagtgaagagcccaccttgtgcaagaatcgacctgcccccactcagaagagattatgacctcctcaggccccacggccctctttgggcctttgggtcacctgccacactctcccctacagcccatggtcttccctgggcctcccatgcctcaggggctcttgcctgtgtcatcctgggggcagtgtctctccacggccacagcccaggagccgacctggctgattccaaagccctgtccttgccgctctgcctcccatagggaggctggctccacagtgggccttctggaaggccaaggaaacacctctcatgcgcttggctgctgcagcccccgaaccctgactgaccccagatgagaggagaggtgacatagtgtcacaagggcagggaatcgaggcacctgctgggcagctggggccaagaaacccaggcgtcagggccagctttgccactcactcaccgtgacctcgggccagtcacaccctcatctgtgccttgttgtccacccagccctaggtaagggcttagtgacccctcctagaggcaaggacagtgatcagtcctttgagagaccacgaaggggtttgctggagccccctggaacaagcgtctgtgggacacgcagagcacagagcagcacccggggtgagccctcttggaggaggccaagggccaggggtaggaccagggggatgtgggtggagggacccggaggtggggctgtccccaggggaggaggaacagctggggcagaacaggcccttggcatgcagcagaatcagggtgtctcaaggggctgagggccccaaggcctcccagaatgacagtaacactgagcagggaagccccaagcgtggggatggtaggaggtgggtggccagggaagagcacgtggtctgcagtcgggcagcctgggcttggccccacctctatcactagctgcctgagtgattctgggcaagtaatcttgacctctctagacctcagtttcctcaaccataaaatggagacggccctgacactcttagcaggactgccagagcagggtgacagcccccagtgtcctgtgggtgtttacactcaccctatgaccaagccacggtgtagccacacttcccagcattatctggatctgtctttcccaccattctggcctctggtaccaccagggcttcctccacagctcatcgctcccctttccagtggccatttctgccaatgtcaccacccatgcccagcacaggccggatgcccagtaggcgctcaaggaatgcttgatgacacaatgtatgaatgcaaatacccctggcccccaccctctaggcccctgcggggcacatgccctgggatatacttgcacatacgtagacagtccccaacactggactgccccacccctgccccgagctaccctggacctcagtgggacaaggcagaggctgatgaggcgctgggcagggcagcctgggcaggagcaggggctgggtgtggagagaggggacagatggggaggggcgggggcaggcggtcactgtggctcagtagccctgcgactggtagccctggggctcggtgtcgaaggtgttggccggctgctggtaggtgccgcccataccggcgggatccggcccagtgggctccacgtagggcgcgtaaggcatgctggagtcctggctggggtccatgtagtcctgggagaagagggccgagtcggcgccaatctggtaccgctggaaggccagcacagcctggcc

SEQ ID NO: 1612 - DNA, 1443 bp, Homo sapiens
gtaggtttttttttcagctactgatgtcttggttggtagctgctgccctttttcccaccagaggtttctcctgcttaaaaacaacaaccttctttcctttcttccctaccacaggcttcttgactgcaaccccctttctcatctgatttggcctctagtgctgctggtgctgctggtgctgctggtgctggtgctggtgctgctgctgctgctgccaccgccgccgctgccttatccacctggagtttgtggttgctggcctggcaaagcctggtgttgcagagcatggtctttgcatatgggtttagcttcaacatgattttcaggttttccaggaggtttgtccccaggactctacgatgaatcttcctgcaacgtgcttgaagggctttggatgtctgggcttttcaagattctgctaaggtctgtattgatcatcttgtgcatgcaaagattgcagttactcttgaggaaacagctttacaccaagtgccacacaattgtctaacttctagaaagcactttcagtccaaatgcagaaatgtcccacatgcccatcaggagcaagtttcaaaatgttcagtttgcttacattaagcagaataattctaggaatgtttcggaaggctttgacaatacaatcatcttcattagagacgatgcagggtcccttgcgctggatacgatggtttctcattttgcccttgccagctctcatttgctgagaggcatagcccttttttgtatcactccaggcttaagtggcaaaacagcctccttgattgtcttgtagccttcaactttatctctgaccaccaaaaaaagttcaggaacttccttaatatgatgacctgtagacatgaccagcactggtaaggcagaggcagccaggggagaacagatagcatattgttttttggattgtgttcactctacagtgccaacagtgccaggttttggttggtgcaaacatgtggcctccatgacagatatttccaaaagcaccctggccaaaagagtgagtcccaccacctcaaactctgggaatttgagacccaactctgccagtaccccaagattcagcactggtctgacgacctgctaattcactaacaagatagggctgtctgttgtttttgtgcaagttggtgtgaacaaagttcacaatatctggtggaatgggagccttgaatacaggagacaaagtgacatttttgccagatgactcccctttttcagagtacactgataacagtggatcagcacatccatgggaaggtgagaaggccacactccaacattttttttttttttttttggagacagagtctcgctctgtcgcccaggctggagtgcatggtgcaatctcggctcactgcaacctccgcctcccgtgttctagcgattcttctgcctcagcctcccgagtagctgggactacag

SEQ ID NO: 1613 - DNA, 426 bp, Homo sapiens
ccaccctttgctgactctcttttcggactcagcccgcctgttcccaggtgaaataaacagccatgttgctcacacaaatcctgtttggtggtctcttcacacggacgcgcatgaaaccttggtcgtgggccctcgtggtagagcccatgtcccccaagatttctttggctgtgttaccttagatttgaacaagcactgtacctaaggcgggcgccttcctcctcccgctttcaggaatgccctgctctgccattcttttgctttctcacttctctaatacacttgctttcactttagtccgtggactcgccccgaattctttcctacgcgacatccaagaagcctctcgctgggtctgagtggagacctctttctggtaataaacggactagggagattcgactttgaaggtgaaaacaaaaacca

SEQ ID NO: 1614 - DNA, 351 bp, Homo sapiens
ctcgagggggctcctgggctgtccagagtgggccctttgagagacccctgggccctaaggttcaagtaggccaccgctgaccttggccttcctaggagggatgcaaagccagcccaccacttgaacccggcagcctgagcaccgagggacagggccgccatccagggccagggctaggacaaggccagcaaggtggcagacacggagcatctcggccggggggcctttcttgggtcacacatcagcacggggcacagagatggggaaaccgaggcacggagctgtgaagtgacttgcccaaggccccaccggcagccagtggcagagccaggtgccccccaagatgttcac

SEQ ID NO: 1615 - DNA, 900 bp, Homo sapiens
attggcttaagtaacttatttgcaaacaggcattattaggcagtgccttttgctgcagttgcttccctttatttgtagcccttcaaatgcatacattaagattctcttcacagttgcaaacagcaggtaaataattgtatatttgagagactattgcctattgaatttaagttggtcacagactttggtccatggtaacatactaattgttaacttcctgttaaccagttatatcaagccttatgtaatttttgttgtttcagtacatactgtgaatatagccagctccctaactctgtatgaatattatatggggaggaaaaaatcctgtttctctattcttctaaaatctgtacctggggactgtgaattaaactaacaaaagacagattaataggaaaaaaaagcatactttttttttttgagacatgtctcactctgtcacccaggttggaatgtagtggtgcaatcatagctcattgcagctttgatctcccaggctcaaatgattctcttgccttagcctcttgagcagctggcactacaggcatgcatcaccacacctggctaattttttatattcatagagatggggtcacactatgttgcccaggctggtcttgaactcctgagctcaagcaattctcctgcctcagcctcccaaattgctgggattacaagccacaaattttatttgatattagtaatttaatttttacatgcggagaggatgtcatagtaaagaagtgaaaatcaaaaaagcaattagaccagaaggaattagatgtccagtataaagaagcctgatcactctggccttacttggctttccaataatagtatttttaggatcactgatataaaacctacaaagtaagtaatttggttcatataagcagg

SEQ ID NO: 1616 - DNA, 695 bp, Homo sapiens
gcgagcgctggggacgcagcacctgccccgcgcggccgagaggcggcagccccaggtccccagcgcgcgaaattagtaaagggcgcctggcccgattctcagaagtggctcccttcgccgcaactccacacctcggggtaaccgtagagattggcagcaatgccccagcccctcaccagcactgtgcaaagtgactttgacaggcagagaaaagccaacccagtcgaattcgtctggaaagcattccagcaacccagagaggagcctctgtttctctctctgggaaaaagccccaagggttttgctgaacccaggtcttcctgctcatctctcagcagttcagagctacataaacaacttctgaccatttacgcaatcatgtaaacctaccctgacatctccactatgtggaaaagatgttaactggaaaactatttttaaactactgcagtaagcaaataaacatccaactccaacatatatatgcagcagccttattagttcattcagtgttggtttggtttgtttgttttgtcttctgctttttagaattaattattatctttataattcctgttcgagaagtgggcaaaaccaggctagtgataggtattgttgtggtcaaatttttcatcacttgaaattccatgactttcatgattgctgagattaatgctaaataaagaagttacccc

SEQ ID NO: 1617 - DNA, 1885 bp, Homo sapiens
tggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaag

SEQ ID NO: 1618 - DNA, 503 bp, Homo sapiens
ctccatttttccttggccgccgcttatcatctctgggtgctgaagtctcttgatgtgaacagaatggagaacactttggtctttacctctcacctctacaccttttgtttcccaggaacagaggccacaaaagagctgtaagagcagagtgaagcaggctcatcctggtaatttgtagttttgcagataaagaacactttcctcagcacatgtgcagtggatcctgacaccagagcttcaaagaggtcccaattggagagaaaatgaggaaaaggaggaacagatgggactaaaagcagaaggcacctgatgaaagagaaaaagcaaggctgggggaagggtgtttagagaaggactgggagaacaaaagcaaagaatctgaaatgagagcatgctttcttccgttcccatgaacttcagaatgagccacatctttactcaaagcctcctctgctatttatatgtgtgaccttaggctctacaaccattccaaagaaaaacag

SEQ ID NO: 1619 - DNA, 1082 bp, Homo sapiens
cccgccgcccgctcgcctgaggcgcggccggcctccgggcggggggccatggccagcgccgccgagccccccggccaggcggccgagtacctgcaggagctgacccggatcgtcgccgcgcagcaggagctgctggcgcgccggcgacggcgcatcgaggagctggagcgccaagtggcgcggctgagccgggagaacgccggcctgctggagcgacaccggcgacacctggccgcgtgcgcccgccgccccgacccgggccccggccccggcccgcagccgctcggcgccatcccggagctcggcggccgccgcgacaagtctgaaggagaaagctcgcggagcgtcagaacaaattaaacccaaaggacgaagaaaaatatcagtgtggaaattaatgaaatgaaaaacagaaaaaccataccgacgatcaatgaaaccaaacctgattctttgagaagaccagtgaaagtaataactctgtggtcagaccgatccagaagaaaacgagaaaagacacaaattaccaataccaggaatgagaacagtgacactgctacagattctgcagcaggctaaaggagacatcatatgattcattatatctatgacagaggaaaatttaatgcccatgcatgattaagaaaactctcaggaaaaaaaattggaataaaggggaacttcctcaactttataaaggacatctacaaaaaacctactgatagcatcattagtatattaaagatgacagactgaacactttctcccaaagactgggaacaaggcaagaatgtctctccctactgtgattcaacatatcattggaacttctagacagagcggtaagtcaagaaaggcaacaaaagtcatacagattggaaaggaagaaataaaactgtccctattttcaataacacaattatctacaatgaaaatcccaaggaatctataaataatgattaccagaaaaaaatgaatgaattcagcaaaatagcaggatttgtgatcagcacacacacacagaatcaacgcatttctgtataagaacagcaaaaatttagaaatcaaaatttaaaacacat

SEQ ID NO: 1620 - DNA, 1164 bp, Homo sapiens
gccgggccgacttgaagaggtggggattgctgagggctggtctgtcggctctggaaatcctgtcatactgtcacttttggattccgccgtttccgtcccaacggaaaactggggctcctggattcccctgacccgagttgtaaccaccgacgagaatctttttcactggcggcctcggcgtcggcattttataaaatgagagcggggagggcggccgaagacgagtgtgcggagccttaggccccccgctcgggtccgcttttcgtatattcggttttggacaaagatgaagaaacaaatctagagactggatgaccttggatctcaggcatcacttgtgatacctccaggtatgggaaaaaccgaggcaactagggtctggagtggaaccccagcaaaccacaacagctttactgaagagtggcctgttaaaacaaacagaaaataacaacatccacaaagatctcacaaaagtcagaaacctcaaagattgaaggtagataaccccacaaagatgagaaaaaatcaacacaaaaacactgaaaactcaaaaagtcagtgtgtcttctcctccaaatgaccacaacacctatccagcaagggcacagaactgggctgaggctgagatggctgaattgacagaagtagactttagaaggtgggtaataatgaacttcacagagctaaaggagcatgttataacccaatgcaaagaagctaggaatcatgataagacaatacaggtgcgacaaccagaatagccagttatgtttctctcctttagagagatttagaagtcctggccacagctatgagcctgcaagataaagaaatcaagagtattctagtaggaagagaggaagtcatattgtctttgtttacagatgacatgatcctatatctagaaaactccattgtcttggcccaaaagcttctaagctgataagcaacttcagcaaagtctcaggatataaaatcaatgtgtaaaaattgctagcatttctatacaccaataacaagcaagcagagagccaaattatgaatgaactcccattcacaattgctacagaaagaaaaaaatatccaggaatacagctaacaagggaagtgaaggacctcttcaaggagaactacaaacggctgctcaaggaaatcagagaggac

SEQ ID NO: 1621 - DNA, 934 bp, Homo sapiens
gctgtggcctggaataaaatgtcacaaatatatatttataaataaaacagtcactaaatataataagggaaaagaataaaaatgcccactgcagacagtggaactgtgggcaaggggcaagcagtcagagaaggaggaatcagcattcattgagtgcctaatacataccaggtgctttgtaaacattgtctttggatactcacataggtttatgaagtagacttataattttcaatcctttaaaaacattttaatatgaagaaactaaggcccagggaggaggaatgaattcctaagatcacacactaggaagtggctgagctgggattttaatcctatctgtctgcttccaaaacttgcattcttttctctgtacaataccttttccctagatattgccaaatatcagatcataaaggacaggaattctgaagaggataaaatcgtagacagaccattaccaaaggagttggacttggagctgtctatcccaagctcataccagcttcctggggcaaccaatgagtggtctacacagaagtatactctgtcatttcactccaattcagaagaactctgaagggccatcccaacttcagagcttcccaggaggttagctaaagctttgttgtgatgactttggagctcaacttccctgtgtgtccaatcctgccttcttctctctcttctacaggcgaacagtcagcttcaacaagcagcaggtttgatcaaccattcttctcagagcaagaaacctaccatactgcaacgtggatacagctagaggccattatcctaagcaattaaatgcaggaaaagaaaatcagataccacagattctcacttataagtggaagctaaacattgggcactcatggacataaagatggcaacaatagatactggaaactactagaaggcggaggagggggta

SEQ ID NO: 1622 - DNA, 1914 bp, Homo sapiens
gaaagacaaagcctggaaacttcttttagcagatggaaaccttttgctaattaaaccttaaggtttttaatcttaaaagctacacagaaaacttgttttaattttgaaaacataatactcctcctcccccaacacgcgcaccggacaacctctctccttgaaccactccgggtggttcaaattccaaagagcatatgtttcaaatgaaaggtcaaaaaggagatcggtttcagtttggagctaagggagagtgattatttctctaatgtgagctgcttcctgttgctaaaacactgccccttcaaatgagattgtttgctaagtgaggcatctccttcctctttcttccttggatgaattagcaagcaagaagagtcagtctgaggctcctcactgtgacggactgaggagctttatttactccctgcggatagtggcctgccaccagagaggccacaggccggagtgatggagctgactcatagggtaaggagaaagtggcctggatcgttgacagaggtaagcagtgtccaattcctcctaggcgggggagggagaggttatggcaaagaaagccgtttctattccactgggcaattaatgccaccatttttcttgaaaaagcgttttttttttcataagccgttgaggataatttaacccccatcttgacaggacgtactaatgaccgctaatggatacattcttttaataaatgaagaggcacaagaaaattgccagatattaaacagagtcccacatgtcttatctgagactataatggctctatcaagtgacccaagtgaaagaaatgtcactcttcagaggttaaaggagtctattttttcttagtgcgatataaattcatggctagaaagaacagtaattcattggtctaccctaggaaatgtttaaagggggctgtatctcaaatgatgcattttctatcggtagtaaagaaaatatgaaataggtacctctgtgcactgtggatttatgtaaatggctttttaccaggtaatatagcctaaagctctgtcaagtctctaacgcttggaatttttggcaaagaaatgaaagaacctgtaagttatcattattttattttatttttttcaataccttccagggtgtggtctttttgtttggtaattttaaactacattcttgaaaaagtttctcaagattcaagcaattcctaggactgtatgtacacttggggaacatttcttaaaatacataacgaattcaaattaataagaaaaagacaacccagaagaaaaatggacacgtgaattaatcagaaactcaagaggtggcgtatatttgagcatggatctaaatgaggtgaaggattgagatggctgcttggggaagaactttccaggcatgaatgaatgcctgaattgagcatctccacttcctgatatgagagaagagacgtaacaaagattcctccagaaccaaaaggatccgagataaggctaacttgattaacgtgcttaatgtgaatgccacaccttgggtttcccaggaagaagactctcagatgaagaccagtgtttaggaagcttattaggaatgcttgcgggatcaacacctgctggggaagaaaggcagcaagattgggcagaggacagagttgggctatggtgcagtctcagtggaggtttccatcggccatcgggagttctgaagctgggctggcccttcggggtggtcccaagttgggggctggatctttatgcctcgccttagtccatcattagatgttggccatcccaggaaggagtatgaccttgggtgaggtggctcccctctgccacagtagtccttggcagctgagggctacttaaatgatttcaacttcttccttttgttcccccagcaccaggagtgatggttcctcagcag

SEQ ID NO: 1623 - DNA, 1752 bp, Homo sapiens
gggtcaaatggtatgtctagttctagatccctgaggaattgccacactgtcttccacaatggttgaactagtttacattcccaccaacagtgtaaaagtgttcctgtttctccacatcctctccagcacctgttgcttcctgactttttagtgattgccattctaactggtgtgagatggtatctcattgcggttttgatttgcatttctttgatggccagtgatggtgagcattttttcacgtgttttttggctgcataaatgtcttcttttgagaagtgtctgttcatgtccttcgcccactttttgatggggttgtttttttcttgcaaatttgttggagttcattgtagattctggatattagccctttgtcagatgagtaggttgcgaaaattttcacccattttgcaggttgcctgttcactctgatggtagtttcttttgctgtgcagaagctctttaattagatcccatttgtcaattttggcttttgttgccattgcttttggtgttttagacatgaagtccttgcccatgcctatgtcctcaatggtaatgcctaggttttcttctagggtttttatggttttaggtctaacgtttaagtctctaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatggttgtagatatgtggcgttatttctcagggctctgttctgttccattgatctatatctctgtttcggtaccagtaccatgctgttttggttactgtagccttgtagtatagtttgaagtcaggtagcgtgatgcctccagcttcgttcttttggcttaggattgacttggcaatgcgggctcttttttggttccatatgaactttaaagtagttttttccaattctgtgaagaaactcattggtagcttgatggggatggcattgaatctataaattaccttgggcagtatggccattttcacgatattgattcttcctacccatgagcatggaatgttcttccatttctttgtatcctcttttatttcattgagcagtggtttgtggttctccttgaagaggtccttcacatcccttgtaagttggattcctaggtatttttttctctttgaagcaattgtgaatgggagttcactcatgatttggctgtttgtctgttactggtgtataagaatgcttgtgatttttgtacattgattttgtatcctgagactttgttgaagctgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggaaaacctgtcttgtgccagttctcaaagggaatgcttccagtttttgcccattcagtatgatattgcctgtgggtttgtcatagatagctcttattattttgagatacgtcccatcaatacctaatttattgagagtttttagcatgaagagttgttgaattttgtcaaaggccttttctgcatctgttgagataatcatgtggtttttgtctttggttctgtttatatgct

SEQ ID NO: 1624 - DNA, 1120 bp, Homo sapiens
cagtgaacaagacaccaagagctccatctctgtggaatttacaacctagtgggagtaagagtcaataagctataaaaataacaaatacagagattatataagatgttaaaaggttataagggctacaaagaaagaaagaaaagggaatgggaaatgggtatcagaagtgtcaggctagaaggaaatgttgcaattttaaatggggcagtcaggaaaagtctcattgagaaggcgacatttgaacagagacttgaagatcagggatggaaccacaggatatctgggcaaagaggattctgggcagacagatgagccagcacaaaggccctgaggtggaagcattcctggtgtgtacagaagacagtaagcaggacagggtggctgcagcagagtgagctggtggtggagagaaaagtgagaccaatcatgtagggactcggggaccactgtaagaactttgacttttactctgagtagaacagcaagccattggagagtcctgagcagagaaaggactgacctgcctcatgttttaaatctggctgccgtattggaagtagattggaggaaaaaaaagtggaagccctgggacccaccatcatgaacaatcggggagaagacaagaggccagcaaaggaatgaacacagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcgggtaagcggcctctttctactctcttctccaacctctctcactatccctcaacctcttttcctttcaatcttggcaccacccttcagtctctcccttctcttaatttcaattcctttcattttctggtagagacaaaggagacacattttatctgtggacccaaaactccggcacaggtcacagactcaggaacacagccttcccttggtgtttaatcattgtggggatgcctgcctgattattcacccacattccgttggtgtctgatctccgtggggatgcctaacttggtcattcacccacattcccttggtg

SEQ ID NO: 1625 - DNA, 825 bp, Homo sapiens
attgagaaggcgacatttgaacagagacttgaagatcagggatggaaccacaggatatctgggcaaagaggattctgggcagacagatgagccagcacaaaggccctgaggtggaagcattcctggtgtgtacagaagacagtaagcaggacagggtggctgcagcagagtgagctggtggtggagagaaaagtgagaccaatcatgtagggactcggggaccactgtaagaactttgacttttactctgagtagaacagcaagccattggagagtcctgagcagagaaaggactgacctgcctcatgttttaaatctggctgccgtattggaagtagattggaggaaaaaaaagtggaagccctgggacccaccatcatgaacaatcggggagaagacaagaggccagcaaaggaatgaacacagggacgcatgagacatttggtgccgaagacctgggtcagcgggactcctttgggagaccagtcccccatcctcaccctcactctgtgaagagatccacctacgaccttgggtcctcagaccaaccagcctaaggaacatctcacctattttaaatcggacaggaatgtcaggcctctgaacccaagctaagccatcatatcccctgtgacctgcatttatacatccagatggcctgaagcaaatgaagatccacaaaagaagtaaaaatagccttaactgatgacattccaccattgtcatctgccctaccctaactgagaagatatattctcccccgcccttaagaaggtactttgtatgcctatcccaaacctataagaactaatgataatcccagcg

SEQ ID NO: 1626 - DNA, 1216 bp, Homo sapiens
gttgttgttatattctttagatatgttcacactccaagcatgtgaacattgtcttaatgacactttgtaaacaatgccaccatttaaaaatttaaagattttcctccagattagcctaaaatgcagatatggttttattccttataattttacagtggcttactcccctgcttctggaagacttcttggttgccccacacccagattaggcactctttcccatttaaacaggagtattcagtgtgtttccctatctctgttcctgtttctcttccactactgtatgttgggagtgggtgggacagataatttgtctttaaaattcacaggtctccaagagaagttgaatcaagatctggcattgatcatgagatcctggacataatgtcaatgcaatcattggacaagtcttttgggatatcttggggaagaggatgagtatatttttcccagcagccaggaaggaaatgaatatttatgatccagtgtgcagatcatgatgctggcaaggttgcggagcaaagggaacacttatacactgttgatgggagtgtaaattagttcaaccattgtggaaagcagtgtggtgattcctcaaagagctaaaaacagaactactatttgacccagcaatcccattaccaggtatatacgcaaaggaacataaagacatatgcacctgaatgtttactgaagcactattcacaataccaaagacatggaatcaacctaaatgctcatcaatgacagattgggtaaagaaaatgtggtacagatgcaccatggaatactatgcagctgtaaaaaagaatgagatcatgtcttttgcagaaaaatggatggaactggaggccattttccctagcaaacaactacaggaacagaaaaccaaatatcacatgttctcacatacaagtagcagccacataatgagaactcatgaacacaaaaaggggaacaacagaccctggggcattccttcttttctagataagtttttcttttgggatttgagcctctttgatttgaaatttagcataggcccagaagaagactctgtcctctgagtttaatttttcctaatctcctggagaggcagcattggctactagctaagagtacagcccctggggccaatgctatggagtgaatgtgtctcccaaaatttgtgtgttggaaacttaatccccagcacaacagtgttgggtagtgaggc

SEQ ID NO: 1627 - DNA, 883 bp, Homo sapiens
ggaatcattctacagtgtatttgagaactaaacaaacagcttattctagcaaaatctgaactatgtaagtccctccaaaaggagtgtttggagactgataggaagacttaggaaggataggagatttaacccagcttttaatccaaaggaagaaatctctgcaaagaaggcagccattggttttggtttgcttaaggacaaggcaaatatctgaggtccatgtgagaagaaacgtcaggcccgtaaccatttcctcaggctgccttgacaatcttccaccagtggggtggttcaaaaccatagttctgggggagccaagatggccgaataggaacagcttccggtctacagctcccagcgtgagcgacgcagaagacgggtgatttctgcatttccatctgagataccgggttcatctcactagggagtgccagacagtgggcgcaggccagtgggtgcgctcaccgtgcgcgagccgaagcaggccgaggcattgcctcacctgggaagcgcaaggggtcagggagttccctttccaagtcaaagaaaggggtgacggacgcacctggaaaatcgggtcactcccacccgaatattgcccttttcagaccggcttaaaaaacggcgcaccacgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagccgggaagctcaaacttggtggagcccaccacagctcaaggaggcctgcctgcctctgtaggctccacctctgggagcagggcacagacaaacaaaa

SEQ ID NO: 1628 - DNA, 2072 bp, Homo sapiens
aaaaggtttgccttgaagttaaggtgacaagagagtgactgattcctgaaaatttcttgcagaatgaaggatgaggttggacttctcagtttctgtccagaacaaggatggagaggctcagcagcaccaacaggaactccttatggaatggaagcacatccaggctgaaggcccctgtgttccagatgctgtgtgagtgttgacctgccaggcgactccacgatggcttccgtcctcaggttcaccatcaactaagacagactgaagatgtaagtagtaatggaaggacacaaaaggtacaagagtcagaggccaggccaagagtgcaagctgagcaatgggcaaggaaggcctccttgatggctagctccagaactgggactgcagaaagaggaattttctcgatagaaaggggtgtgggccttccagtcaggttcagatccacagaagcatgcacatgtggtatgctggggcaccactgcaccaccggggagggtcatgctggaaaagaggctgcaggatctgggactcactctatcctggggcaatggggagtttaggagagggtgagtcagatcagcatgaagttagcctagagtcaggaagatgagttaagaggtctgacagtctattgaagtaaaattattcattacagaatagcaccatgtatgtttctaaaatacttggtgccatatttattctcctgagggattcatctgagcacttagaaaagaataactgggccattgagtcttggttgaaatcattcattcatccaaccagtattcatcaagcatctcccacatggccaacgctgggaacccagtgttgaagttggaggagacttcactcacatgccatgagaagtgcaaggaagaggaccagctacctgtagagcatgttacagaggagtcaggtctggtctgaggttggaggtccaggaagtgactggagttgaagcttgaaggagttggtattcaacatgcagaactgggaaaaaggcattccaggcagaggaagcagcttgtgtgagggcactggggtgagagggagcatggttcatttgagaagttaagaaagcacagagaggaggagaatagggagggttaggggaagagggggtagggcctgtgccaggcctggccctgccctttaaggtgccaagtccttgcaagcattggaagttaaaacatgatggccatttattgatgatttattgatctctctgtatccccttgggcactagcggattctcgacagaaccacaaagtggagttggctgcagatgagtctgttcatggccccagtttctcacctattcctgagtcaccttttgcccctcagacacagagatgggatagcgccaggatgtgggtttgtgttgtctaatttcttggagtttgtacaggttttacctggtaccagcgtgaccttcccatgtaccctcttggtcagcaactttttacaaggagttaatcccactttctggaacttgctcattctcaaagtgagtggttattggtcctcaagacagtccgcagaaatttcagccccatgggaaagaaaaaattccaggtctctacctgatgcttggaaagccagccatgttaacttagtcaacaccaatgctcatcaaatacacacatttatctagtgttcccaacctacattcccagcctgggattctgtgggccagaggccccagtgtagagattatagcctaatgtcccagcagagaatcactgattgcagataggaaaaatccagacatttctgaactccaagaccacagtgatttatgtggcctggtgataagctatgattgatatattactcaaagtttctgcttcccccaactctggcaagaactttggcagaacttctatgccatatccagtactaggaagttgccaagtttatgtccttaaaataaagtgggttccaagatagatggcagaaagtgggaaatgtgatttttcttgattgggtaactaagaaccacacagcatgcgggagccattttgggccaaagagctgttcatttaaagtgtttattgacacctggaaatagg

SEQ ID NO: 1629 - DNA, 2018 bp, Homo sapiens
aatgaaggatgaggttggacttctcagtttctgtccagaacaaggatggagaggctcagcagcaccaacaggtcagtaggaactccttatggaatggaagcacatccaggctgaaggcccctgtgttccagatgctgtgtgagtgttgacctgccaggcgactccacgatggcttccgtcctcaggttcaccatcaactaagacagactgaagatgtaagtagtaatggaaggacacaaaaggtacaagagtcagaggccaggccaagagtgcaagctgagcaatgggcaaggaaggcctccttgatggctagctccagaactgggactgcagaaagaggaattttctcgatagaaaggggtgtgggccttccagtcaggttcagatccacagaagcatgcacatgtggtatgctggggcaccactgcaccaccggggagggtcatgctggaaaagaggctgcaggatctgggactcactctatcctggggcaatggggagtttaggagagggtgagtcagatcagcatgaagttagcctagagtcaggaagatgagttaagaggtctgacagtctattgaagtaaaattattcattacagaatagcaccatgtatgtttctaaaatacttggtgccatatttattctcctgagggattcatctgagcacttagaaaagaataactgggccattgagtcttggttgaaatcattcattcatccaaccagtattcatcaagcatctcccacatggccaacgctgggaacccagtgttgaagttggaggagacttcactcacatgccatgagaagtgcaaggaagaggaccagctacctgtagagcatgttacagaggagtcaggtctggtctgaggttggaggtccaggaagtgactggagttgaagcttgaaggagttggtattcaacatgcagaactgggaaaaaggcattccaggcagaggaagcagcttgtgtgagggcactggggtgagagggagcatggttcatttgagaagttaagaaagcacagagaggaggagaatagggagggttaggggaagagggggtagggcctgtgccaggcctggccctgccctttaaggtgccaagtccttgcaagcattggaagttaaaacatgatggccatttattgatgatttattgatctctctgtatccccttgggcactagcggattctcgacagaaccacaaagtggagttggctgcagatgagtctgttcatggccccagtttctcacctattcctgagtcaccttttgcccctcagacacagagatgggatagcgccaggatgtgggtttgtgttgtctaatttcttggagtttgtacaggttttacctggtaccagcgtgaccttcccatgtaccctcttggtcagcaactttttacaaggagttaatcccactttctggaacttgctcattctcaaagtgagtggttattggtcctcaagacagtccgcagaaatttcagccccatgggaaagaaaaaattccaggtctctacctgatgcttggaaagccagccatgttaacttagtcaacaccaatgctcatcaaatacacacatttatctagtgttcccaacctacattcccagcctgggattctgtgggccagaggccccagtgtagagattatagcctaatgtcccagcagagaatcactgattgcagataggaaaaatccagacatttctgaactccaagaccacagtgatttatgtggcctggtgataagctatgattgatatattactcaaagtttctgcttcccccaactctggcaagaactttggcagaacttctatgccatatccagtactaggaagttgccaagtttatgtccttaaaataaagtgggttccaagatagatggcagaaagtgggaaatgtgatttttcttgattgggtaactaagaaccacacagcatgcgggagccattttgggccaaagagctgttcatttaaagtgtttattgacacctggaaatagg

SEQ ID NO: 1630 - DNA, 234 bp, Homo sapiens
atgaaggatgaggttggacttctcagtttctgtccagaacaaggatggagaggctcagcagcaccaacaggaactccttatggaatggaagcacatccaggctgaaggcccctgtgttccagatgctgtgtgagtgttgacctgccaggcgactccacgatggcttccgtcctcaggttcaccatcaactaagacagactgaagatcagcagcacaaaggcatctctacgccca

SEQ ID NO: 1631 - DNA, 791 bp, Homo sapiens
cccgcgcctacctcccggcggctccagtcgcgcacgcgcgtcggcgcccggggccctccgcggcctctctaggaaactgggaggcccaacgtctctgcttctctccggctccggtgcggcgggcggcggggcttgtccaacatccctcacctccctcagttggacatttcccttccacgctcggatgcccagccgcgcctgttttcttgcatccctcctgtcgtgtctgcggggctgccctgaaggcctctttccctccagggaagaaagggatccaaagctaggggtgaaaatagggccagcagtatctagcagactggtcctggccaggagaaggggttaagggagccactcattcttcgcctgggtacacttcaaagaggggaaccagatcctacgggaagctaggtgccagaactcctgcctttccaagacgagctcatccccatcatcaccatacccaggaatacttgttcatagccagctcagaggtgcaccatactttagcttcccacggccttcactcgttttctcctgtgggtgaattctaactaggctcgcctgtcaccaaagatggaaacagagaatagatcctgaacaccaggaagatggtgacaaggtgatagagaaacagatggcacattcaaacaagggccctgaagtgatcctcctcctgttcactgacacccgttgccaagagagagagagaaaaagagagagagagagaagcaggaagagaggagagggtgctggccttattagagaaagaatgtaaggggaaagaaaacaat

SEQ ID NO: 1632 - DNA, 1345 bp, Homo sapiens
gtggtgtctgagccctagacagttgtcggccgctgattgaacccgggctggccgcaggaagcgactacagcagcgacggaagcggtgtgggccgccatcttgggtaagggcagcgactgtggctgaggctgggtactgctagctgaatggggttcggccacgccttacatctgttgagttgacccgcgtacccctgccctgggccccaggctccctcgaaaacccctgctgatctcctcgcccggactccgactcgtggtgcaggagttctggggtcagccaagacaacaggttaggcaggaagggcgggcggccgcaggcaaggctcaaagaggtttcttttttcttctttcattcgcgtgggcaacggatccaacctttgaaagcccacctgctgatcctccacctgaccggagcccgccgtgcataggctgataggagacgtgcggggtggacggactgcgggacatctgaaggaagggctcaaggcgcgccaagctcaaagctgggccgccactctagaccgtggagggaagcgcccgggccagatcatcggtcgaggacatggggtcgcctcagagtgggaagctccacatggtccagaactgcaggaggaagaaagcatctactgcataaaggaaagaaaggaaaacccatagaaatggaaatgtaaaaaaataaaaagggaagccacaacccttcatgctgctgtggcctctgtacatggcaacacatgagttcacggcagtagaacggagacttgggggtggttctctcctgagtgcaagcctctctggctccctggggtggggctgggggacttgcttttcagacctggagtgattggcaagctgcttactgagggcggcatcccagccgcctcgttgcccctcactgctcccctcggccgtgctcccaggccatgcgggcctgctcctccttagcgctcccaggaggcaatggagccttgcggtgcaggcctcgaggcctctcagtctcttcacgcagcagcaccccctcatcgtgctccagggccggcaggcgggggtggtagggcttgggcggcagcgcaggcgggtccatggggtcctgagggatgacgcaccctggggctgagtggcttcggcatggctgggccttgatggagtccaggacggcagactcagagaggctgtagtggacagggaggtagggtggctcaagatcttcgtcagcattccaggcctgacttggcatggagtccatggtgtcagtgcgaggtggggcctccgaggagtgcccaaagttactctcactcaaggaggacacgccgctgctggcactgccggacagcgtagagttgctg

SEQ ID NO: 1633 - DNA, 210 bp, Homo sapiens
ggagttttgaagtaaactttcaattgtgatgtgaaagatgaagacagaaggaagaatgttccagcaagaggaaatagagaagaccctgagggggaaatgcctgtgtgaaatgaaattcggaggaagctggaaaggactgaaggagtcatcagactgcaatgcaactctgatccagagtgaaggagacaaggagagaacattggatagtgg

SEQ ID NO: 1634 - DNA, 659 bp, Homo sapiens
gttaacttgtctggcggatcacaaggccagcaaactattggctggcatcctgaatgatactggaagcaaaacagcaaaacttacctttcgtaaaagactgtgaaacttctaaaattcaggttgtcatttggaaccagagaaggtcgagacaggtgtggctggaacagatggggaggaagagctaagagctgccacatgggaccctgatgacctcatctcttcccagaggccccacttcttgatactatcacactgggtattaggttccaacataggaattttgggaggacactgacattcagaccatagcactatgcagttggttccttttgattttaaagaccaagaggctaagaaggtgttcagaaatgctcttcattttgcctgagcctatatattaattttctgttgctgctatagtgaattaccacaaacagaatggctaaaacaacacaatttattattttatatttgtgaaggtcagaaggctgacgtggatgtcactgggctaaaatcaaggtgttgaaagggctgtgttcctttttaaaagttctggggtaaagatcgttttccttggttttttgggttgttggcaaaatcagctcattgtggttgtggtaccaagatcccctttttcttgctggctgtcagcggagggc

SEQ ID NO: 1635 - DNA, 839 bp, Homo sapiens
gggctgcatccgcgctctgacatgcctgcccccagcagggaagctgagccccaggaggcagcaagcggggccccggaaggtattgctggagggctgtacagaagagcctagtatcggtgtccaggccgactgaggagccagggaaaggcgagggcgtagacgctggactacgcagcaggaggaagctcgacggatggggggaggaggccattgatgggatttggagaggcgggtggagggctgggagcacttcagaactgagcatcagaaacttgggcgcgcaactggtccccagagcccgaacttgaccgtcgcgagagaggaagggaggggagggagggaggtggggtggagggtgaaggcggggtgagtagtagaaggatgcgaaggctgatactgaacagaaaatggaaggaaatttttccaagaaccggggaaggtaaggacaatcgagctgggagggactgtaatgagaaagctggagaggcaaagaaggagagcaaaatccagaatgaagagcgaggccgtggaagggtgagaaatatactttgaacattaagaggaagaaagcaaaatgcgtccggaactaaaaattcaatataggaaaaacaaaacaaaacaaaacaaaaatcaggtgggagggacttcgtccctgaaactgccaaaagagagggaaaaatgccactgagcataccggaagaacagaaagtgaaggaagggagaaaggaaagaaggcacattaaaccaggcaagaaatatgcctcagaatgtgatatttggaaacagatttgttgaagatgtagctagctatgataaggctatactggagtagagtgggc

SEQ ID NO: 1636 - DNA, 2654 bp, Homo sapiens
ggaaaaagtaccctgttgggaaacaaggagaagtctaaaacagtattttctaaagaacatctatgaagacaataagcaatatttggtggggggagtaattcagtattctcaaaccagtagctgcaggaacaaagcaggcatgtgatttcactatttttatttttattttttttttgccaacagaaagcagagaacacaagtttattaggaagcaagtcacttctcttttccccgtccccagacaaacctcctcttaatgttccttacataccaagaaaaagacatctctacaccacagtgatctcacaaggggaggtgagaagctgcaaccatcctcaagtctacttgctacagtaagactggtcattagagactctggcttgtggcttgccgaaaacactagccaagcctgcaaattgaggcttaacccactccggagataacctgcctttttttgtgtcaaatagaagtcaggctctgcaggcttccaagatcatattacccttgcatgggcattccagactaccacacctccaggcccatttctgattggactttgaccagtattctcagttgcctgatgttctattttcttcattagggtggtggggagaaacatcatcccgaaaaggaggctgatgttaccgcagaaaggcaggctccccaacgtcctcctcttagtcaagggtagtcattctgttcgcagggatgctaagcatttcagaaaaccatctcatggatgtgccagcagcatcctgtacctctcccctgagtgtatgctactgaacagggcctggatacctgcttgctaagcagagaaaagcacgtacctggttctatgccaagcccaagagagaacccacttggtatgacaatagcctaagatctccaagaaactgtgatatttaaaaaagcttttctataaagccagagaatatgctggcgagttagctgttttcaactgcacctgaagctatggagccactagaaaggaatttggatgaagttttcctcccttctttcctctttaatctctaaggaattgctactaaaccaaggccacactggcagaggcagcgccaactgagcctttctcaaagacagtgtagaaaaaaaaatgccctgctgcctcaatatcctagaatacgcttcattccccaatgcccatctgtaaaaggcaatgctcactttatgacaaacaaggggataaatgtgctggcactgaaattcagactccacagccaggccctgtggggttggccactttaatgagaatatctacaaccccctcctgtaataatgggaaagcagggaaggagaggagaatggttctacaaggttttcattttgtctgtagttattttacacctgaaacagaatcaagagtggaaaacacctttccatgttttgcacttgcggttttggtctgatctctctttctcttaatatgtttttaaatcttttctttcaggttagatttgagtttgttttctctgaaaatgcaaaagggcctgtccacattgaactcctggatcacctctcaccgatgaaagttcaatgcgaatgtaacgtgctcgtaacacgtttcctagtgaatgtatctctctgcgaatcattcgtgtgtgctcagcctgcaagcctggcaacccactggcaacgtaccgaatctgttcagtccttatactggatagctgactctttccataatttatgttacagtgccatctgatggtagtttatgaccaccatttttaaaaagctgggctgtctcttctgccttttaaagaaatatatgggtttaaaaatcgtctttaattaatcacagcagataatgtgtcagtgtggtggtctgtaaacaagaaagctgtttccacgtgaggtctgctaaagatgagacactacagagaggattttgagcagccacacacaccttaaagacaactgattaatttttttaaagacattcatgttctcgttcagtgactattactgcataatccgacatttcagaagcagtgttctttgtgaatgccatgacatatttgggaagaatatcagagggaaagtctgttctaagtaaatgatgtgtggtccagaattttcggctctgcattctcattgtgcatcatttatttctccctcttcatttccaaaaaaacccacaaaactctctgggcccataccggcatgacacaaggaaacccaaccccacttttaagcccaatcatttgcaaatgtatttcagtcctaggtttaattctaggagaagattccttggagaagcctcattccggaagtctgcctgccaatttttggaggctttaaggcttgtttcctctctctcctccaggtttctttccacccacaaagttaacgtgcatcgtgaatgggcctgaatataattcctccaacagaacttgccagttctgtggctgcactgccagtcactctcaggaacgcgcaaagaaaaagatgatttcaagtccagggtctagatctgctgcccaggatggagtgcagtagcatgatcacagctcactgcagccgcagcctcaaccttccaggctcaagcgatcctcccagctcagccccccaagcacctgggataacaggcacgcgccagcaagcccgactaatttttgtatttttagtag

SEQ ID NO: 1637 - DNA, 915 bp, Homo sapiens
ggagagcctggggcgtccgcccacccgcaggcgccccggacccgcaagggcggcgcaagacttccccagcgcgcagtcagcgtcgcggccccgaaagctggcgacaggcgctgctgtcttcccgccccgtggggtcgcccctgccctcccgcgccccggggctgggggcgccaccttgccagctccgactgctgcagggagcgccaggggaggagtttgggagagaatgaattggactgtgaaactttcatgaacttctcaaaagaacaggaacatgaggagacgaaatggtgatgaaaacccacaattcaatctaccacagtatggtaagcattcccagctttaaaccatgaagaaaaataaattgacaattagtgaaaaaaaaaatgtggtaaatcaaagaacgtaatgcaaaatggacactggagggatgaaagtccatatgactcctgcttccaggaaaggccagagccactgatcattggttcactaatggccaatagtgtttcaaggtgaaaggaaggatgggtccaggagcctattggaggaaaatagggtggagacttggagatggtgttaagagaacatttgggtgagtgaacataaatcaaagaaaaaataaattaagaaaaatgcttatagaaagtgaaaggtagacattaaatactaaatcagataaaaacctgcagattttatatttaaccatcttctcaattataataatgatttggaaaatttaatgttttcttttatataatttggcagggtgataactatcctcagtgggataacagactagttttaactcttacatctccatgtttcagagtttatttgaggcaaagtatgatttttaagaacagctactgcttattttgctcaggttgcttattgcccagcccagtctgaggggac

SEQ ID NO: 1638 - DNA, 891 bp, Homo sapiens
cggccccgaaagctggcgacaggcgctgctgtcttcccgccccgtggggtcgcccctgccctcccgcgccccggggctgggggcgccaccttgccagctccgactgctgcagggagcgccaggggtgagtgtgcggatcagcgctgagcccgggagtgcgggtcacgcccgcagctggcgcgcaggaggagtttgggagagaatgaattggactgtgaaactttcatgaacttctcaaaagaacaggaacatgaggagacgaaatggtgatgaaaacccacaattcaatctaccacagtatggtaagcattcccagctttaaaccatgaagaaaaataaattgacaattagtgaaaaaaaaaatgtggtaaatcaaagaacgtaatgcaaaatggacactggagggatgaaagtccatatgactcctgcttccaggaaaggccagagccactgatcattggttcactaatggccaatagtgtttcaaggtgaaaggaaggatgggtccaggagcctattggaggaaaatagggtggagacttggagatggtgttaagagaacatttgggtgagtgaacataaatcaaagaaaaaataaattaagaaaaatgcttatagaaagtgaaaggtagacattaaatactaaatcagataaaaacctgcagattttatatttaaccatcttctcaattataataatgatttggaaaatttaatgttttcttttatataatttggcagggtgataactatcctcagtgggataacagactagttttaactcttacatctccatgtttcagagtttatttgaggcaaagtatgatttttaagaacagctactgcttattttgctcaggttgcttattgcccagcccagtctgaggggac

SEQ ID NO: 1639 - DNA, 230 bp, Homo sapiens
catttttccactgtggacaccagaccaggtatggacagaatgcaaaggagactccaagtctgtctggattttgttttctgaaagctgaagtctagaagaatttgaagaaatgatggaagagtttaaaaaaaaaagaatgatgcttgaaagggtcttgctctatcacccaggctggagggcagtgccatgatcatagctcacagcaatctccaactcccgtgctcaggtga

SEQ ID NO: 1640 - DNA, 247 bp, Homo sapiens
catttttccactgtggacaccagaccaggtatggacagaatgcaaaggagactccaagtctgtctggattttgttttctgaaagctgaagtctagaagaatttgaagaaatgatggaagagtttaaaaaaaaaagaatgatgcttgaaaggtatggaactttctgagggtcttgctctatcacccaggctggagggcagtgccatgatcatagctcacagcaatctccaactcccgtgctcaggtga

SEQ ID NO: 1641 - DNA, 1518 bp, Homo sapiens
aaaaagaaaaaaatatcttgcattatactccttcaacatctgcacactgcttcacactgttctgcagcaaatactgtgcattctgtatctggtcctgtgtttctctaatggtaatgatccaatcttccaatccttctaaaggctcatcaattttgatcgaagctcccgactcatgacggatttgtttaatctgcagaccacctttgccaataatagatccagccaaatctttgggaatcgttacttgtgtagtaataataagtccaccaagattaccatatgagccacgaccccctgcataggaataatcatatctggagccaccctgtggttcataagccatctgccattctgatgggctccatgtatctattgcagagtcccaagtttcatcagcactgaaaccaaccatgccatggtaacagtctccaggtctccctcttctgtcataggccatgaggtctccccctctaggtggtggtggaggaggaagaggaagattccgagctctgctaccaccctcaccaccttgtcctggaggaggtggaggtggtccttgacgagggctcatatcatcataatctcttctagatggaggcatgggacgcccaccctgaccaggaggcattctgtcaaaaccacctcttccccgcatgggaaatcccactgggcgtccacagcggtcatcaaacataattgtaaaaccaccataatcataggtttcatcataaaaattgggatcataaggctgtgcacgtcctttgatgggagactcatatataagatcaaggatgatctttatgcactctacaaccctatcgggttttcctccaataagaacaactcttgtcagtggaataaggacagcattcctggaaaagcttgatggtggtttgagtgttctctcgaagttctttgattttagcaccttcgaccccaataattcctcctgctagactctgatgaatcaacagcctcaactcgcagtcaaagtcacttcctttatagtgttggccctcttccaaggtagggatgattttcttcagaatttctccaattgtgtcaataccagcactgatactcaatatgtgctcggggccactgctgtctgggactgaaacactggcattgtagtctgtacggagagccttgatattcttgcctccttttccaatcactgccccagcattcttggtctgaagcagaatgcgtaattcaaccatctcatcagtgtttctagatcttttaaatgcttgttactcttccatatcttctgcagggtgtttaccaaattcaccattggtttcagtgttcgggaaggtttcttccggctgttcagtttacatattcttttattaaatgggcacaccaatcagttattatatatccttgcagagcagaactgaagcgttctgggtgggaccaacaactgacaccccagtgctgcagtagcctatagtcagtgaacaagtgggccacaggcaaggcgtcgaggtcggtgcagcagagaaacagagg

SEQ ID NO: 1642 - DNA, 892 bp, Homo sapiens
gctacctttgcacggttagggtaccgcggccgttaaacatatgtcaccgggcaggcggtgcctctaatactgataatgctagaggtgatgtttttggtaaacaggcggggtaagatttgccgagttccttttactttttttaacctttccttgtgggcatgcctgtgttgggttaacagtgagggtaataatggcttgttggttgattgtagatattgggctgttaattgtcagtttaatattttggagaatgttttcatgttacttatactaacattagttcttctataaggtaatagattggtccaattgagtgtaaggagctcagttgtatgtttgggattttttagacgatgggtgttgagcttgaacgctttcttaattggtggctgcttttaggcctactatgggtattaaattttttactctctttacaaggttttttcctagtgtccaaagagctgttcctctttggactaacagttaaatttacaaggggatttagaaggttctgtaggtaaatttaaagttgaactaagattctatcttggacaaccagctatcaccaggctcgataggtttgtcgcctctacctataaatcttcccactattttgctacatagacgggtgtgctcttttagctgttcttaggtagctcgtctggtttcgggggccttagctttggttctctttgcaaagttatttctagttaattcattatgcaaaaggtacaggggttagtccttgctgtattatgcttggttataatttttcatctttcccttgcggtactatatctattgcgccggtttacaatttctatcgcctatactttatttgggtaaatggtttggttaaggttatttgatagtaaggtggaacgggtttagg

SEQ ID NO: 1643 - DNA, 766 bp, Homo sapiens
gggcaggcggtgcctctaatactgataatgctagaggtgatgtttttggtaaacaggcggggtaagatttgccgagttccttttactttttttaacctttccttgtgggcatgcctgtgttggaatgttttcatgttacttatactaacattagttcttctataaggtaatagattggtccaattgagtgtaaggagctcagttgtatgtttgggattttttagacgatgggtgttgagcttgaacgctttcttaattggtggctgcttttaggcctactatgggtattaaattttttactctctttacaaggttttttcctagtgtccaaagagctgttcctctttggactaacagttaaatttacaaggggatttagaaggttctgtaggtaaatttaaagttgaactaagattctatcttggacaaccagctatcaccaggctcgataggtttgtcgcctctacctataaatcttcccactattttgctacatagacgggtgtgctcttttagctgttcttaggtagctcgtctggtttcgggggccttagctttggttctctttgcaaagttatttctagttaattcattatgcaaaaggtacaggggttagtccttgctgtattatgcttggttataatttttcatctttcccttgcggtactatatctattgcgccggtttacaatttctatcgcctatactttatttgggtaaatggtttggttaaggttatttgatagtaaggtggaacgggtttagg

SEQ ID NO: 1644 - DNA, 1460 bp, Homo sapiens
gtaacctccgcctcccaggttcaagcgattctcctgcctcagcctccctagtagctgggattacaggcatgtgccaccacgtccggctaattttgtatttttcgtagagacggggtttctccatgttggtcaggctggtctcgaactcctgacctcaggtggtccgccctcctcggcctcccaaagtgttgggattataggcgggagccactgcgcccggcccattctgcctctcttactgccaagtatcctagagccatcttccggctgcagggaatgtgaactgaagagaaaggtgtcctctcttctcataaagagacccaaagacgaatgccccgcagtctctcgttccaccttacgagaaacacccacaggtgtggaggggcaacccaccccttcatctggtgcccaacgtggaggcttttctctagggtgaaggtacgctcgagcgtggtcattgaggacaagttgacgagagatcccgagtacatctacagtcagccttgcgtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcatgggaagggaaagacctgaccgtcccccagcccgacacccgtaaagggtctgtgctgaggaggattagtataagaggaaggcattcctcttgcagttgagacaagaggaaggcatctgtctcctgcccgtccctgggcaatggaatgtctcggtataaaacccgattgtacgttccatctactgagataggaagaaaacgccttagggctggaggtgggacatgcaggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccatgacacatccccctctcagagaaacacccacgaatgatcaataaatactaagggaactcagagacggcgcggatcctccatatgctgaacgctggttccctggg

SEQ ID NO: 1645 - DNA, 3141 bp, Homo sapiens
gtaacctccgcctcccaggttcaagcgattctcctgcctcagcctccctagtagctgggattacaggcatgtgccaccacgtccggctaattttgtatttttcgtagagacggggtttctccatgttggtcaggctggtctcgaactcctgacctcaggtggtccgccctcctcggcctcccaaagtgttgggattataggcgggagccactgcgcccggcccattctgcctctcttactgccaagtatcctagagccatcttccggctgcagggaatgtgaactgaagagaaaggtgtcctctcttctcataaagagacccaaagacgaatgccccgcagtctctcgttccaccttacgagaaacacccacaggtgtggaggggcaacccaccccttcatctggtgcccaacgtggaggcttttctctagggtgaaggtacgctcgagcgtggtcattgaggacaagttgacgagagatcccgagtacatctacagtcagccttgcgacatttgaagttctacaatgaacccatcggagatgcaaagaaaagggcctccacagagatggtaaccccagtcacatggatggataatcctatagaagtatatgttaatgatagtgtatgggtacctggccccacagatgatcgctgccctgccaaacctgaggaagaagggatgatgataaatatttccattgtgtatcgttatcctcctatttgcctagggagagcaccaggatgtttaatgcctgcagtccaaaattggttggtagaagtacctactgtcagtcctaacagtagattcacttatcacatggtaagcgggatgtcactcaggccacgggtaaattatttacaagacttttcttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcgtgtccaagtgcacaagtgagtccagctgttgatagcgacttaacagaaagtctagacaaacataagcataaaaaattacagtctttctacccttgggaatggggagaaaaaggaatctctaccccaagaccagaaataataagtcctgtttctggtcctgaacatccagaattatggaggctttggcctgacaccacattagaatttggtctggaaatcaaactttagaaacaagagatcgtaagccattttatactatcgacctaaattccagtctaacggttcctttacaaagttgcgtaaagccctcttatatgctagttgtaggaaatatagttattaaaccagactcccaaactataacctgtgaaaattgtagattgtttacttgcattgattcaacttttaattggcggcaccgtattctgctggtgagagcaagagagggcgtgtggatctctgtgtccgtggactgaccgtgggaggcctcgccatccatccatattttgactgaagtattaaaaggcattttaaatagatccaaaagattcatttttaccttaattgcagtgattatgggattaattgcagtcacagctacggctgctgtggcaggagttgcattgcactcttctgttcagtcggtaaactttgttaatgattggcaaaagaattctacaagattgtggaattcacaatctagtattgatcaaaaattggcaaatcaaattaatgatcttagacaaactgtcatttggatgggagacagactcatgagcttagaacattgtttccagttacagtgtgactggaatacgtcagatttttgtattacaccccaaatttataatgagtctgagcatcactgggacatggttagacgccatctacagggaagagaagataatctcactttagacatttccaaattaaaataacaaattttcgaagcatcaaaagcccatttaaatttgatgccaggaactgaggcaattgcaggagttgctgatggcctcgcaaatcttaaccctgtcacttgggttaagaccatcggaagtactatgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcatgggaagggaaagacctgaccgtcccccagcccgacacccgtaaagggtctgtgctgaggaggattagtataagaggaaggcattcctcttgcagttgagacaagaggaaggcatctgtctcctgcccgtccctgggcaatggaatgtctcggtataaaacccgattgtacgttccatctactgagataggaagaaaacgccttagggctggaggtgggacatgcaggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccatgacacatccccctctcagagaaacacccacgaatgatcaataaatactaagggaactcagagacggcgcggatcctccatatgctgaacgctggttccctggg

SEQ ID NO: 1646 - DNA, 1346 bp, Homo sapiens
gcgattctcctgcctcagcctccctagtagctgggattacaggcatgtgccaccacgtccggctaattttgtatttttcgtagagacggggtttctccatgttggtcaggctggtctcgaactcctgacctcaggtggtccgccctcctcggcctcccaaagtgttgggattataggcgggagccactgcgcccggcccattctgcctctcttactgccaagtatcctagagccatcttccggctgcagggaatgtgaactgaagagaaaggtgtcctctcttctcataaagagacccaaagacgaatgccccgcagggtgaaggtacgctcgagcgtggtcattgaggacaagttgacgagagatcccgagtacatctacagtcagccttgcgtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttctgtactaagaaaaattcttctgccttgagattctgttaatctatgaccttacccccaaccccgtgctctctgaaacaggtgctgtgtcaaactcagggttaaatggattaagggttgtgcaagatgtgctttgttaaacaaatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcatgggaagggaaagacctgaccgtcccccagcccgacacccgtaaagggtctgtgctgaggaggattagtataagaggaaggcattcctcttgcagttgagacaagaggaaggcatctgtctcctgcccgtccctgggcaatggaatgtctcggtataaaacccgattgtacgttccatctactgagataggaagaaaacgccttagggctggaggtgggacatgcaggcagcaatactgctttgtaaagcattgagatgtttatgtgtatgcatatctaaaagcacagcacttgattctttaccttgtctatgatgcaaagacctttgttcacgtgtttgtctgctgaccctctccccactattgtcttgtgaccatgacacatccccctctcagagaaacacccacgaatgatcaataaatactaagggaactcagagacggcgcggatcctccatatgctgaacgctggttccctggg

SEQ ID NO: 1647 - DNA, 773 bp, Homo sapiens
gtgtgagccaagtaaatgtctccaggaagagcttcacaagcagaagctatgtaggtgcagaggcagtgaatggaagcatacttggtttcaccaccaaaaagtcagggctgatggagtgaactttgagaaggaaagaatggtgaggtataaattcaatcaagttagccagaggtcatataatatgggttccacacaatcatagtattctgagtgagatgaaaagttgttcgaggtttttgagcttaaatgacatagtctgtttcatttcaatagaatcattctggctactatgtggacaaaaactgtagcaggtaaagaacaggagccaagaagccagtatggagccaaagagcaggccaagtgagggatgatgactcactcactggctagctgagtggttcttggtataccaacaagaatgaaaataacttaacagcaattttataaattcacatcccccagagcaccacagagtaaagaaatactgcatatgggtaacaactggttcttagttactaaatctgaaagatcaaatacagttaattacataagcttctcttgagtttttctgggggaatataccaggagaccataatcaaggtttctggtattgcactaaacacgatgaaaaacaggagagaacggagagggatcatgttttaccacaatatgcaatttatgggagagatgaagcgctcaggtggagatgactagtgtcacgtggtgttttaagtggatactcacaacgctggaactcacagcaataacaacaa

SEQ ID NO: 1648 - DNA, 258 bp, Homo sapiens
catttactggctctcttaccctggaaataacattatcagaagctatttattgagcatttcttctgtgctgggcgctatgcaaggccgaagaatacagtcaggatcagacacagtccctccaagatggggcaaaggccagaaaagcgaccttcagaaggagccagcaccccagctcctgcctcagggcgatatgaagaccccaggaaggaaattatgctgagaaaaggagatcacacctctgtccagcctgcaccggcc

SEQ ID NO: 1649 - DNA, 2198 bp, Homo sapiens
cagcccacagcctccggagttggcttcagaaatcccccttaatgttgctagaccagttacattaaatattaaatgtaacaccaggtaaatattcctgggtttcctttagtctaacatccaacccagatatgcaataaaatgaaaaactcaaaatccctaacaactcaaaccatccaatcacccagaccattaggatcacaatgagttgagactgcaggctctatactgtgacatctcgtcagtggctccatcttaagaaatacagaattttagttgcatcagtaactagaatagactagctctgcttttaaagctttgccttttaaatgtagatttctagaagttcactttcaaggtgccatcaagaaggctaggccactaagaagtcacaagcccaacctagacatcgcagcctcttaagacatttgtcttcactaaccgttcagtctttaacctgctgctgatcctacaatgaaaacacttagtgccagctgaagcgtggatgcttgtctatcagcaacataattaagtgtagctgattctgcaagaaatttatattagtcacagcagacatccacaggaacatactgaatcgtactcagtagtgagtttaggatggctttcctgctcccctgcatcacccttgcagtgtttaatacaaaagggtgcacatgtcaagctgccgctgagaaaaccagattccaaacaggtgcctcaggaaaagtctcttattatccattgcttgcttaagcaacctctacttttcaaaatggaaggtaccagaatatggctacaattaagttaggtcatataaacttacctaggttaaaaagacccttaagtctcacaaaactgtaatttttaaacatcctggctaaaactgtgcttctagatgttatatttttgcttatactagttgagctttataatcaaaagctaatgtcctactcaaaggaaatacatgtctattaagcagatggtcagtggtatgtagaaccttactggcactgtgttttctggcagtggaagattctagtacagaaaattgtctcttgctaaaaatattagaagtaccaaggactattgcataagagaaagtttgtagcaattttttgctaggcagatggtacacttgaagacaacaatgacttcattcaccaaggaaaacactacttagcaaagatttacaatatcctaaacacaaacacatatgtggctgaggtggaataagcagcacgttgtcccaaaaacacacttaaggctttactttagcagcatcagggtaacctatcaaagaggcgctgttaatggtcagttcatttcaggaacgctcggctggaaccataaaagtgctccgtgggtattgtaagaaacattttaaatattgaaggattttcttctttcatgcaatcctgatccttaatctttctcccttgaatctttcaaatcggtctgttcttctccccccaggaacagtccacagtggtgtgataataatctaagtggccagatgatagtaggtaatttattaaactccacatccagtatgttcattaacagagactaaggacgtgagatgagagaagaggacctgcttgtttgaaatcatgttcgaggggcttgctcctctgcccaagagactgctgatttataggttcaccgggcaatcctccactgccgccaccaccaaatgcttccctgggactgattcattcacagaggccttgtcctttcaaagattccacaataaactcatctggcccctggagagaaccaaggcctataatgaaacccctcaaatagttccagatcataaaaggctccaaaatcctataaaccaaagatgtcacagagcctacagaacactgctcatggattagccccttgtttgctgctcctttcggtacagacgcctgggaaggcttttcccacacaagatcactcatcttttgacaggtttaagcattctgtcaactgtccatcatgggttctcaaggaacttaaaacaagtatcttcgtgccaataaacctgaataatacacagagtcccttcctatccatgggaaggaagcggagttggctcatccaagtaaccctattagagtccaatgctgaggaatgaaaagacgatggacgactcccaaccccagcagccctgtgcttacctggatgtaggaacaccgagacattccaaattc

SEQ ID NO: 1650 - DNA, 1616 bp, Homo sapiens
ctgagacagattctccaagtcttagaacatggatatgcagtgagagtgaggtttacgtagaaaagtctttgtgtcttgggagtgccatgtgtattgaatgtctatgactcatgtctccccttgactcacttcttggctgggctacatgactcatcaggcctggtaggttcagggcagtgtagctggtggggaagggctaagtgaagaggggctgtctagacctggggagcatggttataatgagctttttcaaacgtacaactcaactctcttgcacctaggaagtatcttcatccagaaggagttctcagtcctttttctggtcctgcagagcaaaagaggagagagaaaaagagaatgagttacatgggcccactgtatgttatagctgactgctgatggtatcagaggtaagacctggccaggtactagcatctcaaagttactgcacttatgtgcagcccaagaagcgctcaaaacttttctaaatccttctcctccttgggctacaagtatcctaaggggcatcattggctgaaacacttctaaatacaaaatgcttttgccgggtaagtccttaaactggctatcactaatgtgtctgatggtacagcaggctcctgttcacccagcctcctcctgttggccctgcccgaagtaactctctggggccagcactcgttaaggttccaagcattggtgagggtcctccagcagtcagacatgggtcttctggccaattcatcatggcatctccaccaataaagcatggaaccaatccacgactccctctgtccccggggggaggcagtaattacttatttgctaatggggaggggaactgttttaaagtaatgcttatggctagatggtaccttagcaagggagaaaataagtcaatacatcttaaaatcttaagaggcagcaaaggatcaactcctccaaactcttcatttgtcactttaaaaatcaaaaacaaaaacaaagacgataacaacaaaaataaacaaacacacctagagaggttgagaggcaggtccaaaccatgagcagaactgagatttgaactcacccagattaacctggaatggccatccgtgtttcctgctgccaccttagttttcccaatgtggacacaatttgggggatgtgggtgtgggtctgagaggggaaataggatggataggaagctggagaaggggcttgtgtgttcataaaagagaggattggggaggaggaaatcagtggtctggcagaagagcttatcatctctgctttgcttgttccattttctccatttgtatagttctgctcatattccattaaagtgaaaaaatagtatttttcactacagggacttttggatttaagactacatacttaaacaatgatgttcaaaagagaaactggtgtgactgtaattgtcagtcacttaaaaattttgagagtgcgtatgcagatggattatgtgtgagtgtgtgtgtgtgtgtgtgtgtaaaactatgatggtttgcaggtatgatggaagcatcccctggtatgtgaatttttccaaaactgtttacaaacatacccaattggagataggataacaaggaaaaatgccaaattccatg

SEQ ID NO: 1651 - DNA, 3639 bp, Homo sapiens
gccaaggagagtgtgagacataaaacaaaaaaaggcaatcttgggaaaggtaccaggaaagaagaaagacatgacagtcattggggttgagggtccctatagaaaatcatttagtgaaagatgtcttcctttagttcttcttcctttttattccctatccacatccttgttgtcctccctttctcagtttctctgtgtgtagccccaaaagaaagcttaaccatggacagcagctcaacaggccaggcacactgcaagttaggtgtcacctggacaggctaggcttgctaacagccaacagggatggggtttgaagtcctgagggagactggagagcagctgtgcagtactcaaaacccaaactcaggtcatggccactgatcctacccagacctctctctcttgagttatccattctaatttcttgtccttctctgaagccccttgaggttggtgaagagtgaaggaatgcatcctgagttattaaagacactcctaagaagctcattaagtccttttctccttaactccaagaaaagatcccattttccttccaacactttaaaaccattattcattggatggaaacatccttcctcccctcaacccttttcaaagggaatcatccagcccaggactatgaagtatccctatgtgtggcagttagatttggtgacaaaaagggctctagtctctccttgttacaaagaacaaagataaaattatgcagttcaggccataaatagtgaggctgaaccgaggccatcagttctcaagagagaggattcagaccaatttgttttcccctctcctttcctttgaatcccactttctgtcttcattcccctgtcatctgagtgctatttggcccctttactttattttagtgtgtcttctcttttctttgtttttttcaaactcactcttgaccattcttcgttctattttattgcagtcccgtttctttccctctttctctgtctctccctcatttacttctcctgagatttacgcagcttgacttcatgagctcactgtcacatcaagggaaaacagaaaggaggagccatggctggagggaggaggcttatcttaccttgtaactgtgttaacccattgtgtgggggtgggatgagtactggttttttcttactcttgagtagtgctctaatagctccattacctctgcaagcacaaagatgctgttcgcttttaaagcagcagggcctggctaaaagcctgccataaccaataaaagcctcagctgtgctggccctctccaaatctcctcacaccccaggcttgtaagctgcctgaaacagaagttaatagtattcattggaataagacatctccaatggacttcttccagtctatttggattgcggtgccctgccaatgacaaggagtggtgaagagatatcagggttcccctgcctcatgtagagtgcattctcatgaaagagattttggctggagaagttaagtaaggcagtctttctattgtaagagtcacatttacttcatagtattattttgaattctgcaatagttgagaagagagaaaagatgcattgctcttgcttttctgaaaaaaagacatattgaccactcagatccctccaaacatgttaattccattttccattctcctgctccccctgtgtctgtcactgatgttctgtctgcccttttggtcttgttccttcttttccttccttttcttttccattcttctcttttttttttcttttttcctctctctctctcctaattccatcttaactcaaggttctgaaattgttattttatctaactgtgaaagggcgtaaatggatgagctaaagttactccaatccttaaccatttcatgccaaacctgttgtcacactctttattggtacagaacgggtcatttcctacaaatttgacgggaccatctgctcctcgggatgctgctaggtggttttcagtggcatgaggaaagtcttagaaaatatactgtaaggagctacactgattgaccaaagcagttgtgaaaaatcctttagtttctagaaaggtgggactggcttggagttatggatggacagcgaattgttggcagcaatcaggggaagcaatgaagagatatggggtagaagactgttaagaaataaattactctggagaaaggaccagggaaaatggatgaggaggagagtggagagaagaacagctgaatcctaaacaagggcaggcctggagttgtctcgatggtgtcctctgacctgacacggtatgcttcttgccactttgtgctgtgtgctgggcagccgctcttcaccaggctatctgggtattctctctcacacacaatttcccataaacaaatcccctgttgccgtgaataatgccaccattttgcttgagaaattatctgaagtgtttttcattgactttctttgcttaaatctagaggatggcccattctaatcagagtgtgtatctccctcaaatttattagcaagtctcccatttaatccctgatttacgctttattcatatcccagtggtaatgctgagattgtgctgacatcagctttccctgccaaggacacatgaaccacgctctggaaaatacacatgcttaacagatgctatgaaaatgaagtttccatcatatttccacagaactctaggccttcaccacctgaccaaacctcatgccccaacaacctctatgtctccctcattctctctctttccagggcatgggtttctccatgaatggtcttctcacagatctttcatctttcatcattacctcttttctcatccttagtatcttccccattctctttgaccagaagcaaaggcagaaagtgggaattgactcaagtctcccagagggcagatagcaatgccatactggatacaggatgagagtgggagcctcactgagtccgttatgattcatgagtggagagtgaggatattagttctggagctgggggtttctcattagcacggagggcagaccatagagaagaagaaaatgaagcaaaatctcctttttttgtgagattttttactcagctctagccaagggtctggatcctgagcatttctcttccttcccacttttcttccttaaatccttattttctgcttccattttctctcagtattcattttactcagcaaaaaggtgaatctaaaccataagacctaaagactcaaatgggtgcttttcatggttactctgttttttctctgaataaaatatcacatgattgtacactttgtacagactgattgaattgttctaagtaaatacacaaaaccaaaatcaataaaggtttagagttaattctgtatctggaagtaggtgaagagagttttacactagttggattccaaagttgcagatattgaaaacagaaacaataacaacagaaggataattatacattatgattgtgaggaagctagaaaccagtgcaaaagaatattttcgcactaaaaatattttttttgcactgacttgatctctagctctgtttgtttagacaatgtgattctgaggacaaatacaggaatttagaattgagattttagttcaaatcttgattctgccatttagtaagcagattattt

SEQ ID NO: 1652 - DNA, 1479 bp, Homo sapiens
tgtgagtggcaatctcattaggagaagggagtggaatgctaaggcactggccttgaagctgaaatgtgcatggggcacacacccttttcacttagattctatgtttcagagaaatagtatggatgtggccgtgatagagaagcaaaataaagtcactgggaggagtttaaaattaccttatttcttccagaaaataaggctacatgtgtttcaaaagttccacaaggacagggtaacaccagcctcttaaagtaaggactctatgcttaagtaacatttagggcaagttagttacttttcaattaagaatttggctgagattatggaatcagtagcagatcacaccatatgtgtacccctagttcagcatgttctttcatcaagtcaaagacaaaagagaaaaaaagatgcaacagtctctggactcctcaccaccacatccgtttgctctccttggctcttgataaatagaatggtgaagaccccaagggaaatccccttgtctgtagtttctgcattgcacaactgcggggacacaattcacagaacaatatgataggatacaatgtaagagcttctcctgcactctcccagtcttgttcttgagttttcaccctcccaggcttacccactatttctgctcttctccctcaaattttcatcttacagtctttactgtttcacaatgcaaaccctagtaaatcataaaatcactcacaggccaaataaaaacagtagctatttttgattaagcattggacaaagtatgatctgctttagaagtcctgcttctggctgcctcccaatcttttgtttgtatgtttcaatcaagacatctgctgtctagtgttatttcagataataatcttaatattaagaaatgattcagaatatccagccataccaaagcaaaaaggcagcatacaatctcttaagagaagacataattaagttaaggaaaacagagagttgccattttttaagagtgaatatgcatgtccaaattacttcaattagcataaccacatctttccagaacagttggctaatatcatggccttcctcattaggattcaacttcacaattgtgaataacaactacaaagaaaacaaaaacaaagaaaactgaaagataatcctatattttattgttaatcaagtgtaaccttctttactttttttcttctttgtccctcccttcaatatttcaagactaggaagataaataacagcaggtttaatactattgacagaagactttctgctatgtaaacctgatttttctacaaatgcattatggccattggggacggtgagagcaggattgaagattcattaatatatccccataagcaaagagcaaatgaatctcaggctgtttctcagaatgtttggaatgactcactcaacaagctgtctagatcccttctggctggaaatatcagaactagaattgaataatctcatattaaaaatgaa

SEQ ID NO: 1653 - DNA, 3148 bp, Homo sapiens
ggacaacttagtaatgcttatgaggaacattgaaaaatcatactctcttaacaatctttgaacggatgaggacatatcccagaaataatggggagacatctggagatatgagactaaaaacaggaaaagactgcacatttttagtgtgatgtgacacccaaaagactaatgttatttttggatgcagtctatttagagcatttcatcatggaatagagggtgacagttccactctcaatgacattcatgagacctattctagaatgccccattccgtttggtttgtctgactaccaaaaataagtagacagattggaaggagtccaaagaagagtttcacaattgattagggaaaagaagctgacttatgggaaaagtttgaaagaattatgtctatacaggaaggtatgggtatacatgttacaaagccataaatgtctgttggaggaagaaataatttacggagattaaaaggctacaggttgaactgtacagtgaaatgggttttgaaaagagaatttggattacgtattggatggaaattagttggtggttaacgacatctaggtggcattgatttggaagtagtgcgtgccctgatgtgaaatgctgaaacgcgtcttccatgcacattcaagagaggaatggaggcaaaataggaggtgaagggatttgatgtcactttagatactttccatctcaaatctgtcacattccacattgtatctgtgtgtgccatatgcatgtattacatttaattcaaatgtaaactgttttaatcctgtatgtattaagatactttatcccttccccctcttttgaataccctttatgggaagctaaggtgattgtaaaacaacgtttaccacactatctggaaatattcaccattcttaaaatggttgtgaaaataacccaaatatctaacaaattcaaaatgatgttagctaagaagttattaagacattatgattgcatttatggtgaatgtgtgtacagagtgttgcatagatactttgcaaagagcctttgcatgtatttcttggtgaacttgaagcacctcattcctttggttagattgtcctctccagttgcttataataggcctccacctcacaatattgagacttttaagaaaagtaattttacatttagcaagggaggtagatggcctaaaggttaagtaaaggaaaaaataaaagaggagcacaaatagtaataagataggagagtcagggattggtttaagtaatgaagtccgcaatcaattttacaagttaaggacagtaatgcttttatttgcctttacacactcatcgttgacacttaaagaccatagagacataatagtttgtattctagaaaagttcttttgtatttttcttcaaactatccaattaaaaaaactcttaattttatcagagaattgacagtttaaataaaaattttccattgctttgtttcctcttctgggcatataatcaaaatgccatctttttctacccttctcattgccctttgctgaactattctttctatgtatattaaaattattaacccccacataaaaacagaaaagccaaaaaggaatagggttccaccagcaaagccacatagtgctcatactgattgaaaacgtggcatggggactgagttttccgttttgctgtagatccctatggaaatttcagtggtttaggaaaaagcccgaaaggtggctctgagtttaccagctgtaatcttaacttgaatttctggtgaagatacaattatttatgatatattacagttttaataatcttgaaggaattctgggctaacatttgttttgccaatttctgttcagttatcatctattcaatcaatttatatgtttcctttgtatactagcactgaatcaagttttgtggggataccatgaggtagacttgttctctatccttcactaattgcagtatgtttggggaaaagaactagaacgattaaagtaattcgagggtaatatattgtagcagaaattgctactgacagacacagtattaaggaaaaatgggcacattcaagtttcttgcagaaagtccccaaggaaaaatagtggactaccgtgatttaaggtggaaaagtagccataggagtaaaaacttgatggtgacaacacatgagggaatgtggaagaaaccatgatggccagcgagaagggtcatcttggggagcaatagcataggttctaagtacatagcagaaccccattattatgtattatttattaaatggtccttgtattatgtattatttactaaatggtccttgtattatgtattatttactaaatggtccttgtctctttgttgacaacaaatattctcatccactcctgtttcttttttcccactttgaagcagcttgttcctgggcgtatgtgaaactgcctcatagctttaatactataatagcataacaaatatttcattgtttttcagaaagggttctcgttataataaaaaccaatctataccccataaagctcaaaatcttccaaagagtagatgttaaaaagcacccagtggatgagagagtactataatcttattttaactcttaggcacacccctaaagatagagccttcctctcattgccaatagcactaaactcctttcaacattgaggaggtacctacttgtcttgggttgccatttaattgatctttaagtttttcttctcaattggatataaagttttgaagactggaataggttttacacaaagttaaatacacagcagatatcataaaacatatgtttaattaatagatttatgagattgtgttttgtttccttttttgtggatgaggcaagcataattgtcacctctagaggcaatatggatgggcagacttcatcccatttcatacaaatgcacaggaatcaaccatatattgacctacttacttcatttaagtatttcctatgatgactttgactttgtcctgacaaccctattaaagctagtctgtgaaagctggaagcaaggtgtctaatttcctttgtagagagtaataaatggtgttcgctagcacactgctttgcatacaagaagtgttcaacaaagggcaagcatgatgatgatgatgatcttttcctatctcag

SEQ ID NO: 1654 - DNA, 2558 bp, Homo sapiens
cctcttttttcttctaggtaagtcttgctgctttctaaatctcatcagaatgtcttttaacaaaatggtaaaatgtttgtatccaggaaattgaatggaaattgttgtgttgatggaaattgttttttcaaggtaaaaaagaaatgtgttattttaatttttttttaatttatggagattagaaaatgtgcttagtgccccctggagtggtgtagcaaaaaatctcaaagccaataaacaggatccccaggttttaattcaaaagcgttcaaggttgccactgcgaaaaacaaagtttgttgtttcttttaaaatgtaaacctccactgcttagagaattaagctgttttgtcttttgttgccattgcttttggtgttttagacatgaagtccttgcccatgcctatgtcctgagtggtaatgcctaggttttcttctagggtttttatggttttaggtctaacgtttaagtctttaatccattttgaattggtttttgtgtaatgtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtagcagtaccatgctgttttggttactgtagccttgtagtatagtttgaagtcaggtagtatgatgcctccagctttgttcttttggcttaggattgacttggcgatgcgggctcttttttggttccatatgaactttaaagtagtttttttccaattctgtgaagaaaggcattggtagcttgatggggatgacattgaatctataaattaccttgggcagtatggccattttcacgatattgattcttcctacccatgagcatggaatgttcttcgatttgtttgtatcctcttttatttccttgagcagtggtttgtagttctccttgaagaggtccttcacgtcccttgtaagttggattcctaggtattttattctccttgaagcaattgtgaatgggagttcactcatgatttggctctctgtttgtctgttgttggtgtataagaatgcttgtgatttttgtacattgattttgtatcctgagactttgctgaagttgcttaccagcttaaggagattttgggctgagacaatggggttttctagatatacaatcatgttgtctgcaaacagggacaatttgacttcctcttttcgaattgaataaagcaatggcaacaaaagacaaaattgacaaatgggatctaattaaactaaagagcttctgcacagcaaaagaaactaccatcagagtgaacaggcaacctacaaaatgggagaaaatttttgcaacgtactcatctggcaaagggctaatatccagaatctacaatgaactcaaacaaatttacaagaaaaaaacaaacaaccccatcaaaaagtgggcgaaggacatgaacagacacttctcaaaagaagatatttatgcagccaaaaaacacatgaaaaatgctcatcatcaccggccatcacagaaatgcatatcaaaaccacaatgagatatcatctcacaccagttagaatggcaatcattaaaaagtcaggaaacaacaggtgccggagaggatgtggagaaataggaacacttttacactgttggtgggactgtaaactagttcaaccattgtggaagtcagtgtggcgattcctcagggatctggaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccgtaaaaaatgatgagttcatgtcctttgtagggacatggatgaaattggaaatcatcattctcagtaaactatcgcaagaacaaaaaaccagacactgcatattctcactcataggtgggaattgaacaatgagaacacatggacacaggaaggggaacatcacactctggggactgttgtggggtggggggaggagggagggatagcattgggagatatacctaatgctagatgacgagttagtgggtgcagagcaccagcatggcacatgtatacatatgtaactaacctgcacaatgtgcacatgtaccctaaaacttaaactataataataataataaaaaaaagaaaatgaaagaaaaaaaaagagaattaagctgtaacagattcctgaagatgttatgtaggccttgttagatagcagtcatttctagattctcacagatgagttgggtgaaatcagatatttttataccatatttgaatgtcattctcttcgaaaaagccaagctgcgcacacttcactgaaagccctaaatagtcaag

SEQ ID NO: 1655 - DNA, 1212 bp, Homo sapiens
cctccatgtcccagatgcaggtgatcctcccgcctcagcctcccgagtagctgggactacaggcacgcacaaccatgcctagctaatttttctgtttttagtagagacagtgtttctccatgttgcccaggctggtctcaaactcctaagtgatccacccgcctcagcctcccaaagtgctgggattataggcgtgagccaccacaccaggccaagaaggcggattccttgaagatgattcaaagccagccattaaggatatccgtagaccatgacccggatgctaaataagcaccaccccttcctgttcagagggaagagagaaaggagagggaagaattataagctttcccctttctgatggtgtcttcttatttctgacaatgcttgggagcgagctgtgtgacacccagattttacgagttgccagcggtggagaggagagagccgggcatgcagattcttcatggaccctactagagaggacagagaaaaagagcactggtgtaggagcccacgggtctggctcttaaccctggcctggtgacttcagctatttgaccttgagcaagtcacttcatttctcctttagcaacatctctaaaatgagggagtgagcaaaaatgttcccttagatttcttctaattcagaaataccagttgattcttatttaaatatgaacatgaccaaagcatgtgcagtctgtaaagctggagaggtgcccagcaccttggtgtttccatttgtgcggtagcccccctcatgtgagccctgtacgtgaacatatgaaatcttatgctgcatccacattcaataagaagaaattgctttttcagtgtctgtgggaggagataagctgcaggtgctgtttattttcccaaaggactttatatatgaaacacagggtttattaaatgtatcaaatgcaataagagaaaaatctgtcatctgatgttgagatagcatactgggagccaggtcggggtactgcatttgctcaccagaatcagatcaaacgagatacgagtcctttggtttgattggattcatcatgaggcagcatgggtttgcacttgtagaaatcaaaactgttaggtcaggtagtaaagccaatccttgaacttacatctttagttaaggcatcaaagaattgtaagttgctttgcaatgatgccatctccacatggtcagattcttccagtaaactgtgc

SEQ ID NO: 1656 - DNA, 317 bp, Homo sapiens
tgaagaaggaaacctagaagccagggaaagagaggacagagagggttgtggagaggcttgcttttcactgtcagctcttagccctgtttgaattttctctctgcaggattactgtccacaaacaaacaaacagcaccaaaactcccaacaataagaacaacagaaatcccacctaaggcaccaaaggcttggtgagcatggatgcatggcaaaactgcctcctgaaggccagaagaaaggatttctctcctgttttcacccactccctgtgcctcctgactgaccccggtgcttcccccatggctctgcagatcttg

SEQ ID NO: 1657 - DNA, 424 bp, Homo sapiens
ctcagagaagttgaataacttgcccaagatcacatagcaaaaagataacctcaacacatgccctggatcaaactaggaacatgactgaagaataaaattgctcctcctgcaaagatggaagaatgttgagctctgtgagagctccccacagcatgaggaaataaaggggttgaaaccagagagaagctgagtggagaccaagcaagaaggcaggaaagtaggagccaggaagagacagtgagtagcaagggacaggtgggaggattggcggaggaacttctgaaaacagggatccctgatatctgatattaactgacctgctgtgtttacccacagggcctcccaaccccagcactgtgattgcccccacagacccagtagcaaaggctccataggagtgtgaggtatatttggagaaggcaag

SEQ ID NO: 1658 - DNA, 982 bp, Homo sapiens
ttagactctcctctaaagctctgctgggagaggacggccggagaaagacacaagtctccctcagctggctggaacagaaacatcactgagttacaccaggtcctatttgccatccatttcttctttttgccacaaatagagcatcaaaatagattgttcattagaaggaacacgtccaagctattgccaacctatgttggcacctaaagacattatatgtggtttcctcttaacaaaaaaagaaaaagaagaaggttaagaaactaaaagcccagaatctctgaaataagtctacacaacacccagttttttccagttactctgtatgaaatgttattgtaaatataagttccagtaatgcataaccttaaattattgttctgaaagatcagcccaaagaatattaaaagtgttttcaacatactccattaaaaaaataaaaataaataaaagtgctagaatttctctttcttctgacttcaagtgttcaagagaatcacatcgatgggacaatggaagcagttatttggatgcatgttgcaaatctcccatctccgactttatgatggatgtcagtgaagtttgtggctggataacagtagtcctacatcaaggagatttatggagaggatgcatttagtattattcatgagccacttaacaagcgtcagcaaaggaaacaatatggcctttgtttatagtcccaggagttctttagagggcttttgaaaattgaagagattttctgataaatggtagaggatctttaggtgggcctgaaagctgtaagtgtattttcctgttaacttgaagagtactacatttcatcctaacttccctgtttcctcaataaaaaattatcagatattctgctggtattttattgtgctattgttctgctacattaaataaccaagagggacacatttttaagaaaaatgttcatttcactctctattacaggaagttggagcatcttaac

SEQ ID NO: 1659 - DNA, 1965 bp, Homo sapiens
gggcttggcggctgcaggccggccacgtgctgctgcaggtactcactctggccggagggctggacgggcagcaaatgtccgggcggtatctgaggctgaggatacgcgaactgctggggctgctgcgccgcgggggcgcccactgcagggcccggctgcggaggcagggacatagccggctgcgccagggttacattcgtcggcggcagagtctgtcccccgggccccgctccctggggctggctgggctgcgcggctgccatcattggctgcggcccggtcgcggctcccgggaacggcggcagcggagccgagctttgagccacagccccacctacgggtggcggcggcggctgtggctgcccaacgctaaaactctgcggctgggccggagtgggctggctcattttctccgacgggggtagctgtgacacagcagtcaaggagctgtcagttcccgactcgggcccgtgcgccccctgcatggaggccactactaccaccaccgaccctccggtggcgcccaggccgctgtcccgctccgcagtctggtcaaaagtactgctgtgtctaatgcaatccccggatctagtcaggacgctgctgtctgaatccctctcatagtattccatacacgtccatcggccgcgtctatagggctctccgctcccgtggtccagcttgatcacgcgaaaacgggaactacatgtggtgggaggctgagatggggctgcagtcactggcccggcggatgagcccgcgagctgggggccgccgggtgctccgggggcgggggccgaagtggcagccgccgccagggtactggcgagcgccccagacacgctccgggccgaaacgactcctcctccgttggcgggagcagcagccgccgctgccagctgcccatctaggaggaggtttggggagacggtcccgggagtctccgcatccccaacattgttaagcgtctcttcggaagagctgcgctcgcagacctcctcagggccataatccgtggcccgagagacgtcgaaaatctcggaggagacgtcctctgtgcgtgactcgtccgggtcgtccaagctctcggtgtcctcggtgatgctagtggccacctgggccgtggtgacactggtgatctggaagcagctcttcttcttggccggcatcttggacatggtgaagaaggctggagggcagagaggcacgccggctcctctgggtcctgtcggaaaccggggagggcagagcacgggcccccaaagacaaagtccgagtctgcgctggggtctgaggcccgccgctgttaagagtcacgggctgatccaggcgctggccgcccggtgagacatcctcctcctcgtttccttctctgtgtcggtctcttcggctctgcccccgtctcagtcccgcggcggctcctccttcctttttagctctcgcagccgcggcgcctcaattcaattccctcagaggcggcgagagcgcgaacccaggggcgggccggctgcttcctctctcgtctccgggcagccgtgaagctactcaaggatgtgctccaccaaaatgaggatatgaagccaatataaaggaaggcaatgaatacaagagacaggcaaagggagttcccaggacataagcaagggacgtcccaggtagcaagtgtgcacctggtgtccagggccatctgtccagggagaagtcagctgccatgtcatgaagacgctcgagtagccctatgagattcccatgtgaacagaaattgagtcctcctgccaacaatcagccataatttgcaagacacgtacatgagctaccttagaagagaatccctgggccccagataagccttcaggtgaatgcagccctggaagacatcttaactgcaacctcatgagagaccctgagccagaaccaaccagctaaggcactgcccgattcctgacctacacgcatgggggtgtg

SEQ ID NO: 1660 - DNA, 2266 bp, Homo sapiens
cccacgggaagggtggccgccgtggcggggctcgctgcggcgccggtggacgagggctgcgcggggcttggcggctgcaggccggccacgtgctgctgcaggtactcactctggccggagggctggacgggcagcaaatgtccgggcggtatctgaggctgaggatacgcgaactgctggggctgctgcgccgcgggggcgcccactgcagggcccggctgcggaggcagggacatagccggctgcgccagggttacattcgtcggcggcagagtctgtcccccgggccccgctccctggggctggctgggctgcgcggctgccatcattggctgcggcccggtcgcggctcccgggaacggcggcagcggagccgagctttgagccacagccccacctacgggtggcggcggcggctgtggctgcccaacgctaaaactctgcggctgggccggagtgggctggctcattttctccgacgggggtagctgtgacacagcagtcaaggagctgtcagttcccgactcgggcccgtgcgccccctgcatggaggccactactaccaccaccgaccctccggtggcgcccaggccgctgtcccgctccgcagtctggtcaaaagtactgctgtgtctaatgcaatccccggatctagtcaggacgctgctgtctgaatccctctcatagtattccatacacgtccatcggccgcgtctatagggctctccgctcccgtggtccagcttgatcacgcgaaaacgggaactacatgtggtgggaggctgagatggggctgcagtcactggcccggcggatgagcccgcgagctgggggccgccgggtgctccgggggcgggggccgaagtggcagccgccgccagggtactggcgagcgccccagacacgctccgggccgaaacgactcctcctccgttggcgggagcagcagccgccgctgccagctgcccatctaggaggaggtttggggagacggtcccgggagtctccgcatccccaacattgttaagcgtctcttcggaagagctgcgctcgcagacctcctcagggccataatccgtggcccgagagacgtcgaaaatctcggaggagacgtcctctgtgcgtgactcgtccgggtcgtccaagctctcggtgtcctcggtgatgctagtggccacctgggccgtggtgacactggtgatctggaagcagctcttcttcttggccggcatcttggacatggtgaagaaggctggagggcagagaggcacgccggctcctctgggtcctgtcggaaaccggggagggcagagcacgggcccccaaagacaaagtccgagtctgcgctggggtctgaggcccgccgctgttaagagtcacgggctgatccaggcgctggccgcccggtgagacatcctcctcctcgtttccttctctgtgtcggtctcttcggctctgcccccgtctcagtcccgcggcggctcctccttcctttttagctctcgcagccgcggcgcctcaattcaattccctcagaggcggcgagagcgcgaacccaggggcgggccggctgcttcctctctcgtctccgggcagccgtggtcagtccagctcggcgctcggcgcggtcagcaggccttggctgggggtgggagtgggagggcgaagaggaggaggaggaggcggtggcggcggcgtgaggggcggtgctgccccgctcgggctcctcaggccggtgccggcgtcagcgctgggctctctgactgagggaaggagcggcgagtccggagtcggagatgcctaattcagccgggagccgcgggccggagctggctgaagaagctactcaaggatgtgctccaccaaaatgaggatatgaagccaatataaaggaaggcaatgaatacaagagacaggcaaagggagttcccaggacataagcaagggacgtcccaggtagcaagtgtgcacctggtgtccagggccatctgtccagggagaagtcagctgccatgtcatgaagacgctcgagtagccctatgagattcccatgtgaacagaaattgagtcctcctgccaacaatcagccataatttgcaagacacgtacatgagctaccttagaagagaatccctgggccccagataagccttcaggtgaatgcagccctggaagacatcttaactgcaacctcatgagagaccctgagccagaaccaaccagctaaggcactgcccgattcctgacctacacgcatgggggtgtg

SEQ ID NO: 1661 - DNA, 853 bp, Homo sapiens
gtgccctttgatgaatcacttaaccattttaagcatcactgtcctcatttgtaacgtaaacgtttactcattggcaagattccatcatgttacccaagagcttaggccatccattttcccccactgtgacagcctctcgtgtcagtcttgatgcctgttcctatagctctctcaccccaaaactccttccttcttctttgcctagctaaagccaactcatttgtcaatcttcactatcacatgctccaggaaggctgccctgatgccaccatttctgaaactagatacgtgctcactgtgttcctgtgcttcctccttcaatgatgaccccatgtcataccttgaagtgtccctctgttcagcctccccctagactggaatcttcctgagagttccctgatgtgtttccatagggcatggcagcatgttctgacggctttatagtgagcaaatgaacaaaaggccttggcaaaggaagaaatatcaggggtacacaggagccaaaggttacactatataaacagcagatttcaataaggggaaatcaatgatatcaaatgctgcaaagagggtcaggaaataggataactgagaaaaagacaacaggcttagaaattaggtccctgacagcttctgagaagtgtggtgagtgtcaaactttaaatgctctgggtgatgacaaaagatagggggtgggaggaggattccttcttctgggtgaagaagaaagtgagattctccttgactgagcctagagagggcacggacaagagtgccacaggaatgcagaacacagatgagacagttatttgtaaattattttagtaacataaaatgtaataacacaactata

SEQ ID NO: 1662 - DNA, 347 bp, Homo sapiens
ttattcatcaatatcttctaatccttcctcctcttcatcatcatcatcatcttcttctccttctccttcttcatcatccatatcgggaaccaagtagtactgtaatgggtttggccagatatcatctttgatgacctctcctaactcatcagcacctgcatcagaatgagacacagtgaaagtgaagcccggaaacactagtaaagcaacttacaatactacccccaacatctacttagtcctaaagctcaggacaatcttgccaacaaacacaattttggtttctcttagacagccagagaaacacagggtaacacaagggaaatctcatgcaagtgaagttaaat

SEQ ID NO: 1663 - DNA, 302 bp, Homo sapiens
tggtctcttaaaagaggcttttctggatgtgctttttgtttttttaagtgctgaaagctaggtacctatattatatccttgattttgtctcatgtcctgaaaagcctaaaatgtggatctttatcaaaaaagaatgccaaatcttgttttaaaactggaatgctgtggaacacaatgtttcccagagagaaatccctgaaattctattcccactgatcttcaatgcagaagaggtaccatggtcaaatgaaggccctgacaattcctgaagtaataacaaattcacgaccacaatcaaatga

SEQ ID NO: 1664 - DNA, 3814 bp, Homo sapiens
tgttaaccatgtaattttctcaactgcaaataatactaaattgcctcttcctttccaaaagtcttattgtattgattagaaaattcaacctaagcaaaataggttgtcttattatccatagttgatgcgatgagttatggtctgttcttgcattgtggtattgctgtttggttttaacgggtagttctttatattttggtcctctgacttcttagattttgaaaaatgtatacatactgtaaagggttatcttgcctcattgaaggttcaaatggtatggtgataagaccatattaaaagcatttataaaaggttcatggtaaagagttcattatggttcattaaatcccttcatgcttttatccactttagttactgtatttcctgtaaatgggatttatgccagggccacgttaacaccatttcacattctgctgtgctattacccacggagcttgaatcaattgaatgaaagaggtcttttcaagtgtattgattttcatttatccaaactcatctgtttgctttgccgcatgctcatacatgagaacagggcacagctaatcttctctatggtgttgctttttcctctaagcatttaatactagaatagacatatgacagatattggtataaaaattgcagaatattcactagaactacagttttttatgggtgatataagggtctggatctcgttctcatgtcagaaagaatgtagcctaaagcaagacattatagccttccttcctgcatgaaagcagtcacctcctactcttccagcccccagagagctcagttcagggatgctgtcctcctctccacaagtaaaggagtgttgcctatacagtagttcttctaagaagtgcaaatttttgctcactgtcagggagctaagttttctactgctgctttctacagaaatactccttatttttttggccaggtatcaaactgaaaatctgaacaaaaggaagtatccaatagggaaaataatacttttaatgtgcattgtaatgctcttgttctacattcctagcttaatgtgtatgattgtgtgtgtgtgtgtgtgtgtgtgtttgtgtgcgtgtgtgtgtgtgtggaaattagagagaaagagagagaaagagagaccatttattttaatctacagttagaattttgagatgaaagcgttttaacaatttttattgaattgttgtgttagtcactggataatatgtggctatgtggtggaggattaaatgatatgttctaggcttctagtaaatagatcttgacttctgctcaggtaaatactgaaatatatttacctgggggataaatactgactaaggcaaagcaaaggtcagtatttcctttgagttgcaataaatatttctatacacttaaacattgattttatgttatagctaatgatcaaacattatccaaagccacagcagaaaatattactatcaagctaattctaaggcatctttcttttatgcataatgctacaaaggataatcacttttggcttaattaagatcttggcctaaatgttggctcagcctgagtccttattgtgaaatagaagatgaatagattcatttatgaaaagctcaaagtacataaatataacaaacattaagcattattgacttaaataaaatgaacaattaacaaaagtttgaatacgatcctactgagtgaatgagctaattatttttcctcctacacatttatgtcatgggctatgttacacaatttttgagaaataattcatagaaaggatttttttgaaaaaaaatttctttcaaaggagaactatatcatagtaactataaaacatttgagtatcatttagctagggggtaagaagtatagaaatgtatcttcaagaagattacaatttaattggggagaagagcagatacatgcaaatacagaattgtgtagttgttaaaaacatgagactttgtagtcccagctacctgggactacaggggaggtgggaagatcatgattgtgctactgcactgcagactgggtgacagagacagaccctgtctcaagaaagaaagaaaaaaaagaacatgagatttggaattttaatgagtatgaattctagctctggcactatgacttctgacaatgttttctgagccttggtttccgaatgtgtacaaaggggataatagaattgatttcatagggtaacagtaagaactaaaggtctggaaagccctgaaaaggtacctatcaaaaggagaacactccataagtggtagctgttttgatgatgtattgctaccgtgacagatgaaaattcttttatggaggtaactcaaggaagtacatatgactgcatttggaatgaagcactatttttagcttaattccagagaaaagagctcttacaattgtatttcatggtttgtcaacacttcaaaaaaatggtgtgggatttgaactagaggctgactgaggaatagggttttattagttgtaaaagaggagtgatgagcattacaactgccaataaaagagcagtcatctgttcagcctgggcctgagcgcatcctccttctaaatattctctcctaggttaataccaacattagctccaagttttaaaagtatcttttcaactatttcttctgggtctcctttgtttcttcctgttttgttttagtccccccaaatgaaaaaccactttcaataataaataaacaacattaaaaataaaataagaaaaatgaacataacaaaaaatatcactttcctgttaatataaaacctcctgttaatactttgctgaaggtccttaaaagccgttctgtacctctatctctgtgtgtgtctctctctgcacatacacacacacacttgtctaatctcatttcttccctcaaaaatatgcaatatgccataaatatcttttcacaccaaagaaaaacttcattatatttaaatgagtatatcacatttgattgcatatacatataacaatttaataaactctttagtgggcgttttagttgtttccagtttttttctattaggaaaaaagtgctatagtgctacagtgagcatccttgtacattcattttggcccacttacatgattatggttatccccttaagaaaaataactagaaatagaatagaggaaccaaaagcacatttacaattttggtatttagaaccagaaatgagaagtaaaatcaccacattttaatcttagaagacttaaaaaaaaaaataaaaagaactggccagtcttaactttcatgaataaataaaacagccagtcttttaaaattaatgtttgaaaccaaagcatgaaaaataggagtacataattagaaatagttattttgtgtaattctatataaagcaatgtcttaacaatagaaaaaaagagagaaaaaatgatcaaattgaggtgtttttattgtataaagtcttgccaattaaactaaccaaaccttttaatttaaatgtctaactacacaattaaattaattgattttccagcacaattgtctgacattttgatgagttattatggaatgttgaactaaattgagtgattgtaaatatcttgtagagaggacctgtgaactagtactaatttaatcccttctatgcaattctcctttcctctcatttcttcttagaatatatagagtaatttactttcatttaatcatgggttgtcttgttttcacatttgcatataaagcctccagtcaatgtgacctgattgattgttccaagtgcggcttcttgatttcttgacctgttagtgctagttaattttggaaaa

SEQ ID NO: 1665 - DNA, 1201 bp, Homo sapiens
aaaaaatgccaaattacacccatggctaccattgtatttccactggacaatgttggaataaaagagagtgtcctcagggaactcacattttagtcagatcaataagtaaacaagcaatgacaggtgaccatcaagtaaacatgagctgctttgacagtatccaaagaagatgctcagatgagcccaggaggggctccagagggaatctggagtgagaggtgatgcctgggctgaattttcacagatgggcaggaggcaaccttcagtcaggtggagaacattccagctagagaatacagcatgtgcaatgtcacagcagtttgaagtagcttctcatatttggaaaactattaatagtttgatataatggctgggcgtgctcacgcctgtaatcacagcactttgggaggccgaggcaggtggatcacgaggtcaggagttcgagaccagcctggccaacatagtaaaaccccgtctctactaaaaatacaaaaaatagctgggtgtggtggcaggcacctgtaatcccagctactcgggaggctgaggcaggagaattgcttgatcctgggaggcagaggttacagtgagccaagattgcaccactgcactctagcctgggcgacagagctagaatccatctcaaaaaaaaaaaagaaagaaacaaacaaacaaaacatcagcccaaggtttggattttctgaaaatacaggaataaacaagccaaaattattttcctatactctcactcaacaatcaacacagaagacttctgtgaccaaatgtgtggggtatttttccccacaccaagcaagcaacacttccacagataccacctgggtgttccccgattcaactctgacactctccacctggagatagcatgatatctcacagaatgagggctcaatgccataagattgtcccccactttcaatgccaattataagccccagggatttttttacctgtgcttctgactgactggctgtaaatcagagtccttacaaaatgctatccttgggttcagtttatttgctggagtagctcacagaattcaaagaaacacttacacttatccatttattataaagggtattacaaaaaaacacaagtacagatttaaaaaatgcataggatgagttacgggggaaacgacacagagcttccttccatgccttccctaggtatgccaccctcc

SEQ ID NO: 1666 - DNA, 772 bp, Homo sapiens
gtgaaagtttaaattgctctctctgcctaataagatcacaccagttcataagagagaaaagcttttacccacatcttgcataataaacaacagttgaacaaccgcacatgatggcttatgcctgtaatcccagcactttgggaggctgagttgggcagatcagttgaggccaggagttcgagaccagcctggccaacatggcaaaatccagtctctactaaaaatagaaaaattagcaggtatggtggcgtatgcctatagttctagctactcaggaggctgaggtatgagaattgcttgaacctgggaggtagagggtgcagcaagccgagatcacactactgtacttcagcctgggagatagatcaagagcaagactctgcaaacaaacaaacaaacaaaaaaaaaaaaaccaaaaaaaaaaaaaacccagaaataatcagcactatctaatccaggcaacaaacacttgccaaaaatgaaacacttgttcaaaaatgaacactttcttattgtagggtattttagagcatttttaaaattatactttaagttctgggatacatgtgcagaacgtgcaggtttgttaaataggtatacatgtgccatggtgctttgctgtacctctcaacccatcatctaggttttaagccccacatgaattaggtatttgtcttaatgctatctctccccttgtccccccatcccccaatagaacccagtgtgtgatgttcccctccctgtgtccatgtgttcccattgttcaactccc

SEQ ID NO: 1667 - DNA, 637 bp, Homo sapiens
cgatgagttccaggcatcaagaaggaagaagtgggaagagtaaaatggatgtctcctagctgagcgccgctgggttagggtctccctgatcgagctggtcttggcaagtggtgcccatacatggggcttgaacccgggtcaaagggtcgccggagcaatggttggagaacgtggaactatgctggaggacacccgagtactcttaagcaatccctgtggtgagtaagaaggggagcttggaaacatcagggtaatagtgggacaagtgtgggctctggttggttccaccttggaaccttttcacactgatgatgaggaggaaggagagtataacgaagtaacagaagaggtgacagagcaggtttgtttgccagctaaagctaaagtggcaaaggagggagaggtttgtccctacccttctgcactctgtcattattttgaagaaaaagagtggctaaccctccagatctttcttttccagagaacactggctgaaaaatagcggccccagtgactgtttgggcagcgcctagagcgaccactctcaattctattcgggcaggaattcagcaagctagatgagagggtgatatagaggcatagcagttccctgttaggatacaccccccagatcaac

SEQ ID NO: 1668 - DNA, 650 bp, Homo sapiens
gggggcaaaagttgttttagttcagtttattttttaatatgtcctgagttctttctgttcataaaattatgatcttatgacagctgtaacttttaattaataatattaacaaatcattattgatataggcttttcaatttgctcaagattaggaattgtaagtggaatgaagcagcacttccagttgacaaatggatccaaaggtggaggcacctggaagatgacaaaagtagggaggaggaggacctggaggaggacgcttgtgtctcctaggggatgaggaaggtccacagaggagaaagagaatcagctacagccaccaaggcaggaaccaagaacctcttcagaagatgactggaataaagaagacaagtccgacatggaacatgtaagagaatcataaagctagaagaaaaataagagcggggaagacaggcaacttgaggcaataaaaagcgaaaggaagaaactggaaaacaagattttggccaatttacgatagttcctgaataccacgatcatggaaaccaatcagagctttcttagacgacaccaattttatgtactctaccccaattaccctgtaaaccactataagtgttcaaaattccaatattttgttttttaaaacaactccctgaacaagacag

SEQ ID NO: 1669 - DNA, 805 bp, Homo sapiens
ccatcctcttatgcaatagaacaccagcacttattcctctcgtctatagctttgcacccattgaccagtctctcaccactgccccctgccaatcctctggtaaccactgttctactctttctttctatgagagtgacatcttagattccaccagtgagtgagatcatatggtatttgtctttctgtgcctggaatctttcacttgatataatgtcttccaggttcatctacgttgctgcaaacaacagaatctcacttttttatggatgaatagtacttcattgtatgatttcatgaagattaattagatacgtccataaaaacaggacttggacttaaagtataataacaacaacaacaggacttggaacataatcttcagcatgatataatgacatgttataattacggaagtgttaaggtacggctgggctggctcgttgagtgactcctaatatgcagtttagcaagtgttagaaagacagggtttctcagttctacagaaagtggtcagaaggctgacacagtaaccttttgggtaagcttttgaacactggtgtacaacttctctgaaagcagggcgtttggtcctctgcctttcaggaatgttcattttctatgtcactacttggcagtcatcttctttatgcagctaaaccggggacggccaacatgctatgtatcagatggtaggaaagaagtattcggtctttgaccttgaggaatcctgtggcaggtgaagagagaaaaactggatggctctgaaagctcagttccatcttcttatagaagcttagcaagaatc

SEQ ID NO: 1670 - DNA, 853 bp, Homo sapiens
gtaaatagataaaattaacacctattttaatatatccaaaccccttccttatatatattaggtaaattaaaagaaaaaaattatcaaagcaatactacagccagctacatcgccaatttacaaatgagttagtaagtaccataagtttgtttgaatatcaggtgcttcagagtttttctcaaacagttacaaaagagattaggttcccaatcagttcacaaaagctaatttaaagaatgtagcttaactacagtactgaggttgtcacacacttaactttcggtctcttgcttatttattcatatctgaggttcactgtttctactaggatacattccgcccacacccacaccttggtccccacatcaagcagctcctcacagcaggaagacatccgctatcagacatggttttctgaagttgtgcttaggatttcagaggaggaaaaattcagaggttctaatagccttcggtaactgaggtagaatatggggctcccaagaatatcttccatatgccccaaatctgtttccctcccacccccatccagctctgttcaaggtcaagtttgagaaagatacgtgttctcaatggtatatttttaaaatccacatcaatttttaagagactacctgctaaaggagaataatggctcactgcatcttttctcaaccccctaaactattttaaaaacacactggcagggacaggtgcaatggctcacgcctgtaatcccagcactttgggaggccgaggcgggcagatcacttgagatcaggtgttcgagaccggcctggccaacatggtgaagccccatctctaccaaaaatacaaaaaattagctgggcgtggc

SEQ ID NO: 1671 - DNA, 798 bp, Homo sapiens
accccttccttatatatattaggtaaattaaaagaaaaaaattatcaaagcaatactacagccagctacatcgccaatttacaaatgagttagtaagtaccataagtttgtttgaatatcaggtgcttcagagtttttctcaaacagttacaaaagagattaggttcccaatcagttcacaaaagctaatttaaagaatgtagcttaactacagtactgaggttgtcacacacttaactttcggtctcttgcttatttattcatatctgaggttcactgtttctactaggatacattccgcccacacccacaccttggtccccacatcaagcagctcctcacagcaggaagacatccgctatcagacatggttttctgaagttgtgcttaggatttcagaggaggaaaaattcagaggttctaatagccttcggtaactgaggtagaatatggggctcccaagaatatcttccatatgccccaaatctgtttccctcccacccccatccagctctgttcaaggtcaagtttgagaaagatacgtgttctcaatggtatatttttaaaatccacatcaatttttaagagactacctgctaaaggagaataatggctcactgcatcttttctcaaccccctaaactattttaaaaacacactggcagggacaggtgcaatggctcacgcctgtaatcccagcactttgggaggccgaggcgggcagatcacttgaggtcaggagttcgagaccagcctggccagcatggtgaaaccccatctctactaaaaatacaaaaa

SEQ ID NO: 1672 - DNA, 311 bp, Homo sapiens
ctctgcttcatccaatagggggcgtgagatgagagttgaagccaagacagcttcggagaggcagatgagaagcaggagggcaggcagtcaggtgtttttccactggctgaattttcggaggggctaagtagctaagtgtctccagtttgaatggcctttaagtagtgttaacggaaatgagggtttgaggtcaggatcagcgatgggacaatgatgctgtagcttcaaatcattcaacgatgacgtggtcttgtacctgcatgacaagttcgcccttggcggacacgcagccatcagacttctcacctggc

SEQ ID NO: 1673 - DNA, 1268 bp, Homo sapiens
tgctgaaaaagcgctgtgtctttttaagaaaaagatcaaaaattgatttacagatgggaaagatgtctaattttgtagaagagttgaaagaaaagtaaatgtttctttgtaattacgtagctacttgtctcaacctgacatcttgctttcaaggattaagaactaaagtacgttcatttattcttttattcataacataccaactagaggctcagttgagtttaggcatcatacactgaattgcaatctcaaaacaacaacaacaaaggcagacacataaataaataatgcaatacctaaaagtatgtgctatgataaatgcaaaaaagattttatataccactgaggaggcaacaaaggcatcatcagggattagaggcaagacagcgattgaaaaagaacagatatttgctgagtgataaagggggacgacaaaggcctctcaagtagaggaaatcatttgaatgaaagatggatacttggaaaacagggcttggttgggaagaatgttcagaaaaggaggtggaagaaaaactgagttgagatcaataaaaacgaaaagttactcaaaggttttcaatacagcctttgtatttgtttgaacatctgtatctgctaggatgcttctggttgctcagacagaatccccaaaccaaactggcgcttcatctcgaatatctaggtacacagcatcaccatcgaggcttactttgtagttctctcagctctgtccacctccatgtataacttctcccttagaggcagaatttcctttagtagtttcagaacctgcatgcttatatcatctattctctattagaatcccccagacgacatcttacatttcgttggcctgatttagatcatctgtccacacttcagtgactgaccatggccagagacttgagatatgttgactagtgtaagtcaaccaagacctggaggttggattgtcccccaagatacaagtctgcatggttgaggagtaaatatttgaatgcaattcagatcccttttatcaagaggaaatgtaaatgaagagcaaaaagtagcaaatctccattactaatgaatagatgtattttctatcacaagtcattggctattctaaaaatccgcagagaaatgcaaatattgattaattaaagctactgccataaaccataagaacaaacaaaaacattgacaattcaattccctaagcattattaagtgactgctatgaagaaggcactgtgcaggtcactgatgaagagataaacagctgc

SEQ ID NO: 1674 - DNA, 239 bp, Homo sapiens
tgcttcatggtggagatgcttctggtttattttgtggctaccgctgttactgcttggagtgcctcaccgagccagctaacaacggcgtgcgtgagcgcagggaaaggcttcttgagaaatgaaaactaggttgtaggtttaggaggggaataggaaggttagctctgtccagccgaaagccttttggatgaagccccacccgcccttcaggatgccagccttggcaacattgtgagacc

SEQ ID NO: 1675 - DNA, 1731 bp, Homo sapiens
gatgttctagatagagggtcatgcagctgaagactcggggaggagctgatgttgtagtttgagggtcatgcagttgaggactttgggaggagctgatgttgttcgtgttgagggtctttcagctggggactcagggaggagctgataatcttgattaagggtcatggagctggagacccagacaggagctgatgttctagttagtggatcttccagctacagagtcagagaggagctgatgttctagattgagggtcatgcagctgaatactcggggaggagctgatgttgtagtttgagggtcatgcagttgaggacttcgggaggagctgatgttgttcacgttgagggtctttcagctggggactcagagaggagctgataatcttgattgagggtcatggagctggaaacctagacaggagttgatgttctagttagtggatcttccagctgcagacccagggaggagctgatgttctagtttgagggtcgtgcagctgaagacccggggaggagctgatgttctagattgagggtcgtggagctgcagacgcggagaggagctgatgttctagtttgagggtcttgcagctgcagacctggagaggagctgatgttctagattgagggtcgtgcagctgaagactcggggaggagctgatgttctagattaagggtcatgcagctgaagactcagggaggagctgaggttctagtttgagggtcgtgcagctgaagacttgggaggagctgagattctagtttgagggtcgtgcagcagaagactcagggaggagctgatgttctagattgagggccctacagctgcagacctgaagaggtgctgatgttcgagattgagggtcgtgcagctgaatactcggagaggagctgatgttatagtttgagggccctacagctgaagacccggagagtatctgatcttcgagattgagggtcatgcagctgaagactccgggaggagctgagttgctaatttgagggtcttgcagctgctgacttggggaggagctgatgttctagtttgagggccctacagttggaaatctgtacaggagctgatgttctagtttgagggtcatgcaggtgaaaaatcggggaggagctgatattctagtttgagggccctgcagctagagatgcagacaggagctgatgttgtagtttgagggtcgtacagctgaagattcagggaggagctgctcgtgtatttttagggtcatgcagctgcagacccggagaggagctgatgttaaagattgagggtcatgcagctgaagactctgggaggagctgacgttctaatttgaggtccctacaggtggacaccgagagaggagcttatgttctagattgagggtcatgcagcagaagactcggggaagagctgaggttgtagtttgagggtcgtgcagctggagaaccagacaggagctgatgttgtagattgagcgtcgtgcagctgaagactcagggaggagctgatgttgttcgttttgagggtgtttcagctggagactcagggaggagctgacgttctagattgagggtcttgcagctgcagacctgtagaggaactgatgttctagattgagggtcacgcagctgaagacttggggagaagctgatgttctaacttgagggtcgtgcagctgaggactcggggaggagctgatgttgacagctgtgcagctggagatccggcgg

SEQ ID NO: 1676 - DNA, 250 bp, Homo sapiens
ctccgcctcccaaagtgctgggattacaggcatgagccaccgcgcccggccttcctggtagtttccattccatctccctgtatttttctcttatcactctcgaagtctatctttcttgttcttttcctccctagctttttttttttaaacactcctttcaagctgtgtccaacacccacaaggaatgactatttttaactaatcttactgacctcatttaatctattcaataaaacctctgccctaagga

SEQ ID NO: 1677 - DNA, 4848 bp, Homo sapiens
ggcaaaacaatttactactaaaattcagattctctctcagtataacgcaaagtattactctgaacacctacttcaggcatcactcagtaagtcaaccactaaaagcctctctgctcagattttcctggtgcatcttttatttctcttctctttcatgtagaagtctatgaataatgcccacctaatgcaaaggagtttctcatatctctgacgcagcaacaatttatcacatgctttcacataaatgagaatgttgaaatagtataattttagagttgaattatttgcttttgaaaaaaatttttacttttttcaagtgaaaaaatatatttcgaatatatctcttcaaaaacctacttttcaacttatatacaaggaaattttctaacaggttcaacttttgttatacttaatactctgatttattttaaagtctgaagtgttagttccttagttctttctactgtaaatcctctgatgtttacatagtcttaattttagcctaaatatttcttcacatttactgcacctacaaattatattctagtaaaaattctctggtgtttcttttctttttatcttgttttgagacagagtttcactcttgttacccaggctggagtgcaatggcacgatctcagctcaccgcaacctccacctcctgggttcaagccattctcctgtctcagcctcctgagtagctgggattacagccatgcaccaccatgtcctgctaatttttgtatttttagtacagacgaggtttctccatattggtcaggctgtccttgaactcccgacctcaggtgatccaccctccttggcctcccaaagtgttgggattacaggcgtgagccaccgcgcctggcctctggtttcttaacctgcagtttctgaacagaggtttttccacatttattacatttgtaggatttctctccaatataaattctctgatgttgaacaaagtttaagcaactgcttcagagttttcctctagtacaaaatgcatatagtaagttctgggatacaagtacaggtactagagccctctttatctttgtattctctgtcttaagactattcttcactttaatggcctatattttctaaaaggtctttcaacagaaattacatttataatgcttttattaactataaatttcaagtagacaatagcttttgtatatttttatgtttgtacaagtagtctcacatataaatactatcatgtgcaaaaatgctaagcattggttacaagttttgccacattttttgtatttccaggtgttttcttcagtaggaattacattaagaactgactagaattggaagtctttgccacatttttaattttaatttggcttctcatcaatataattactcttatgtctacaacagattgaggtgtgattaaaagccttctcacatttttcacattttagagtttctcttcattatgaattatcttatgattagaaaggattgaggagcatttaaagaccgcgacattcgtcaccttcgtaagacattcccctggtatgagttctcttatgtttaagaatgctgtagtatgacttaaaggctttgccacattctttacacttgtatggttttatctccagtatgaattttcttatgtgcataaagatttgcagactgtctaaaggttttgccacagtctccacacgtgtagggtttctctccagtatgaattttcttatgcgcataaagatttgcagactgtctaaaggttttgccacattctccacatgtgtagggtttctctccagtatgaattctcctatgtacataaaggattgctgactgtctaaaggctttgccacattcttcacatgtgtagggtttctctccagtatgaattctcctatgtttagtaagggttgtggaactagtaaacgctttaccacattctaaacatttaaagggtttctcacctgtatgaatcctcttatgtttagcaaagcttgaggatgacgtaatgactttgccacattccttacatttgtagggtttctttccagtatgaattttctcatgtctattcaggtgtgaggactgtttaaacactttcccacattctttacatttgtagagtttatctccagtatgaattttcttatattcgttcaggtttgtggaccatccaaaggatctgccacgatcttcacatttgtagggtttctccctagtgtgaactctcctatgtgtagtaaggtttcttgacctactaaaggctttgccacactcttcacatttgtaaggtttttctccagtatgaattttcttgtgttgattcagggctatggaccatccaaaggctttgccacactcttcacatttgtaactttgctctccagtaagaattttcgtgtgttgattcaggtctgttgatggggcaaaggctttgccacactcttcacatttgtaaggtttctccccagtgtaaattttcttctgttgattcaggtccgtgtaccatacaaagtctttgccacactcttcacatttgtaaagtttctctccagtatgaattttcttgtgttgattcaggtctgtgtaccgtccaaaggctttgccacactcttcacatttgtaaggtttctctccagtatgaattctcctatgtacataaaggtttgcggactgtctaaaggctttgccacatacttcacatgtgtagggtttctctccagtatgaattctcctatgtttagtaagggttgtggaactagtaaacgctttaccacattctaaacattcaaagggtttctcgccagtatgaatcctcttatgtttagcaaagcttgaggatgaggtaatgactttgccacattgcttacatttgtagggtttctttccagtatgaattttctcatgtttattcaggtgcaaggaatgtataaaggctttcccacattctttacatttgtagggtttatctccagtatgaattttcttatattcattcaggtttgtggacaatccaaaggctctgccacgatcttcacatgtgtagggtttctctctggtgtgaattctcttatgtgcagtaaggtttgttgaactattaaaggctttgccacactcttcacatttgtaaggtttctctccagtatgaattttcttgtgttgattcagggctgtgtaccgtccaaaggctttgccacagtcttcgcatttgtaaggtttctctccagtatgaattctcctatgtacgtaaaggtttgcggactgtctaaaggttttgccacattctccacatgtgtagggtttctctccagtatgaattctcctatgtacataaaggtttgcggactgtctaaaggctttgccacatacttcacatgtgtagggtttctctccagtatgaattctcctatgtttagtaagggttgtggaaatattaaaggctttaccacattctaaacatttaaagggtttctcgccagtatgaatcctcttatgtttagcaaagcttgaggatgaggaaatgactttgccacattccttacatttgtagggtttctctccagtatgaattttctcatgtttattcaggtgtgaggaatgcataaaggctttcccacattctttacatttgtagggtttatctccagtatgaattttcttatattcattcaggtttgtggaccatccaaaggctctgtcacgatcttcacctgtgtaagctttctctctgttgtgaattctcttatgtgcagtaaggtttgttgacctattaaaggctttgccacattcttcacatttgtaaggtttctctccagtatgaattttcttgtgttgattcaggtctgtgtaccatccaaagtctttgccacgttcttcacaagtgtagggtttctctccagcatgaattcctttatgttgagttaggtctgagaacttctgaaatgacttgccacattcgttacatttaaagtgtttctctccagtatgtcttgtcttatctttgtttgaatttgcaaatttactaaaaactttgacacgtgcattacattgaaatattttgctctgagtatttgacaagcatttattaattccattataaactcccttctgcactttacacacgttcatacttttacagcctttccttaattgtaaattatcatgcccacatttctcatatcttctcagtataagtttgtggaatgaatcttctatcccctgcactggcaaaaagtcttgggtgaaatgagaacacatagctgaaagaaacaaaaataacaaattatcccagttactagattcatatgcatatactttacaaatcataagattatacaaagtacgctagtaagatcacataacaaaataccacaagtcataacttcttcacatatacatgtaacaaacatatggtgatcaaaatgcctttgtgtgaaatctataaatgagttaattgtatgcaatccctcaggtaagcacaatgccaagagccacatagaacaggaaggaatgtttgttcaatttacccaccaacagctcttcctccccaatatagcactatgccattagaagaaagctctcaactcctttttccttaaaagagaagaaaaatactgacacacatatccttatttctggcttttggggtctttacaaaaactgatttctgcctccaataaaacagtgctgaaagaaatggtgatactttggaagaacaacttgggtattcgaagacaaaatataaatatttcaaaagcagactgaagtgctgaatacaggcaacaggtacagcaagtgatgagagactttttttttttttttttttttttgagatggagtctcactctgtcgccc

SEQ ID NO: 1678 - DNA, 257 bp, Homo sapiens
ggagcagttacctctgggcccctgcaggtaagggagctgcggtgttcacacacaactcccatggtcatggctcagggttccccagaggctgtggactccttgccgccctgaacctactcacctacaatcacgacgggctcctggggcaggacaaagccacaggaaaaaggggaagcctctcagcagatccttgaaaggaagtgactttgtgactaagtggaggcaggaacatcatggcacaagggcacacgtcgcac

SEQ ID NO: 1679 - DNA, 527 bp, Homo sapiens
gccagggaagccagcactggccgtcagctcacacacagcctctgagatggagtctcgctctgtcacccaggctggagtgcagtggcgtgatctcggctcactggaagctccgcctcccaggttcacgccattctcctgcctcagcctcctgagtagctgggaatacaggcgcccaccaccacacccgcatcttgaacatatggaacatggtcacagcataagcatgtgtgtgctgtcctctacttgccctgtcacctccagcatcttgaacatatggaacatggtcacagcataagcatgtgtgtgctgtcctctacttgccctgtcacctccagcatcttgaacatatggaacatggtcacagcataagcatgtgtgtgctgtcctctacttgccctgtcacctccagcatcttgaacatatggaacatggtcacagcataagcatgtgtgtgctctcctctacttgccctgtcacctttgtcatttccaggtcagttactacaacctccacctcccggattcaag

SEQ ID NO: 1680 - DNA, 403 bp, Homo sapiens
agtcagaccagctgcccccgggccaccgagctcgggcaaggccttccctgctcctgggcgtggaagatggtggtggtgggtcagagggtctcttactgcacagtggcagctgtggctgactgtcccagccagaaagctctagggccaagcgttccaacagctcggacccccgagggagagcacctgcaggaagaagacgccagcccctgcagaggaaggacagagacaggtcagtctggcccgagggcgggctggggaccctgaagaggaggaacacaggaaaccgcagcaaactccaccaagagccgacaatgacaccctgcctggccccacgaagtcagatgcccagagccgacaccccgcctggccccgtgaatccgggtgcccagagccgacaccccac

SEQ ID NO: 1681 - DNA, 245 bp, Homo sapiens
ggatgggctgacggggatgttcacgcctgagggctccgcaccgtgggcacccaggttctacaggaaggaccccgttctccagtgcctcctcccattcttgtcatcaggacctcgtgagggaacgcacagccacgtgaggcaggggaggtgacagcaagtccccccccattccctgagccagtggctgggagacacagccaagccccacccacagtgacctccccacccccagcacactccgagcc

SEQ ID NO: 1682 - DNA, 426 bp, Homo sapiens
gactgaactccgccgcattgggtcttaccccggactccgagccggaccccgcgcccgcaccttcagccgggcagcgagggggggctcgagcgcgccggttctcggccgagacgctgtggctgacaccggtggagcgatctgccctggctcgcgcggcgagcaagtgctggaggcagggttccaagccggttctgtcgggttccctcaagaccccgagagcacgcgctccggagggaccccggcacttcggaccctagcagagccagccctgccccaggaccgccccggggtcggtgcccgggctctctgagtctcgcttctggcccgcgaagacgcgccctctcctccagtcgcgggagtcccgcacccgagggccgcgtccccgggcaggaggaaaggctatatgaggacacagggagaagagag

SEQ ID NO: 1683 - DNA, 2257 bp, Homo sapiens
atttttccaggtagcccagagaacttttgagcgtctgaagggcatggtccagaatgtttttaaaaactgaatttccagcactggaaatcacttctgaagccattttcatgttagaaaagggtcaggacaccacccccccaccacatcccacccgtctggggctccaggggcatctgaggggtaattagtgacttctttgatgatcacctaccgcctgccagcaccttactgagcactcaggattcatcatctcgtgggacgctcagccaaccgcgtggggtgagctgtgccgtttgctgcatctgcagagaggagactggtcccaataggctggacactgccgcaggcagacagcaggaggtggccgagcgggaccagaagccatgggacctccctggtgcctgagtgccccagcacagggctgagacgcaataggtcacagaagttgttcaaggtcaagggtatgttcaaggtttacagaaaaaaacacatttgacttcggtgtcatatatgacgggttctcatgcaggagagctttgtgatgtcacgatgtcaccatgtcagacacgacaggttctcgtgcaggagagctctgcgatgcctgtggccatgatgtcaccatgtcagacacaacgggttctcgtgcaggagagctttgcgatgccacgatgtcaccatgtcagacacgacgggttctcatgcaggagagctttgcgatgccacaatgtcaccatgtggtttgcattttcatatccacctgttggaaaggtcctcattcgccaactgtgggagctggcacactttactggcagtgttgacaaaaagccaagctctgtgaaatatttgaagaggtttattctgagccaaatgtgaagactatgacctgtgacacagccctgggaggtcctgagaatagctgcctaagattgctgggttacagcctgattttatacattttaaggggacagaagttagaggcagagaggtcagtcagtacatggagagtgcacattggttcagcccagaaaggtctgaaaacaggcttctaggtataggtgtgttacaggaaaagggaccccatctggaccccaagagagggttcttggatctcatgcaagaaagaattcagggtgaatccatagagtaaagtgaaagcaagtttattaagaaagtaaaggaatagaagaatggctactccatacagcagccccaagggctgctggttgcccatttttatggttatttcttggtgatataataatcaaagggtggattcgtgcctccctgttttagaccttgtagggtaacttcctgacgttgccatggcatttgtaaactgtcatggcgctggtgggagtgtagcagtgaggacaacgagaggttactctcatggccatcttggttttggtgggttttagccgacttccttactgccacccattttatcagcaaggtctttatgacctgcatcctgtgccgacctcatctcatcctgtgacttaatgccttaagtgtctgggaatgcagcccagtaggtctcagcctcattttacccagctcctattcaagatggagttgctctggttcacatgcctctgacattgctcccctcccttttataagacaacctttaatcctaagggttgcagagggatgaagatccatcttctgtaacttcttcagggtgaatagggtccatgatactcctgcctattaaggtctcttctgttcagggtagagaagagctcagccagaaagccttggaatggtgagagccattcataactcttgagttctcacaaaaggtgatatatgaaagattattaagtgtttaagaaaacattcagtaagcttgtcctatattcctacacaaagagtacaacagcaatataacagaataagcaaagctatcccaagtgaactaaattagaaggctttccatgaactgggcatgttggaactaagctgacatggggctgttagctgattctaatgtgcccagaattagaatactgatccagatgtttacattatccatccctcttgtttcttctgagcagcagccagagatcactggttggttcacaggaataagcagggttagcctaaattgcagaaacaaacttaaaaacaacaatgaaactagaatttaagaagtgtaccatagttcttgaaacataatttctctctctagtttcccattttccatttttactaaaaacaaatcttggtaagactgattttattatacttggcc

SEQ ID NO: 1684 - DNA, 1440 bp, Homo sapiens
ctcgagctaaagttgtcatcattgctcttcatagtctgaaggtgcatgaaatggtcaactttcttccaaagggcttttatgcctaagtctgtggttagtgtataaacagatatttactgaagtcctgctgggtgcagacactgtggccagccctgaggctacagtcgagatgaagccagtctctgtcctcatggagacctgtctattgataagaaaacagaaagctcactgagcattgaccctgtgcccactgcttttgatgcatctctcatttcatccttctatcaaatctgtgaaataaacacatcaccatcatccctatttcacatttagggaaacatgcttagagagggtaagtaacttgttcaaggtcacacagcttcaaactctcatcccacaggcgcaggaatgggaggcagcagctgtggaagccagggtctctggcagtccttgtctctgggcggtgatccagaaagagagagaacacgattgtctcagcactgggtcttcttctgagtcatcttgaaggagcaattccagagcgtctcggtgttaaacatcatgttgtgaatgactcagtgatctctgacccagagaccttggggataaaggaggggaggtacggagaagctcttcgaatggatgttaccggcgtgtcagtgttctttgaggccacaggctatgtgtcaccaaattgaaggggtggcctgcccctccacacctgtgggtatttctagtcgggtgggatgagagacagagaaaagaaataagacacagagacaaagtacagggaaacaacagtgggtccaggggactggcactcagcacaccaggacctgcacgagcactggcctctgagttccctcagtttttattgattatgattttcattatttcagcaaaaaggaatgtaataggagagcagggtgataataagcagaatgtcaacaaaaaacatgtgagcaaaataatctatatcataattaagttcaagggaaggtatatgactggacttgcatgtagtcgacatttatgtttctctccacccaaacatctcagtggagtaaagaataacatggcagcattactgcaacatgtctcgcctcccgccacagggcagcttttatcctagctcagacttgaacaaatgtacaatcgggtttacaccgagacattcaattcccaggggcaagcaggagacagtggccttcctccatctcaactgcaagaggctttcctcttttactaatccgcctcagcacagaccctttacgggtgtcaggctgggggacagtcaggtctttctcatcccacgaggccatatttcagattatcacatggggagaaaccttggacaataccctgctttcaagggcagaggtccctgcggctttccacagtgtattgtgcccctggtttattgagactagagaatggcaa

SEQ ID NO: 1685 - DNA, 1520 bp, Homo sapiens
gtccgggtttggggcccgggaggcggggccagttaggtcgagggtccctgggatcgtcgggtcaggccttgggctaacgtaggcactctcgcagttcctccgccttcaggaaggtctttttagcaggggccttacgggtgcatgcttcggtcctggaggacttaggctagcctcctctccatcagcgccacccgtctggggcccgaaaggagggagctttccctctgtcccccagcctttggactgtcaccaaacaagccattcgttcaccaaatactttttaagcgcctaccatgtgcctgacaagggatatgtaacggtgagaaaaactaggtgtggtccaggcccttcagggactcaggggctcgtggaagaagtggatattgaagtacttatcacacaaaggaggataaaagtacgatagcgatatctaccacgaagctgttgttccacaccagaaccaaatgagcgcaagatctgacaaaaaaaaaagtccctgtatcctgagatggagtcacctgagaatccacagcaagtcctaaccagggatgggtctgggtgattaaggaagattggcttcagaactgggccaggggcactgctttgcttttgctgttttgatcagctctctgcctgcaggagacgaggaaaaccaatgggaacaggcgcaggaatgggaggcagcagctgtggaagccagggtctctggcagtccttgtctctgggcggtgatccagaaagagagagaacacgattgtctcagcactgggtcttcttctgagtcatcttgaaggagcaattccagagcgtctcggtgttaaacatcatgttgtgaatgactcagtgatctctgacccagagaccttggggataaaggaggggaggtacggagaagctcttcgaatggatgttaccggcgtgtcagtgttctttgaggccacaggctatgtgtcaccaaattgaaggggtggcctgcccctccacacctgtgggtatttctagtcgggtgggatgagagacagagaaaagaaataagacacagagacaaagtacagggaaacaacagtgggtccaggggactggcactcagcacaccaggacctgcacgagcactggcctctgagttccctcagtttttattgattatgattttcattatttcagcaaaaaggaatgtaataggagagcagggtgataataagcagaatgtcaacaaaaaacatgtgagcaaaataatctatatcataattaagttcaagggaaggtatatgactggacttgcatgtagtcgacatttatgtttctctccacccaaacatctcagtggagtaaagaataacatggcagcattactgcaacatgtctcgcctcccgccacagggcagcttttatcctagctcagacttgaacaaatgtacaatcgggtttacaccgagacattcaattcccaggggcaagcaggagacagtggccttcctccatctcaactgcaagaggctttcctcttttactaatccgcc

SEQ ID NO: 1686 - DNA, 748 bp, Homo sapiens
gttttactgaaacacagagatgggaatctgaccctctgagcagcctcaggattttctaagtcttccaagcagagtggaaatactggtgaggacccattgaacccctgatggtctggaatcacataggatgatgctttcaaacaactctaggtggagatacattttctgagatattccaaggaggagggacacaactggaccagatgttagaaggagagctgagcattaagtgcctatgtagtgtttgcagcttggtgtcccatgcagaaggggaatctgggccctggtgttagaattcagtgtaattctgggttcctgctttccttccaggaaatcccacttccaactggatgtctggatgaactactgaaagctgctgagtgtcctgcagcaggtgagctgtggccagagcccaaggatgaagggggctccctcactctgtgactgtgaagaggaagcctgaggtgtagcaggccctggccccagaagtatggaaaaaatgagcttgactaccacacaaatgaatccattcaaatgttggcaagtggagcagagtcccaggacaggtgctggagcagccccgctggaagcgatgcagcatccaggaagacggaggaaggggcagagagggacctctactttccaggcggccttttatactgcctctggtcacctgacgtggaacgtaccctaacctaatcagttacatgaggcgcttggaaaccaccgtgaattggaccgcactggg

SEQ ID NO: 1687 - DNA, 1904 bp, Homo sapiens
gcctcccgcggcgggccgggtctccagggaggacctgagttttcttcacccatggtcagggaggcgccatcgccctggctttggggctggggcctccggggaggttccggtaggggcgttggagaggccgccctttttgcaaggcccgagacggcgggacctgcacaagccgccctattccatgccctcagggcgtcagtatccgcctcaggccagataacccctctgggccccgggtgcccccgctgggcccggagcatcctcggcgctgccctcccagagccccgcagaggctgaggtggcacgggttggagggcctggctctgcgagaagcggcggcagcgagggctggaggacccgggctacgtggctctggggcgtctggcctgggtgggactgagcccatccagggactgggactccggggttctggtgtaggtggatccggggcaggctcaggaccaagtccctctccttccaccaaggagcacccagaggccggcgggagctccaggttcacctcctcttcctccaggaaatcccacttccaactggatgtctggatgaactactgaaagctgctgagtgtcctgcagcaggtgagctgtggccagagcccaaggatgaagggggctccctcactctgtgactgtgaagaggaagcctgaggtgtagcaggccctggccccagaagtatggaaaaaatgaggtagggagggaggggacctcaggagaagactgaggtctacagaatcccaggatcaaggggatggtacggtgtcctggcactgtccttgatgttccaagaggggtgagaatccatctcctgagtaaaaacttcacatagggtgaggagtggaggccaagacagcgatcagccttacagcaattttaaccagaaatggacacagaccctggaccccatcacaggagtgcaggcctaggactgtctccagccttgcaccaaagggatgaagctgacttgatcttggaggataagctttttgatatgttgctggatttggtttgccactattatatcgagaaattttgcatcaaagtttatcagaaatactaaagtctagtaaatacattgaaaacaataacagactgattaaaagactaaataatatgaatcctaagtgttctcacaactgctttatagagtaaaagaattgtcaaaacaaatgaacttggccagaaactgtatagagtctgagatgttgtctgaacttccagttactcattgtgaggtggaactgcagtaacaatatttggtgtaaaatttcatgtgatggaagctgagatgtcctgcagtctcagagggacagaattctggtgaatctccctttggcctataaggaatgaagatttaggctctgacggttcagtcaaaatttataagatgtaagaaatggggacgtcgtgaggccatgaggcaaggcctacaggtgtaaagacataacttctaacccagggctcatgaagtcatcataatgtcagaggcgatggtggattgagcatagtatggtctttggaaccattccttccacttatttcttcacaggccaggtatgtgcaacaagggggcatcttgggcctgatgagcagagtcctgaagagacaaaggggcaatcctgaggaagagatttgacagggaggaagaagccaccaatatcactactgataaaactcctcgtccctagtaaaccataggattttccttggtctcactgagagtttacctgagtgaacagaaagagagacaaacggactgatgggttaactgtttccactacctgaagtgattctgaaacgttggggtcaggagaattatcttaagaatcaagagcaacccagataccagggttacacaaaagagactggaagttcttatctttggg

SEQ ID NO: 1688 - DNA, 251 bp, Homo sapiens
gggaggcggagcttagggaggcgccggtgtcgggaggaacccagggactgggagtccctgtatcctgagatggagtcacctgagaatccacagcaagtcctaaccagggatgggtctgcgtggttaaggaaggttggcttcagaactgggccaggggcactgctttgcttttgctgttttgatcagctctctgcctgtaggagacaaggaaaaccaatgggaacaggttagttacactcataaatcctggg

SEQ ID NO: 1689 - DNA, 1306 bp, Homo sapiens
cccaggagtggcaattgctaatcttagtgcttcctcatcttcctgtgattgtttgtccagctccaacatctttataagcatatgctatattaaatttcctctattaaattatgaggtgtgggttttgttttcctgggtggactctgattgacatacatagtttataagaaattagacaatatgtgcaagatgaaggactttgggtgtctgggagcctcgtgtgttgtggctaggtatgcaaattcagctgcggttcaaactccagctacttaataagggggtgaccttgggcaagtgacttaatctcttggtgtttcagtctccccatcggcaagattggtataacaatagtaactaactagtggggtaactagcagaaacaagcacatttatttgaggtatttacctaggttctggcttatggaaagtgctctatacatgtttaatatgattggactattaccaagaggggggcaggggtttcacagaagacactttaaaacttggcacgacctacttgttaaaattgtatagatattccccgccgtgtgtgtgtgtttgtgtgtgtgtgtgtgtgtgtatgtatgtacaagagagagcaagctggctttggaatcagcaaacctgaggctcagcctcacctgtggggcacccacctaacctctctggaccaagtttccatttttagaaaggaccgtttttagccctaatgttctttattctactgacctgctgccagggaattgtctacctctgatactcttctttcctagagtccaccttacccaaaggatagaacttcctccatggaactgcccacttctccagctgccagagtagtaccttcctggtgttgtccagggcgggggcaggcaagtggccttagggatgcacaggccaatttctcacatagtctaataacctggcccatcctgaagctctccccaccaattaccacctgttccctaagaaaacatcagtagcttccacctgcccaatcatatctcacctgggcggacacacccccatcaggggagtgaagggcttaagagatggagcacgtggaggaagagggtcaatactgaggagctttctgctttctgaatgaaaggaacaatatatcacccagaacatcatcatctcttcaattattatactgccgggacttttgttcctattaaaatctatcagaacagccagatgtggtggctcatgcctgtaatcccagcactttgggaggccgaggctgggctggtggatcacttcgggccaggagttagagaccagcctggccaacatggtgaaa

SEQ ID NO: 1690 - DNA, 6908 bp, Homo sapiens
attttattttatatataatgtatatttgatttaatatgcattaaatagaagctatattatagcttaatttaagctatatatattatatatataaatacttatatatatatagctcaatatttaagggtttattttccctttatctttccagctgggaggagggaaatagtctagtgaaggtaggggtgcattcatttttcctagctttggaactgctattaagctgttgagcttgtttgaccagaaaattctttctggcctggttttatgccctggaagtttgtatagcatatgcctaaacacctgcatccctcatgtcaagagcgtgttgtctgcatgaataaaattcactctctaataatcttttcagtttgtactcattctactcagctaaaggctgaattgattttctctgaccagaagaattttttttttttttttgagatagagtctcgctttctcacccaggctggagtgcagccccaccatctcggctcactgcaacctccatctcttgagtttaagcttttgcctcagtctcccgcatagctggattacaggtgcatgctaccacgcctggctaattttttttttttttgtatttttagtagagacagattttcaccatttggccaggctgcttgaacccctgacctcaggtgatctgcccagttcaacctcccaaagtgctgggcttacaggcatggaccattgcacttgcctggccaccagaataaatgaaagtgttggtgggccctacctggatccattgaggaatagaagaattgtttccctgtagaatatttttctagagacacatgtaaataaatgcatggaacatttcttaccacatacacttatgagaacatgcaggtcacatttaatggtactacctggacaacatgaagggattttgagattattttagggttagtgtatactcatgtcttagttatctattaccacataataaattacctcaaaatttagtggcttaaaacaacaataggcatttagtatctcacagctcttctgtgggtcaggaattcaggagcttaattgtgttcttctggacaggggtctctcatgaggttgcatccatgtaaaggctttagagagtctgcattcatgatcaaggtagttcatttatatggccagttggtgctggctgttggcaggaggccttagtttttctccatgtaaactgctccataaggctgcttgaatgtcctcatgcatggtggcccacagagactgaaccaagagaacaaacaaggcagaagctaaaatttctttgataacccagcctctgatgacacatggtgccatttctacaatgtcctattggttaacacatatcagccctattgaatgtggtagtaggctgtccaagggcatgggtgtaggaggctggctcatgttgggagcatgattgcaacagtataccataatgaatacactggattatgggagaaatatcaattactccctcatgttccaacttggtggagtggctgctgatccaacagtactcaagattagactgatgaaaccagggtctcagaatatgaacagggcctttttctctctacatacctttgaacggcctacttatgcattctttgcctgacatctattaaaactaagaatgatattacttctattaaaaggaagatttttctgatatccccaagtcagggtgcaactcctctgtttttgcatagtactctttacatagtgcttcttataacttgcacttaacacattgcattgtgattactttaccctctatcaagctgcctgctgtgctggaagccattggcttggattaaaggtgacagtattattgaagattttgctgaattaatcagctttgattttgcgtgtccatttctgccccatctatttaatgaataattgatctgtcaaacagaatactagctttttattaaatagccgtatcatattagatgccaatgtagagtatgccaatgtggcttaattgttttcatcaaatgcattccatctctttaattaaattaagtatccactccagacaactgaaaaagccagacttctcctttaaaattccatgattcaatgacttgagggttcagccccagtcagtgcaatttcttttgagatggattcttgctatgttacccagactagtttcaaacttctgggctcaagtgatttccaagcctcagcctcctgagtatattggactacaggcatgtgccactgagtgtgacgttattaacatgccagttttctatacaaaaactttgtttcttttcactttggtggcatactgtggaatgcaacccagctccatttgttcaatgcacataatatttcagtgatgctgtattctgacaaccaatttcagcctaaaatgaaataaaacagaaaaacctcctttttttaaaaaaaatcaatctttttttctacaacataaataaaatgaaagtcaaacattcaattctaactctgagttgacaggcgtatatcccacactttgaggcattgttattaaaaagacaattatgtcttcactctaatggattattggctgttctaaagtttgtctcgtaactaagaaaaagttaaatcattgagaaaagggaaaacatgcagtttctctaagtttatcttactgagaatgcaaacagtgatcctgatctttatcctaacatgtaatgcttggaggcattggattcttccatagttggtcttgtacctttccgtctctctaactatacctgccggcttgagttggtcctacaaaaacctagtgacattgaagaatgttatcccccacccctccaaaaaatgtatggtacatctgtatagctgttcatgggattacagaatgaagagttaaagcacctcttgccatgatgaaaggaaaaaaacaaaaacaaaaacaaacaaacaaacaaacaaaaaaaccttaaaccaggtgaagagatagagtggatattggtggctatatatttgtcttcatcaatgttaacaaaccaagattcgacactgttaattccttaattgctcactgatatgatttggctgtgtccccacccaaatctcatactgaattgtaatctccataatccccatgtatctagggagagacttgatgggaggtgattggatcatggaggtggcttcccccatgctgttcttgagatggtgagtgagttctcataagatctgatggttttataaggggctcttctcccttcactcctcttcttctctctctcacctgctgtcatctaatataaagacacatgcacacataatgtttattgcagcactgttcacaatagcaaagtcttggaaccaacccaaatgcccatcaatggtagactggataaagaaaatgtgacacatatacaccatggaatactatgcagccataaaaaaggatgagttcatgtcctttgtagggacatggaagaagctggaaactatcattctcagcaaactaacaaaagaacagaaaaccaaacaccacatgttctcactcataagtgggaggtgaacaatgagaacacatggacacagggaggagaacatcacacactggggcctgtcagggggtgggggtctaggggagggatagcattaggagaaatatctaatgtagatgatgagttgatgggtgcagcaaatcaccgtggcacatatatacctatgtagcaaacctgcacgttctgcacatgtactccagagcttaaagtataattaaaaaaaaaaagatgtgcctcttcccttttcaccatgtttgtaagtttcctgaggcctccccacccatgcagaaaagtgagtcaattaaacctctttcttttataaattacccagtctcgggtttttctttgtagcaacatacccgagactggataatttataaagaaaaagagatttaatagacttatagttgcatgtgtctggggaggcctcatgatcatggccgaaggtgaaaagcacgtcttacatcgcggcagacaagagagaaaagagaaccaagtgaaagtggtttccccttataaaaccatcaggtcttctgagacttattcactaccacaaaaacagtatgggggaaacgacccccatgatgcaattatctcccaccaggtccctcccacaacatgtgagaattatgggagctacaattcaagatgagatttgagtggggacacagccaaaccatatcaatgaacaatattttatcaaaggtattgtaggtgggacgacttcacattcaccaccaccacccccatgatgtttcacttgacaaaaccccttgaaacacttattttcttctcaatctccacaggcttcagatagaaagtaacccatcctccactggctctccatctcctcggaggatggtttccgcttccaaatcttctgcctggaactcagttcctctccatttcttctttacaaatatcttggtcctttcctcgcttttagctccacacctggtacctgcagtgactgtttagtatgatcctaagtaaggttttactgagggggaagacgcatttgtactaagcaaacaaaagaccttcccctgctcaggccccattattctaacggagtaattcagggttataaatagcatcaataacaaaagcttctttcttcttcttccctggctcaaagccaggtggaggcaagctttgtttttgttcttttttgtttttattttttcctctccaggaaaggtagatggagatagggaggggggtttcaaaacagtgcacacacaatttgatttgactatgactttagcaacatgccaagttaagaaagacaatatctttattccaggttatggagatcaactcctaaaagcaacagcagaaataaaaatgcagtgttaacagattttaccatttacagagtcaatagacttcttgtaacatatatataaatgtgtttattcgtatgttacaagaagcattaataaaaattgcctttgaagcccaattatggtgtactgaaatatttgcccattagaattcatccaaacagttgaaaatttttattgtagatggtaaaatataaatattagttgaattagtataattataagccaatttgccttaagacaaaagtagcctatgtctgtttggaattctatgagatacagaccattgtgttaaacaagaaacagagaatgaaagctgaacaattaagagagttgggccatgatacaaggcgttggttgcgctaaggacaaactaagtgtcttctaatgcaaatttggggatttattgaagtaacaatcctcaacactttctctgtgcttcaacacaagttgctctggaaagcaggagatttcaagtggcccctgaagctgctctgtttaatttctcacatgctcctggggattctcagttttccactacctaggataggattgaggctgaacagagaagtcagcacacggtagattgtcaataaatattttttcagggactagatggtactatttaggtttgtgcaaaagtaattgcaattctctaatgaccagtgatgatgagcttttttttcatatgtttattgcttgcataaactatagtgagataccgtatcatgccaattagaagggctgtcattaaaaagtcaggaaactggatgctggagaagaagaggagaaataggaatgctcttacactgttggtaggagtgtaaattagttcaagcgttgtggaagacagtgtggcattcctcaaggatctggaaccagaaatactatttgacccagcaatcccattactgggtgtatacccaaaggattataaatcattctactataaagacacatgcatactcatgtttactgtagcactattcatagtagcaaagacttggaacccacccaaatgcccatcaatgatagactggataaagaaaatgtggcacatatataccgtggaatactatttagccataaaaaagaatgagttcatgtcctgtgcagggacatggacggagctggaaaccatcattctcagcaaactatcacaggaacagaaaaccaaacatctcatgttctcactcattagtgggagttgaacagtgagaacacatggacacagggaggggaacatcacacactggggcctgtcagagggttggggtgcaagggtagggatagcattaggacaaatagctaatgtatgtgggacttaaaacctagatgacaggttgatgggtgcagtaaatcaccatggcacatgtatacctatgtaacaaacctgcacattctgcacacgtatcccagaacttaaagtataaaaagtataataaatttttttaaaaaaagtaattgtggtttttgccattacttttcatgaccaaaaccacagttacttttgcaccaacataatattccaaatggaatgtgccaaatgttgattctaaatattaatattccaaattgaaggaaaccctgagacagtatacttccattgtgccacatttaacacatggattaagaaatgtggtttgttcttatgtgcagaagttttaaattttcatgtagacgcttccatcaattttttgttgcatgtaatttttaaattatctttatctctgagcagcatttttcttcctgagatcaaattaagccattctgctctgttctgattgattgattattgactatgttttactctctcttccctcctaccttcatccctcctccccattataatttctaatgctggtttctatttaccaaagacttactatagagccaagtattgccctgagaattttacatcttatatcatctacccaccagccctgcatattattattgttctcataaaagttaagaattgctcaaaagtgttatgaaattaagcagatgtatttttccagcc

SEQ ID NO: 1691 - DNA, 7361 bp, Homo sapiens
catttttcctagctttggaactgctattaagctgttgagcttgtttgaccagaaaattctttctggcctggttttatgccctggaagtttgtatagcatatgcctaaacacctgcatccctcatgtcaagagcgtgttgtctgcatgaataaaattcactctctaataatcttttcagtttgtactcattctactcagctaaaggctgaattgattttctctgaccagaagaattttttttttttttttgagatagagtctcgctttctcacccaggctggagtgcagccccaccatctcggctcactgcaacctccatctcttgagtttaagcttttgcctcagtctcccgcatagctggattacaggtgcatgctaccacgcctggctaattttttttttttttgtatttttagtagagacagattttcaccatttggccaggctgcttgaacccctgacctcaggtgatctgcccagttcaacctcccaaagtgctgggcttacaggcatggaccattgcacttgcctggccaccagaataaatgaaagtgttggtgggccctacctggatccattgaggaatagaagaattgtttccctgtagaatatttttctagagacacatgtaaataaatgcatggaacatttcttaccacatacacttatgagaacatgcaggtcacatttaatggtactacctggacaacatgaagggattttgagattattttagggttagtgtatactcatgtcttagttatctattaccacataataaattacctcaaaatttagtggcttaaaacaacaataggcatttagtatctcacagctcttctgtgggtcaggaattcaggagcttaattgtgttcttctggacaggggtctctcatgaggttgcatccatgtaaaggctttagagagtctgcattcatgatcaaggtagttcatttatatggccagttggtgctggctgttggcaggaggccttagtttttctccatgtaaactgctccataaggctgcttgaatgtcctcatgcatggtggcccacagagactgaaccaagagaacaaacaaggcagaagctaaaatttctttgataacccagcctctgatgacacatggtgccatttctacaatgtcctattggttaacacatatcagccctattgaatgtggtagtaggctgtccaagggcatgggtgtaggaggctggctcatgttgggagcatgattgcaacagtataccataatgaatacactggattatgggagaaatatcaattactccctcatgttccaacttggtggagtggctgctgatccaacagtactcaagattagactgatgaaaccagggtctcagaatatgaacagggcctttttctctctacatacctttgaacggcctacttatgcattctttgcctgacatctattaaaactaagaatgatattacttctattaaaaggaagatttttctgatatccccaagtcagggtgcaactcctctgtttttgcatagtactctttacatagtgcttcttataacttgcacttaacacattgcattgtgattactttaccctctatcaagctgcctgctgtgctggaagccattggcttggattaaaggtgacagtattattgaagattttgctgaattaatcagctttgattttgcgtgtccatttctgccccatctatttaatgaataattgatctgtcaaacagaatactagctttttattaaatagccgtatcatattagatgccaatgtagagtatgccaatgtggcttaattgttttcatcaaatgcattccatctctttaattaaattaagtatccactccagacaactgaaaaagccagacttctcctttaaaattccatgattcaatgacttgagggttcagccccagtcagtgcaatttcttttgagatggattcttgctatgttacccagactagtttcaaacttctgggctcaagtgatttccaagcctcagcctcctgagtatattggactacaggcatgtgccactgagtgtgacgttattaacatgccagttttctatacaaaaactttgtttcttttcactttggtggcatactgtggaatgcaacccagctccatttgttcaatgcacataatatttcagtgatgctgtattctgacaaccaatttcagcctaaaatgaaataaaacagaaaaacctcctttttttaaaaaaaatcaatctttttttctacaacataaataaaatgaaagtcaaacattcaattctaactctgagttgacaggcgtatatcccacactttgaggcattgttattaaaaagacaattatgtcttcactctaatggattattggctgttctaaagtttgtctcgtaactaagaaaaagttaaatcattgagaaaagggaaaacatgcagtttctctaagtttatcttactgagaatgcaaacagtgatcctgatctttatcctaacatgtaatgcttggaggcattggattcttccatagttggtcttgtacctttccgtctctctaactatacctgccggcttgagttggtcctacaaaaacctagtgacattgaagaatgttatcccccacccctccaaaaaatgtatggtacatctgtatagctgttcatgggattacagaatgaagagttaaagcacctcttgccatgatgaaaggaaaaaaacaaaaacaaaaacaaacaaacaaacaaacaaaaaaaccttaaaccaggtgaagagatagagtggatattggtggctatatatttgtcttcatcaatgttaacaaaccaagattcgacactgttaattccttaattgctcactgatatgatttggctgtgtccccacccaaatctcatactgaattgtaatctccataatccccatgtatctagggagagacttgatgggaggtgattggatcatggaggtggcttcccccatgctgttcttgagatgaagaggaacacagaagagtcagagaagtttgatgtaagaaggactcggccaccattgatgcctttgaaaatggaggaaggagacacaagccaaggaatgcaggtaatttctagaatctaagaatggtccttagctgacatcaaggaaatgtggatctcagttgcacagcacaaggaactaagctcagccagcagcctgaatgagcaagaacagagacattcctctagaggtttcagaaagtaaggcagccccgcagacacctttatatcaggcttgtgagattctaaataaagacgtggcagtgaccactggacttctgacctatagaaaatgtcagacaataaatttgtgtttctttaagcttctaaggttgtggtaattagttgtggaagaatacagagggaatagaaagggaatgtagagtagagagggaaatgtctgtaataaggaccatcatgaaaaaacaaaacaataaagcctttaagagaaaagcaccatgagtaaaagccttgcagagcagggcaagccttagcatccgggcctgaattagaacctggaagagatcccaagaactttgcacgtctgtatacaactgtcacctgcagcgtctcagctccccagttctcaggagcctgttgtctcttgtgaagcagatgattgtggaacaatggaaatagctttgttactagagagtccaccagctgtgctatgtgactatgttctgaaaaattcagggtaagcataggtttttctgtgacctgtgagaaagggaggcagatgcaagttggagagaccagcagtatcatggacagtggcttgcatgacatcttaggcctacttaatgctagacttcaaaggaacaggactaagaaaactggcagagctacagataaacattatgcttatatgtgagaagctctccccatgcaaggattcccggagtcccagagtgaatgaatggctggggagatcccgggatcaaatcgggtgctttctaatagtgtccacctgatttgattctgggatctcctgagccattcattcactttgggaatttggagtgtagacatgttaggaagcacttgtaagtgtctattgttgatagctgcaatcaaattctcctaagtctgaagcttgtaggcattcgccatatgtttaataattttatcttctatcttgataaagtaggtggacatcagaattgttcattttaattgagtacttgtgctgttgtaagcacatttcatatattaacacattattccttagaagaaccttctgagataggcgttattcactgtggtttacagttgaggaaactgaggcgtggagagactgtgtcattagtccagagttgcatagttagtatgtggtggcattgggattgaatctagacaatatggctccagacaccatgtttttcacagctgttgtgacagacagaatgaaagcaccccaaggtggccacatcttaattcatggaccctactaatatattttgctacattataaaaaaaaaaaaaggttgctaattagctgacattaagataggcagattttcctgagttatatgtgaggaacccatgaaatcacaagggtcctaaggagtggaagagtgagtcagagggaagattggagtaatacgatttgagaactcaattcaccattgatggctttcaacatggaaggcatgcacaagccaaagaatgcaggcagagtaaaaactaacgtcaggaatttgtgaccagcttggccagcatgtgaaaccccatctctactaaaaatacaaaaattagctggatgtagtgatgcgctcctgttatcccagctactcgggaggctgaggcaggagaatcgattgaacccgggaggcagaggttgcagtgagccgaaatggtgccattgcactccagcctgggtaacagagcaagactctgtctcaaaaacaaacaacaaacaacaaacaaacaaacaaacaaaacagcacagaaactaactcctccctagagcactgggaaagcaacacagccctgctgacaccttgatttcagtccactgagacccacatcagacttctgacctctagagctaaaaggtaatacattcgcaattttggaagccactaagtttgtggtaattcggtacagcagcaatagaaaagtaatgactctgctgactactgttcccagatcatatcagggattctcagaaagataactctcttcctctccatccatcctcagtgatatgttaaaaaggatcctgtttgccatacatatcgagtctcaatgttattatcctaccagccaccaccaccttcactctctgatcaaattatcactatttagaaattatgaagctgccattgccagaaatatcctttctctgagttcccatatctggatggccaccaccccaagctcccctccaaataatataattctttctctggctatccaggcatgggttcaactccccagtaagattgttcagggtactgaatttaatgcttagggcatttctcattctttctacatatttttcctgtccaaagagaaaacaacagaaggaaggaaacctattggccaccatttctaagacaacagaggatggtttttttctgtctggaagaagactccctcaacttgcgtctactcagagccactaactcctcctcccaccccatttttttgatggtggtcagggaatggttaactatctttgtttacatgtgaaaactaatttagttttagtcaataaaataaccattgtacgccaggcacagtggatcacgcctgtaatcccagcactttgggaggccgaggtaggcgatcacctgaggtcaggaattcgagaccagcctggccaacatggtgaaaccccatctctactaaaaatacaaaaattagctgggtgtggtggcgggcacctgtagtaccagctactctggaggctgaggcaggagaatcgcttgaacctgggagacaaaggttgcaatgagccgagatcacgccactgcactccagcctgggcgacagagtgagactccgtctcaaaaaaaaaattgtaaaaaggaatattaaaaatagaatgtttgagattgggcatattggtctcgccctagaagctttatgacagagcaaggcacaagaatgaagcatccaatgatcctcaataaggactcactttaaaaatgtacttgccttgcctcattgactttgaggagaagcctatagcctccaaggaaagtttatttacctttgtgccatagtgtttgttagccttttccaatctgccaagagtgaaaatgagaatctcaggagtctgctatttctgacagcgtctacagcaaaccagatggcattgtcccttggaacagctagtgttcatgtttatgtcatccttggtctcttagcttctgagccataggtcaatagttttactcatttcaacgtggaccacacttgcattttagtgaccagcccgcaagaatcccaccaaagaagacttgctgttttactcccagaaacaccccagtgtcctttaaagttcagaaaatgccagaggaacaacactttcactagactaactgtccatttacactgaaaatgtcctaatacatttggaaacctaaagcgaagtaatctgacctcttggaggcttttgaaataattgatcaaagtgataaagatgttccactagctactttacttttctagtttgtctttcaatatctttgtcccacagtgattttcaaaagaattgcttgaatttgtctaaatttagtgtaccaaaaaaaggatatcaaatctcatcctaacttcttcagacaaatagcatccaatttatatttttcagaggtagtccgtgtaaaagttggctttatcttaaatatagacaatctatgaaactctgtatggaaataaaagattaatgagggttatttttcactcttagacaaaaatttccaatagcaaataatcctgcaatttgccaaggtcccatttatgcttgccatttgaggagcaaaatatatcgtgttaaacaagatagaggtggtattactgtatattgctgtattacaatgtttaataagtcttttatactgaaatcacacaaccctaggtaaaaattctggttcctaaaattactagctgagcaaacatggtcagattacttaaattcctttaccccttgttctagagtttctttatctataaatggatagcaagagcaactaacacgtaggatgatttagacacagcaaaaagtaggcattcatctgttactcttaggtttctaaacaatttaatgggctttaagcaaatgactccacatctgcattgcaacaatagata

SEQ ID NO: 1692 - DNA, 4782 bp, Homo sapiens
cttggcctttcaaagtattgggattacaggcatgagccaccacgcctggccacaattctttctttacttatggtttctactcttttgatcttcactctccttaacacttttttaaaacaatcactttccaattcctactgctgactccattcatggatttccagaattaattattaatgtgctcagtcatgctgccccttgggcctaaaatttctggtgtatattacctacccttacttcttccacaaaacattgagtacaatggtctttacatcactttatttcatgaagtaactattgctatacccattttacaggagacaagatggaatcttacagaagtgaaatcataatcccaagggagagacttgatgggaggtgattggatcatggaggtggcttcccccatgctgttcttgagatgaagaggaacacagaagagtcagagaagtttgatgtaagaaggactcggccaccattgatgcctttgaaaatggaggaaggagacacaagccaaggaatgcaggtaatttctagaatctaagaatggtccttagctgacatcaaggaaatgtggatctcagttgcacagcacaaggaactaagctcagccagcagcctgaatgagcaagaacagagacattcctctagaggtttcagaaagtaaggcagccccgcagacacctttatatcaggcttgtgagattctaaataaagacgtggcagtgaccactggacttctgacctatagaaaatgtcagacaataaatttgtgtttctttaagcttctaaggttgtggtaattagttgtggaagaatacagagggaatagaaagggaatgtagagtagagagggaaatgtctgtaataaggaccatcatgaaaaaacaaaacaataaagcctttaagagaaaagcaccatgagtaaaagccttgcagagcagggcaagccttagcatccgggcctgaattagaacctggaagagatcccaagaactttgcacgtctgtatacaactgtcacctgcagcgtctcagctccccagttctcaggagcctgttgtctcttgtgaagcagatgattgtggaacaatggaaatagctttgttactagagagtccaccagctgtgctatgtgactatgttctgaaaaattcagggtaagcataggtttttctgtgacctgtgagaaagggaggcagatgcaagttggagagaccagcagtatcatggacagtggcttgcatgacatcttaggcctacttaatgctagacttcaaaggaacaggactaagaaaactggcagagctacagataaacattatgcttatatgtgagaagctctccccatgcaaggattcccggagtcccagagtgaatgaatggctggggagatcccgggatcaaatcgggtgctttctaatagtgtccacctgatttgattctgggatctcctgagccattcattcactttgggaatttggagtgtagacatgttaggaagcacttgtaagtgtctattgttgatagctgcaatcaaattctcctaagtctgaagcttgtaggcattcgccatatgtttaataattttatcttctatcttgataaagtaggtggacatcagaattgttcattttaattgagtacttgtgctgttgtaagcacatttcatatattaacacattattccttagaagaaccttctgagataggcgttattcactgtggtttacagttgaggaaactgaggcgtggagagactgtgtcattagtccagagttgcatagttagtatgtggtggcattgggattgaatctagacaatatggctccagacaccatgtttttcacagctgttgtgacagacagaatgaaagcaccccaaggtggccacatcttaattcatggaccctactaatatattttgctacattataaaaaaaaaaaaaggttgctaattagctgacattaagataggcagattttcctgagttatatgtgaggaacccatgaaatcacaagggtcctaaggagtggaagagtgagtcagagggaagattggagtaatacgatttgagaactcaattcaccattgatggctttcaacatggaaggcatgcacaagccaaagaatgcaggcagagtaaaaactaacgtcaggaatttgtgaccagcttggccagcatgtgaaaccccatctctactaaaaatacaaaaattagctggatgtagtgatgcgctcctgttatcccagctactcgggaggctgaggcaggagaatcgattgaacccgggaggcagaggttgcagtgagccgaaatggtgccattgcactccagcctgggtaacagagcaagactctgtctcaaaaacaaacaacaaacaacaaacaaacaaacaaacaaaacagcacagaaactaactcctccctagagcactgggaaagcaacacagccctgctgacaccttgatttcagtccactgagacccacatcagacttctgacctctagagctaaaaggtaatacattcgcaattttggaagccactaagtttgtggtaattcggtacagcagcaatagaaaagtaatgactctgctgactactgttcccagatcatatcagggattctcagaaagataactctcttcctctccatccatcctcagtgatatgttaaaaaggatcctgtttgccatacatatcgagtctcaatgttattatcctaccagccaccaccaccttcactctctgatcaaattatcactatttagaaattatgaagctgccattgccagaaatatcctttctctgagttcccatatctggatggccaccaccccaagctcccctccaaataatataattctttctctggctatccaggcatgggttcaactccccagtaagattgttcagggtactgaatttaatgcttagggcatttctcattctttctacatatttttcctgtccaaagagaaaacaacagaaggaaggaaacctattggccaccatttctaagacaacagaggatggtttttttctgtctggaagaagactccctcaacttgcgtctactcagagccactaactcctcctcccaccccatttttttgatggtggtcagggaatggttaactatctttgtttacatgtgaaaactaatttagttttagtcaataaaataaccattgtacgccaggcacagtggatcacgcctgtaatcccagcactttgggaggccgaggtaggcgatcacctgaggtcaggaattcgagaccagcctggccaacatggtgaaaccccatctctactaaaaatacaaaaattagctgggtgtggtggcgggcacctgtagtaccagctactctggaggctgaggcaggagaatcgcttgaacctgggagacaaaggttgcaatgagccgagatcacgccactgcactccagcctgggcgacagagtgagactccgtctcaaaaaaaaaattgtaaaaaggaatattaaaaatagaatgtttgagattgggcatattggtctcgccctagaagctttatgacagagcaaggcacaagaatgaagcatccaatgatcctcaataaggactcactttaaaaatgtacttgccttgcctcattgactttgaggagaagcctatagcctccaaggaaagtttatttacctttgtgccatagtgtttgttagccttttccaatctgccaagagtgaaaatgagaatctcaggagtctgctatttctgacagcgtctacagcaaaccagatggcattgtcccttggaacagctagtgttcatgtttatgtcatccttggtctcttagcttctgagccataggtcaatagttttactcatttcaacgtggaccacacttgcattttagtgaccagcccgcaagaatcccaccaaagaagacttgctgttttactcccagaaacaccccagtgtcctttaaagttcagaaaatgccagaggaacaacactttcactagactaactgtccatttacactgaaaatgtcctaatacatttggaaacctaaagcgaagtaatctgacctcttggaggcttttgaaataattgatcaaagtgataaagatgttccactagctactttacttttctagtttgtctttcaatatctttgtcccacagtgattttcaaaagaattgcttgaatttgtctaaatttagtgtaccaaaaaaaggatatcaaatctcatcctaacttcttcagacaaatagcatccaatttatatttttcagaggtagtccgtgtaaaagttggctttatcttaaatatagacaatctatgaaactctgtatggaaataaaagattaatgagggttatttttcactcttagacaaaaatttccaatagcaaataatcctgcaatttgccaaggtcccatttatgcttgccatttgaggagcaaaatatatcgtgttaaacaagatagaggtggtattactgtatattgctgtattacaatgtttaataagtcttttatactgaaatcacacaaccctaggtaaaaattctggttcctaaaattactagctgagcaaacatggtcagattacttaaattcctttaccccttgttctagagtttctttatctataaatggatagcaagagcaactaacacgtaggatgatttagacacagcaaaaagtaggcattcatctgttactcttaggtttctaaacaatttaatgggctttaagcaaatgactccacatctgcattgcaacaatagata

SEQ ID NO: 1693 - DNA, 2155 bp, Homo sapiens
ctgaatcctcttgacctgtgaacatatactatttgactagagtgatgttttgcctttttaaattaaatttgagtagttttggttggagcattactactatttgcaacaatcctcaaaactccctatttattgctttttgcttggctcacttcacatccattgtaggcatttgtctgtgttctggtttaatgctgtgagttttaataagagtttctgtacggagcctgagatatctctataagaagaaaaagtaggaaggttgttagttaaaccactggagtcagaatctcaggaaaacaacaatcagcaaccaggcccagagctggggaagcatcatggaggtttggagcagactggagatagaggtcagaaggctgtactgaaagacagggcatcagaagcaaaactcgggactggatgattgagcacatgaccttggctaagtacatgggcaacagctgtaaaaactagagcaagaaaagtaggggattctcttatatcccctcctgagttgtagaatgtgtaataagacagtttgggcttagttggaaacttagctagggctgattgttcagggaaatctttgcaactatttttcatcaatgctattttttctttttcattttctatttttctttctattcagttaacaggatttggggacagttttagataggagggtaaaactctaataatatttttctatgcctactgtatttttttacttattttattttatcgtatttttattttgaggcaggcatcttgctctattacccagacaggagtgatcttggctcactgcaacctctgcctcccagtctcaagagatccttccatctcagcctcctgagtagctgggactacagacatgtgccatcatgcccagctaatttttgtattttttgtagagacagggttttgccacattgcccaggctggtctcacactctggactcaagtgatctgcccaccttggcctttcaaagtattgggattacaggcatgagccaccacgcctggccacaattctttctttacttatggtttctactcttttgatcttcactctccttaacacttttttaaaacaatcactttccaattcctactgctgactccattcatggatttccagaattaattattaatgtgctcagtcatgctgccccttgggcctaaaatttctggtgtatattacctacccttacttcttccacaaaacattgagtacaatggtctttacatcactttatttcatgaagtaactattgctatacccattttacaggagacaagatggaatcttacagaagtgaaatcataatcccaagggagagacttgatgggaggtgattggatcatggaggtggcttcccccatgctgttcttgagatggtgagtgagttctcataagatctgatggttttataaggggctcttctcccttcactcctcttcttctctctctcacctgctgtcatctaatataaagacacatgcacacataatgtttattgcagcactgttcacaatagcaaagtcttggaaccaacccaaatgcccatcaatggtagactggataaagaaaatgtgacacatatacaccatggaatactatgcagccataaaaaaggatgagttcatgtcctttgtagggacatggaagaagctggaaactatcattctcagcaaactaacaaaagaacagaaaaccaaacaccacatgttctcactcataagtgggaggtgaacaatgagaacacatggacacagggaggagaacatcacacactggggcctgtcagggggtgggggtctaggggagggatagcattaggagaaatatctaatgtagatgatgagttgatgggtgcagcaaatcaccgtggcacatatatacctatgtagcaaacctgcacgttctgcacatgtactccagagcttaaagtataattaaaaaaaaaaagatgtgcctcttcccttttcaccatgtttgtaagtttcctgaggcctccccacccatgcagaaaagtgagtcaattaaacctctttcttttataaattacccagtctcgggtttttctttgtagcagtatgaaaatgtatgaataaactcatttacacaaatgacttcgtattcttattggtgttt

SEQ ID NO: 1694 - DNA, 300 bp, Homo sapiens
atagactcttcttggttgtgatggtttctcacgcttttcttggttttgaagacgttgacaattttcttccattgggatttgcttgatgcttttctcatgattacactggaactgtgactttttagaaggaagatcatagaggagaagaaactgaggttcaaggactagtaaccagcagcagatcacacagctggaagacaactaagagcaaaaaaacaggcacaattaaagtgctaagaaatcactgcagacagagaacctgacactgacaaggagaattacatatgcatcaatgaggag

SEQ ID NO: 1695 - DNA, 938 bp, Homo sapiens
cagcgcgcccacgtgacggccccggctctccggtgagctccccaaacagacgcacacccagccacacgcgcgcgctcgcgcgcgcgcacacacaacacacacacacacacacacacgcacgcacccccgcgcgcacacgcccgcccgctcgcgctgcctctgcgcctccatcccggctcgctcattatctcgccctctcgcttcccctgcggtctctcgctctgcgcgcacacaccacacacacgcacacgcacacacacgcgcgcacacacgcagccggcacaggcggcggcggcggctgcccaagtcaggacgaacctatctaggtaccgtcttgagaaggcggcagcggcggcggcggcggcggcggcggcagcccgagcatccctcctctcccggagagggagcaccgccgagagtttccgttccctttgccattcccttccccctccttttcttttattttcgagagaatttcttcttggcttattggtttaatttgatttttaaaattttgggttgcttttgtgtatgtgtgctttttttttctttcctcattttatttgcatccagagcatggcgggctgcgggctgtcggaagacaccctcttctcttccttcttttacaactacggctcctcctgggaaaccccttccaaccaggttttttgcgaaaatcagtgaactaatattggtaaaattggagccccatggatgaagggtactttgtaagtataatacattattgtcatgttattttctgttattctgaagtgcaaataccaaatgtctgctcttgccatatcaggaaatctgtaacaccaagtttcacacccagatattgataatctgacttctttgaggcatttaatgtttctgaactctaatgttttgacaatatgtcagatgttgaaaagccacctccgcctgccaccctc

SEQ ID NO: 1696 - DNA, 762 bp, Homo sapiens
aggcagccaggctaacacatttcttcaccatctaggtagtaggtgctcataaataccaactgagtgaacggaaatgccatttaatataccgctttatgcctcacaccttaactatactatggaagaagcagatacacttcgagctctctagtacggtgtttatgcctctgggaacagtgattttcacgtgctgtatgggtgtttgtattcaggtaagttccaggaaaatggacattcaatttccgtaagaaggttaatgtgcatagatactagacccccaccaggtgatccattataactgccccaaaacactaacacctgaaaatgcattttgtgaaaaacaaaggcaaatgcatttttaccttagaaatgttgattctggaagagttgggggcacttggtaagttgtttgtggcaaaggcaagggctgcaaagcccgtgacaggaagcagggtaggtataaagtcaaggattaagaacagtacttggcacaaaatagttacttgatgctgaatgaattagtctccctccgtcatctacttcccaggggctagatccagacagaggtcaagaagatggggcctgttgaaagttaaaggacctgccgtctgtttcttctttgaacaagtgaaaggtagtaaaaagtagatggctttctaccataggttttaagtttaagaaccctaggatggtactgtcacattctcttagggaggtcatagctgtgggaactgtcaacaggttgactcatttaaatgtgtc

SEQ ID NO: 1697 - DNA, 1953 bp, Homo sapiens
ggtcacaagggctctgacctcatgaatggaataatgccattataaaatgggcttgtggctggatgcagtgggtcatgtctataatccaagctctttgggagacccaggcaggtggataggctgagcctgggagttcgagaccagcctggctgacatagcaaaagccagtctctagcaaaaacaaacaaacaaacaaattagacattttttggtagtcatcgcttgtagttccagttatttgggaggctgaggtgggaggatcacttgagcagggaagtggaggtcgcagggagaagagattgtgccactgcactccaacctctagggtgacagagtgagaccttgtctcaaaaacaaacaaacagagcaaaaattggcttgcaagagtggattcattgatctttcacttcttccatgtgaggaacagtattcctgtatcctggagaaggcagcactcgagccaccatcttggaagtgaagatcaggccctcagcagacacaaaacctgccagtgccatgatcttggatttttcaacctgcaggactattcaatgaaattccaatgaaaatctcaagttattatgtgaatattgaaaaacgaaccctaaagtttatatggagagccaaaaaatgcaaaagagccagcacatattgaaagagaagaacaaagtcagaagattgacactacctgacttcaagacttatgataaagcttcagtaataaagacagtgtggtatggacaaactaatagaaatacagatcaatggaacagaacagagaacccagaaatagattcacataaatatattgtcaactgacctttgacaaataagaaaaagcaatacagtagagcaaaaatagccttttcactaaacaaatgaacatccacattcaaaaaaaaaaaatgaatctagatggagacttacatgcttcacaaaaattaactcaaaatgaataataaacctaaatgtaaaacacaaaacaataaaaatcctagaaataacatggaagaaaatctagataaccgtggggatgaagatgagtttttagatacagcatcatcggtataatccacgaaagaaaaaatagataaactggacttcaatgaaattaaaatttctgttctgcataagacaatgtctagataacaagaaaacaaggcacagactgggaaggcatatttggaaaagacacatatgatagaggacagttatctaaaatatatcatgcacccttaaagttcaacaataatcaaacaatctgactgacaaatgggctgaagaccttaagagacactttacttaaagaagattatacagatgggaaataagcaatgacaagatggtccacatcatatgtcatcagaaaaatgtaaattaaaaccatgagatactacagtgcatctgttaaaatggcccaaatctggaaaactgacaacatcaaatgctcatgaagctgtggaggaaaaagggctcttattcattgttgctgaaagcaaaatgttacagctactttgaaagacagttgggtagtttcttacaaaactaaacatactcattatatgacataacaattgcactctttggtatttaaccaaaggagttgaaaattttatcttcataaaaacctctatgtagagttttgtagcagctttatttataattgtcaaaacttggaagcaaccaaaatgtccttcagtgggcgaatgaaaaaaaaaagaactgtgggatattgaggcaatggaatattattcagtgctaaaaagaaataagccattaagtcatgaaaagacacaggttaactttaaatgcatatgactaagcaaaagaagacaataccaaaagactatatgctgaacgattcctgtatgatactacaattaacacaagccattatttatctgtccaaacccatagaatgtacaacataagagtgaactgtaatgttgggac

SEQ ID NO: 1698 - DNA, 273 bp, Homo sapiens
aacagaagcaacattcaaattaacatcagtcaactgatggaatattttagatgaagtaagagaagccaaggcatgtaccctcaggctctgggcttctccctgcaaggttgggaagaaatttggaggaggcaaagtgggagcaagtcagatggaagagacattatgggtcagaaattcatagtgtagtgggaggtggaccaaaatgccattgacttgattgcctgacactgacaggtgctgaaatagaggaatatacgggatgccatgggaggc

SEQ ID NO: 1699 - DNA, 269 bp, Homo sapiens
gacttgttttttattttacaggctgataggcagaagtgacgtgccttgtgtcagatgagactttggacttggacttttgagttaatgctggaatgagttaagactttgggggaccattgggaaggcatgattgtgttttaaaatacatgcttgcttcccctttgtccttctgccatgattgtgagtttcctgaggcctccccaaccatgcatcctgcacagcttgtggaactgtgagtcaattaaacctcttttcttcataaattaccc

SEQ ID NO: 1700 - DNA, 1152 bp, Homo sapiens
tgtgtgtgtgtgtgtgtgcagagtgtgtatgtatggggtgtgtatgtgtgaggtatgtggagtgtgtgtgtgtgtagagagtgtgtggagggtgtatgtatggggtgtgggagggtgtatgcatgtattgtgtgtatgtgtgtgtgatttgtatgtgtgaatgtgtttttgtgtgtagtgtgtgtgtggatgttgtttgggagtgtgtgtgtggatgtgaatgtttaggttctgtgtgtgtgtgtttgcggagtgtgtggagtgtgtaacatggtgtgtgtatatgtttggggtgtgtgtgtagatatgtgtgtgtgagtgtgtgtgttatggagtgtgtgtatatgtatgtttgggtgtgtgtggggtgtgtgtatagtgtgtgggaggtgtgagtgcatattgagtgtgtgtatatgtgtatgtttcgggaggtttgtgtgtggagtgtgtgtgtagagtgtgtgtgtatggggtgtgtgtgtgtggagtgtgtgtgtatgaagcgtgtgtggggagtgtgtgtgtagaatgtgtgtgtggagtatgtatgtttggggtgtgtgtagtgtgtgtgcatgtatgtgtatgggtgtgtgtgtatatttatatttgggagtctgtgtctgtggagtgcatgtgtgtagagtatgtgtataggtgtgtgtggagtgtgtgtatagtgtatgttgggatgtgtgtgtggagcgtgtgtgtgcacgtgtgtgtatgtttgtgtgtgtgtgtagtatgtgtgtagtttgtgtgtgtgtatttttggatgtgtgtgtatgggtgtgtgtgtaatgtgtgtgtagtttgcgcatgtgtgtgtttatttgggtgtgtgtgtgtggagtgtgtgtgcatgtttgggtgtgtgtctattgtgtgcatgtgtatgtatattggggtgtgtgtgtgtggagtgtgtgtgtacgtgtatgtttgggtgtgtgtggagtgtgtgtgcgcgtgtgtgtgtatgtttggggtatgtgtgtgtagcgtgtctgtgtgtgtgtttggatggggaacgttataaagagcaccattctcaaagcgcagggaattcgcgagccctggggatcgctggtctacttcctaagcagcaaggaatgttatgcatttcagcgcttgctaagtcagtgc

SEQ ID NO: 1701 - DNA, 340 bp, Homo sapiens
ctaggaattaaatattgtgaatgcaaacagctgaaaaaattgaatctacattgggtttggaaagctgggaattggagtgcctagtctgtaagaaggggctcccaaacaggggaacagcaaatgcaaagactggaagatataaaataacatggtgttttggaaccaaagaaagtctggtatcattagaattcacaagaatcacaatttcttcccttttgataaagtagatataaaatttgctaagttttggctgggtgcagtggcccacgcctgtaatcccagcactttgggaggctgaggcgggtggatcacgaggtcaggagatcgagaccagcctggg

SEQ ID NO: 1702 - DNA, 1828 bp, Homo sapiens
gtgcccttaaaagaggagaaagagacactagagtgatcgctcttgaccatgtgaagacacagcaaacaggtggcatgtgcaagtcaggaggagagccctcaccagaaacgaaatcagtggacaccttgacccatgagccaccagaactgtgagaaataaacatctgctgtttaagccacctcatgtatgatattcggttatggcatcccaagaaaactagtacagtgggatattttaaaactcagctcttttaggaaacactgaacaattaaaaagacaaaagagtatgtgtcacacaataatactgtatgtatcccatactaaggtcctaaggggacacataactatgtctttcaagaaaaaccccacctaccaactcagtgagtagacatggacccactaataaatagagcagagatttaagagaggatagggcttaagctctaatgaagagtcacaaagatcacaaatccagaaacattttcacttctaaatggtttactgttccttaatttgaattttcagtccacatagacacagcatattaaaattatgcacaacacacatgcacctacgtagagaaagaaaaagagggagagaaagaatatatgtgattggacttttgggagaatacactttgtgtcaagcattgtacctatcatcaaacaaatactataaggaggcatcatccctatttttgaagatgataaactgagacacaaagatataacttgaacatgattccactattatttgtgaactaaataacaacaattcattttcagttagaacatggaagcccacaacaataaaaatgaaccatttatgaacctcacatcacaaagatccatatctccagaggttctgaaggatacatttggataagcggtggattattccaaatgaactttcttataaggcttcatctgacatttgtaattattagtagtcacaattatgaaaaaattggcttacaggctttaaaaaatttttttaaattaggaagggatcatctcactgagttacccagaacaaagtgaaaatttgtttgattgtattgtgtatggataccaaacaaaattgcctgattgtattgtatatagaactggaaaacatgccaggaatggaggcatttatgaacaagctacttgtgtgcctctctctcattcctggtgtgtgcttatggcaactcagcttatttttggatctgctcacgatttctgcttctttacaacatttgctctctgtgaccccacatagtccccattgtatcccaaccctctcaaaatagttttccagctttatcttcgaatacaaattgcctcattatcttgatatttgctagatcaaatttaaacatcaaggagagtatgattagactatttgagctttttttgtattatgtcatatcgtaggactctgcctatcttatgcatcagccaccttcaaattatgtagcttctaatcaacggtggtcagaaaggagagggctagtggggaaaacaaaagcctaatgatagttatgtcttaacctgggtttgtaactattcattctgttatttgttcaacaacatttattaggtgcctactatgtttcagacattgttccaggctctgagttacacctgcggtcaaaatggacaaaatcttgatccagttgaggtgaaattgaagaagggagaaatgcacagcaaagaaatggatacataaatattcagtgtctcaggaggtcaatataactacagaagagcattaaagctgaatatataatctgatagcctcaacatttgcactatagatgcgtgattcacgaacatcctaattccag

SEQ ID NO: 1703 - DNA, 327 bp, Homo sapiens
ctttcaccggaaacaaactcttccagatcttaattgtggatttctagcctccagaatgatattctttcagatactgtgtactgatgaaactgctgactcagctggtctgaaggaccccactggcactggctggtctgaaggaccctgctgatcacaacttgcctgaaggaccctactgacatcagctgttgtccaaaggacgccacaagaaactgactcaccaaaaaatgcatcctgatgatttcatcccccttaacccgaccaatcaacaaccccaaatctacacagcccctttccctccatgattcctacaaaactccagcccag

SEQ ID NO: 1704 - DNA, 362 bp, Homo sapiens
ctcgagtggaatggaatgtaatggaatggagtggaatggaatggaattgaatggaatggaatggaatggaatcaacctgaatggaatggaatggaatggaatggaatggaatggaatggaatggcatggaatcaacccgagtggaatggaatggaatggaattcaatggaatggaatggaatggaatggaatggaatggaatggaatggaatggagtggaatcaacacgaatggaaaggaacggaatggaatggaatgcaatggaatggaatggaatggaatggaatggaatggaatggaatggaatggaatggaatggaatcaacccgagtggaatggaatggaatggaatgcaatggaat

SEQ ID NO: 1705 - DNA, 366 bp, Homo sapiens
ccgagtggaattgaatggaatggaaaggaatcaacccgagaggaatgaaatggaatgtaatgcaatggaatggagcggaatcaacctgagtggaatggaatggaatggaatggaatggaatggaatggaatggaatggaatggaatggaatggaatggaatgcaattgaatggaatggaatggaatcaacccgaatggaatggaacggaatggaaaggaatggaatggaatggaatggaacggaatggaatggaatggaatggaatcatcccgagtggaatggaatggaatggaatggaatggaatggaatggaatggaatggaatggaatcaacccgaatgggattgaatggaatggaatgtaat

SEQ ID NO: 1706 - DNA, 619 bp, Homo sapiens
ggaatggaatcaacctgagtggaaaggaatggaatggaatggaaagcaatggaattcaaaggaatggaattaactcgagtggaatagaatggaatggaatggaatggaatggaatcgaatggtatggaatggattggaatggaaagaaattcaacggaatggaatcaaccagaatggaatggaatggaatggaatggaatggaatggaatggaatggaatggattggaatggaatggattggaatcaacccgagtcgaatggaatggaatggaatggaatggaatggaatggaatggaatggaatcaaccccaatggaatggaatggaatggaatagaatggaatcaactcgaatggaatggaatggaatggaatggaatggaatggaatggaatggaatggaaaggaatggaatggaatcaacccgaatggaatggaatggaatggattggaatggaatggaatggaatcaacccgagtggaatggaatggaatggaatggaatgcaatggaatggaatggaatggaatggaatggaatggaacggaatggaatggaatggaatggaatcatcccgagtggaatggaatggtatggaatgcaatgaaatggaatggaa

SEQ ID NO: 1707 - DNA, 763 bp, Homo sapiens
attccgttcaattccattgcattccattccattccattccactcgggtggattccattccattccactccattccattccattccattccattccattccattccactcgggttgattccagtccgttcctttccatttcattccattccattccattccattccattccattccattccattccattccaatccattccattccactccactccggttgattccattccattctattccattccattccattccattccattccattccattccattccattccattccattccactcgggttgattccattccattccattccattttattccattccattccgttccattccattccattccattccataccattccactcgggttgattccatagcattccattccattccactcgggttgattccattccattccattccattccactccattccattccattcctttccactcctttcgattccattccattccattccacttgggttgattccttccattccattccactccactcgggttgattcctttccattccatttcattccattcctttccattccattccattccactccactccactccattccattccattccactcgggttgattccattccattccattccaatccattccattccattccattccattccattccattccattccattccattcgggttcattccattccattccattccattccattccattccattccactc

SEQ ID NO: 1708 - DNA, 317 bp, Homo sapiens
aaggagagcatcgccagggcggagctgagttctcctctgcacagacttcagagatacagcgaaggcggagcagtgttctcctcagcacagacccaggcgggccgggggcaccgcgagggcggagctgcgttctgctcagcacagacccgggggacaccgctaaggcagagcagcgttctcctcagcacagacctttggggcactgcctcgctttgggacaactcgggaccgcatagacgggatcatggcacaagttgcagtttccaccctgcccatggaagatgaggagtccatggaagatgaggagtctgttgaag

SEQ ID NO: 1709 - DNA, 1983 bp, Homo sapiens
gcctgcgcgcccggccgcggtggtgggcgggaggatggtgggcgggctccgagcccagctccactggccccggccgcggggctcgcccctccgtccccaaacgaccgtctccgctgccatgagatgccgacagcctgtgcgctggccgccaccccctgctccatcaggtgctggaatctgagtaaaagcctgggcgcgagctcccagccccggggcctgccaccggctccacgaagcgggcagctccagcggccgccgggagaaggaagggcgaccgggggagacgggtcgcagggacagcacgtggcggaaagttagccccggactagcacgccccacccggagaagccggcctggaaggggctgcggaccaccaggcggagcggtgggcgaccgaagtgcggctgggctggcctcctcgtctccgcactggaagaattgcccttccgcaagtcttcccttcccacatgggggccctccaggccgcacctcggtcgcccaccgcttcccttgagaagggagactaaagacaggcatctggaagctgtcactgtggcgcgcgggcagacaggggatcccattggagaggaagagccgtagtagtcgctgctgccttcggccgacccaacggccgcctgcttgggaggaagaaaaagaacgcccccgctgaagaattaaggcagccattggttgctctagggggttacaagatgggcagtacaatagaggatggactggagttggaaaagactaaagcagcaagtttgataaggaggctacagcaatagtccaggtgaaagacgcaagagcccaaaatgcagcagtggccaagggaatggatctgagataaagttcagaagatagagttggcagggcaggtgaggagaagagaagaaggccacatgaagatggagcaagagattggagtgatgtggccacaagccaaggaagctgaggaatgaagacagctatcagaagctggaagaggaaaagaattctctcttggggtctgcagagggagaacagccctgccaacacttccatttccaatgtctggactctagaactgtgagaaaataaattcccattattttaaggaacacagtttgtgatactgcattacagcagctccatgaaacaaatacattttgttattccaagtcctcttcacaacaaagtctttgctagtggtgaaccaaacacagtcccaccatcatgagccactgttctggatgagggggcaacacagttcagacactggtcatctctatttaatgtctaatgggcatctcaaacctaactttctcccagtggaaatgcctggaggtacgtggagatggaaagctgacctagccaaggagttcagcaaagatccctgggaggaggtgacatctggacatctgcacagaataatgaggctgggctaaggcagtgactgagggaggcactcttttttggtttttcttttcttttcttttgtgtaggaaggaaagaatagccaggagagatagaggagaaagaggataaagatagacaggaaagaggtaacacaagaagtcaggacctgcgcttgaggggcagaagtcaagtcgggctaaggtgagaaggcagaacagggttcagggtctttgaagagaaacaagtacagagctggaactaagtgatgctgactccagactaaaaccctctgggtttgaatcctgcctctgccacttacttattcattacaaaatagcgagaaattacattatctggatcttggtctcttcaactataaaacaaaaataataatagctcctatctcataggatgctattaggagtactaagtatattaacacctgtaaagcacttggctcaatgtctggcactgcatatgcaataaatgtcattattactattaacattattagaagaagcagcaaatttaaaatcagaatgtgagcactggaaaggacttcagaatcaactaatctaattcccc

SEQ ID NO: 1710 - DNA, 2042 bp, Homo sapiens
cccgcctggaagggaccattcgcttccccaggaaggggtgtgagcctgcgcgcccggccgcggtggtgggcgggaggatggtgggcgggctccgagcccagctccactggccccggccgcggggctcgcccctccgtccccaaacgaccgtctccgctgccatgagatgccgacagcctgtgcgctggccgccaccccctgctccatcaggtgctggaatctgagtaaaagcctgggcgcgagctcccagccccggggcctgccaccggctccacgaagcgggcagctccagcggccgccgggagaaggaagggcgaccgggggagacgggtcgcagggacagcacgtggcggaaagttagccccggactagcacgccccacccggagaagccggcctggaaggggctgcggaccaccaggcggagcggtgggcgaccgaagtgcggctgggctggcctcctcgtctccgcactggaagaattgcccttccgcaagtcttcccttcccacatgggggccctccaggccgcacctcggtcgcccaccgcttcccttgagaagggagactaaagacaggcatctggaagctgtcactgtggcgcgcgggcagacaggggatcccattggagaggaagagccgtagtagtcgctgctgccttcggccgacccaacggccgcctgcttgggaggaagaaaaagaacgcccccgctgaagaattaaggcagccattggttgctctagggggttacaagatgggcagtacaatagaggatggactggagttggaaaagactaaagcagcaagtttgataaggaggctacagcaatagtccaggtgaaagacgcaagagcccaaaatgcagcagtggccaagggaatggatctgagataaagttcagaagatagagttggcagggcaggtgagtttatctttaatccaggagaagagaagaaggccacatgaagatggagcaagagattggagtgatgtggccacaagccaaggaagctgaggaatgaagacagctatcagaagctggaagaggaaaagaattctctcttggggtctgcagagggagaacagccctgccaacacttccatttccaatgtctggactctagaactgtgagaaaataaattcccattattttaaggaacacagtttgtgatactgcattacagcagctccatgaaacaaatacattttgttattccaagtcctcttcacaacaaagtctttgctagtggtgaaccaaacacagtcccaccatcatgagccactgttctggatgagggggcaacacagttcagacactggtcatctctatttaatgtctaatgggcatctcaaacctaactttctcccagtggaaatgcctggaggtacgtggagatggaaagctgacctagccaaggagttcagcaaagatccctgggaggaggtgacatctggacatctgcacagaataatgaggctgggctaaggcagtgactgagggaggcactcttttttggtttttcttttcttttcttttgtgtaggaaggaaagaatagccaggagagatagaggagaaagaggataaagatagacaggaaagaggtaacacaagaagtcaggacctgcgcttgaggggcagaagtcaagtcgggctaaggtgagaaggcagaacagggttcagggtctttgaagagaaacaagtacagagctggaactaagtgatgctgactccagactaaaaccctctgggtttgaatcctgcctctgccacttacttattcattacaaaatagcgagaaattacattatctggatcttggtctcttcaactataaaacaaaaataataatagctcctatctcataggatgctattaggagtactaagtatattaacacctgtaaagcacttggctcaatgtctggcactgcatatgcaataaatgtcattattactattaacattattagaagaagcagcaaatttaaaatcagaatgtgagcactggaaaggacttcagaatcaactaatctaattcccc

SEQ ID NO: 1711 - DNA, 636 bp, Homo sapiens
gtggcttcaagcttttccttattggccccagaaaattcacccaccttttgtcccttcttaaaaaactggaatgttggcatgcatttgacttcatactctaaagcaacatcctgacagtcatccacatctacttcaaggaataccatgttggaatacttttcagagagggaatgaaagaaagacttgatcattttgcaaggcccacaccatgtggctgagaagtcaactacaagtttattgcctgcggtgtccaaggcttcctgaaaagcaaccttgctcttgatcgttttaccattcttggctgctggggtctgatgagcaactgtaacgaccgatggaaacggatccaaagcactggactgagcttggacaagacaaggctttgttaactatgttcctgggagagaaggaaagtctgtgtttcatctcatcatctgtgttgcagtttagtccagtttgctttattccatggtgagtggagagagtaagtagttggatggcgccctacattttaatgttaccacaactcaagatttatgctagttttgcaaagaattctctcatgaaatgagttttatctccacttgacaagagacagttgaatccacagtagggctaagaagaagatttaggaag

SEQ ID NO: 1712 - DNA, 1832 bp, Homo sapiens
ggaggatattggcctaaataattcactaatttatttatcatttaacatggcattccaagttcaataagaaaagtcatcttgccggaaaaaaaagtgtgtgggagggagcaagtgttggctcaaaatttgctttgcctgactaatggatccttgaggaaactccccaaactcctggaatcagatatgaaaacgtttttcctttttgtgggagtagggggtagaagattatgacttttgttcctaagcaaggcaagccaaggtcattgcaaccttcctgcataattgtcaaagtgagaaggcagagcacaagcatatcccctgcctgaagcccttttgtttagtttccttttgtatcaaaaagattggctttcaccatgggagaggttgtaattggatttcaccatgaaaggaagttgtaattggatttctcagcactctacaagctctgtccctggaaaagcaaggaaaaggggcctgaatatcctttctgctagctggaaacagcccagccaagccatcagagattgacctgaaaggtatgggcagaatgggccatgtgtgtgtcagctacccccatctctgatgaaaagctatgtgtgtaatagctaaatatcgctcctgaaatttgtatctcctagaaaagaggagggtgtctaaagtttggcatacactaaaacacaaaaacatcattctccgtctagatttattagggaacctacacaaacgaccagaatatgtttttattttcggtactatggtttattttgcattctttttctgtaattggttccacttcagtttctatgatatttcctagaaacttaaattacagtaagattaggtcgaagtagatatttgtatttgatttattttcagttcctatagttttttagaacattaatttacatttaaattttaaaagataaattttatttttgaagttctgtatattgccatgccacttaaatcaacttagcacacctgctcccctgggcacttcttgccttgctgtacttcttctttctatcttccttctctttccttttctcttaagcattaataagctgtctgaacactgaaccagactgtaaacgcagtcatccatacctctgaaaggaggaacaggattcctctttcatattggccacatcagtgactccctggaaattttagtgctggtagttattgcttcaagtctttctaattgaattttccttgtgttgcctagcattcccctggtttctgaaccctccagtctgaaccctccagtggttagctccttctgtggcagcctcagcaaaatttacaagtcctcttccttcccttctgggcctagggaacttgtttcaatatttttgggtttcaaggcagatgatgacaacttgatctgtttatcactttgtctaaagtttaatgaactaagaaagacataccatgtgtactagaaaaaggagaggtttgtcttgttactttctttttcttattactcttggcctatcatttcctggagtatgtacatccatgcatccaaataaggccaggtatcttctgttgaatttaggcatattcaagtctactggagttgaaattctgctgctctgtcaactagtgggggtctgaagtgacagacgagaatttggaggttggcaccagagagtatttcagactgtcatcgtttttgttgcagattcctggatttccctagcaggctggcctctcatgcgagggctttacaggcagtgcttgcaaaccaaaagggaaagagctaattctggtggcgtggatggggttaacagtcttcccctcaagctcttgttctcagagcctcataa

SEQ ID NO: 1713 - DNA, 1861 bp, Homo sapiens
ctctgctgccacttcatcttcatcagtacctagacctagcttgatcatgtggtagatgtggttggagtgggtctggggatcctcaagggaaaagcccgaagatagcagggcggtttcaaacagcagcaccaccaggtccttaactgccttatcattcttgtcggcctcagccttctgccgcagcgtctccatgatggggtggtcggggttgatctccaggtgctttttggccatcatatagcccatggtggagttgtcccgaagtgcctgggctttcatgatctgctccatattggctgtccagccgtaggtgctggtcacaatgcagcagggtgaagacacaagtctattggagattgtcaccttctcaaccttcttatctaagatttctttcatgagcttgcagaggttctcaaacttttccttgctttcttccatcttcttcttctcctcctcatcctcaggtagctccagaccctccttggtaactgagaccaggcttttcccatcaaactccttgagctgctgcacacagtactcgtcaatgggctcagtcatatataccacctcgaagccctgtttccgcactcgctccacaaaagcagagttggccacctgctctttgctctcaccagtgatgtaataggtggacttctgtgtctccttcatgtgagaaacatactacgacagagatgtcatctcatctccagactgggaggtgtgacagcgcagcagctcagacaggcggtggcggttagtggagtcttcgtggattccaagcttgagatttttagaaaatgcctcatagaatttcttataatctccttgtcttctgccagctcagagaagagctcaaggcacttcttaacaatgtttttgcgaatgactttcaagattttgctctgctggagcatttctcgggagatgttcaggggcagatcctcagagtcaaccacaccatggataaaattgagatactctggtatcaactcatcacagctgtccatgatgaacacacggcggacatacagtttgatgttgttctttttcttcttgttctcaaaaaggtcaaagggagcccgacgaggactgaatagcaatgccctgaattccaactgaccttctacagaaaagtgcttgactgccaagtggtcttcccagtcactgatggaggatcactttggtacccctgccaatgggctcaccatgatcagcatgcacagtgaaggaacctccagcagaagactcccaagcatactgttcatcatcgttgtgctttgtgatcacaaccagtttctctgccaccaggtaggcagaaaaaagccaacaccaaactgcccaatcatggagatgtctgcaccagcctgaagagcctccatgcatgctttagtaccagacttggcaatggttctcaaattatttatgagatcagctttggtcatgccaatgcctgtgtctaccaaagccagggtacgttcctgagggttggggatgatgtcaattttcagctctttaccactgtccaactttgaagggtctgtcaggctctcatagcgaatcttgtccaaggcatcagaagcattagagatcaactcctgaaggaaaatctcctcgttggaatagaaggtattgatgatgagggatatgagttgggcaatttctgcctgaaaggcaaaagtctccacctcctcctctccatggtgcacttcctcaggcatcttgaaaagaaaaggcttacacgtactggagagcaatgtgagcttgctttctgatacccaggcagcaccaacgctgtgctggagtgacttgagagcatctttaatccatcttgagttaatttttgtataaggtgtaaggaagg

SEQ ID NO: 1714 - DNA, 415 bp, Homo sapiens
agagaattaaacaccatttgtagaacatctcctggattgctccttagccataatagagatgaagagaatacagcttgttggcatcagccgtgaagatgcatgacagttttatgagaaggctgatgaataagggtctgaaaatgatgatgaagagcacagagtgttcaaatcctgcctgtcaatgctaagagccaccatgttgtgaggaagcccaggccacatggagaggccatgccatgtgtacatgttccagctgacagccccagagaaggacacagtgcacagccaggaataatttccaacttatcatcatgtccagaactcaacgaacaatgtcaagtaacaatgatgatagaagaatcagactcttggtttttaaagacctatgggaaacgtcatttgaatacaccaagcc

SEQ ID NO: 1715 - DNA, 782 bp, Homo sapiens
ctccaggtggagaagttgaaaagcagctggagagttggagagagagtctctgcctcaaagaaaaaaaaaaggaaagaaagaagaaagaaagaaaagaaagaaagagagaaagaaaggaaggaaagaatggaacacaaaagagggctcagagtgaagatatggattgatcagatgactgagactagaaatgtgaccagtggaacaaaacagagacctcagaaatgacaccacacatctacaacgatctgatctttgacaaacctgacaaaaaacaagcaatggggaaaggattacctatttaataaatggtgttgggaaaactgaatagccatatgcagaaagctgaaactggatcccttccttgcaccttatataaaaattaactcaacatggattaaagacttaaaagtaagacctaaaaccataaaaaccctagaagaaaacccgggaaataccattcaggacataggcatgggcaaagacttcatgtctaaaacaccaaaagcaatggcaacgaaagccaaaatagacaaatggggtctaattaaactacagagttctgcacagcaaaagaaactaccatcagaatgaacaggcaacagaatgggagaaaatctttgcaatctatccatctgacaaacggctaatatccagaatctacaaagaactcaaacaaatttacaataaaaaaaacaaccccaccaaaaagtgggcaaaggatatgaacagacacttctcaaaagaagacatttatgcagccaacaaacatatgaaacaagctc

SEQ ID NO: 1716 - DNA, 323 bp, Homo sapiens
atgttattcttcttttacagctaaagaaaccggctcagagaatgttatttgattggaccgtgttgcatctctggacagtgcagctgagatcagactttgtgtgtaactccactagcctaccagggtgcctctcataaagctacccttcttcggctggcaacacacaggacctggcggggaggtcgctcttaccagtccccactctgacgagaagactgcccagctccaggcaccgtagggccccagtgacgtagccgaacacccacgcctctgacgtcgccagaggcccacctctatggtgtcggcgaaggcgcgccattgtg

SEQ ID NO: 1717 - DNA, 935 bp, Homo sapiens
cccttcatattcatacataggcttgaaagtctatagaattgagaacgatataaagaattctattacaagaatacactccattgatgacagaacattcccatgtcataaagcaaaagcattgagtttaaggctgtaaaggttgagaaatttgcactgatacttaagttctgaactccagagggctgctaatcagagctgggatcattttgcaagacagccttactttttccaaagtaatttatatttagttgttgataaccaaaaaaatgtcacaagagtaatacctactgtaaaagtgaggttagaagattccctgggtcttgtgacctaggttaaatgaagtatataactacaatagattttgtttttgttttgcttttggaagttctgtgcaaaagctaccattcacaggattaacgaatacctttacatatgctagttttttaagtgtctgtttgatttgcaaaattagtttagctacataaatcctgtcccttaagccatagttcacagatgtaaaactgcagtttttatagattcagtagaagagttttttttaaccctaaaggtgaaatacagaaattggataagtcatttttaaggaaattgttacattcagaaataaccttggaaagttcaccaatgattccttctggcataaaaactctagtcataatctggtcccgcattgagaaatccattccagtttatagtgcaagaccatggaagcgggtatccacctgcccaccattactgtaagtatcgatagactttgaaacagtgatttccagagtctgcaaccacaacatgaccatctgaagttagggccaggccttgggggccatagagtgggtcagcagatgtgttaatgtaggacaaaaatgatccactcccatcaaaaacctgtaaacaaataggaagtcagaatgttatag

SEQ ID NO: 1718 - DNA, 8636 bp, Homo sapiens
tatgaacataaaaggtagattattaacattaaggcagttgaattttaaaagcttgttttcttcccttatacatattcctaaccgtggagacagctaggttctgtggcaatgaagaaaattgatcaatgactgtttttggtattactttgggaagtagggatggaataggggcaagggaagggcttagcttcaaactgtagacagaagtgggaagcccaaatctttgcatggtgagaagtgggatggaatgtaggtgctagagatggtgcaccagtagggactgtcactggattggggaaaaaaatccggggctgtccttatctgctcccttaggcaaaatcgttctgtgttagtctggagggtgaacctattttaatgcaggagggcatagacttttgggtggaagcggaccctggagatgtactggcaggtgaatagagtgtggaaaagtggggaaaggagaagcacgattcatgagcctgagttcgggcttccatggatggaaaagcatcaggagtggaatttaaagacggtgtgtttcaggtgatgtgaggtcctggatgcccgaagcttcaagaaaatactggttgggcacttagctttccctgtggttgccaatcccacgcaggccgcctctagcgtctcgattcgcttttctctgacctggaacctccgccaagcccccagctctcttcttcgacccagccttgcacggggcagctgtcggggcaggacccgcctctggcctgtcgcagcctagctcacggtcaagggcgggagcctgctgggaagcacggccgcgggggctcgctcggggccacctgcctggaactcagcgcgaggtccagagttccctccggctgcgcagcggcgcacgtgccccgtggaaggggcggttcccgcaccccagaaggagggggcgcccggccgcgcggactttcccttttgcttacttcctagtcccgggcaggccggctcggaggcagcgagaaagcgcagccaggcggctgctcggcgttctctcaggtgactgctcggagttctcccaggatccaaaggagacctatagtgactcccaggagctcttagtgaccaagtgaaggtacctgtggggctcattgtgcccattgctctttcactgctttcaactggtagttgtgggtaagttcctgctcagacttgagcactatacatttgcattttcagctctctgactttatttgagcaattctttgatggattggctccagaattggattggattcagtgaagaaactgaaactggactggtgctctaggaggcctcaagtagataaggttactagaagacagggaatcctgggcttatctggatttaaggagtctacaactccatctgcaactccagccgatttcatttataagaattatggaccaagaacctgtgcttttctagagaaatgtgtgagccttactaaaggtaacttagaattacaatggactgctgagaccagctcggtcgtggagaccctaacccagcagcgctagaggaatcaaagacacacacacagaaatgtagagtgtggagtgggaaatcaggggactcacagccttcagagctgagagcccctaacagagatttacccacatatttactgacagcaagccagtgataagcattatcgctatagattatagattaactaaaagtattccttacaggaaacaaagggatgggccgaaacaaagggataggctctggctagatgtctgcagcaggaacacgtccttaaggcacagattgctcatgctattgttgtggcttaggaacacgttaagcggttttctgccctgggtgggccaggtgttccttgccctcattccagtaaacccacaaccttcagcgtgggcgtcatggctgtcacaaacatgtcacagtgctgcagagattttgtttatggccaaatctggggctagtttatggccaggtttgggagcctgttcccacatgtcccccttttttgttttgcaaagcaataaaagcaaaggcagctttgtcacagtgagctacttcttgcaggagtcgggattcgcatatgcatactatacaaagacaaacaacacagattaaaagcacaaccatcattgaaatcacagagcttccaagtgtctttatctattttaatgggttaatcactgctaatctgtctgcagctccttcaagcactccagttcctggcattaaggtctggtgtgcctggaatgctttaaatatttgttcttttaatattgcaatatggaaagacaagtttgtagagtgtcttctaggtgcttttttattctttcctgaatttggtcttatttaagagccattaatagtttccacaaatccttatgtttagctcctacagcgggccatatcatttgagggtgaggtgccactataccatcatgtttccagataataggaactcttgccatatttcttgctatttctaccatctgaccattttgtttagaccagctaaacatagtgtggccatggcacgcagactgagaggtgcaatttaagctaaacatccccttaggggaccaatcaataatgattccataggaatcactgcgcagcacctctgcctattctgcaatgcaatcttcccaaacaagtatgttcattatttctggccaggtccaattctgtttacaaataggtttttgagggcaatatgcctcaattatagaaacagatttattatggtaaatactgagatcagaaagcatgtgtaactgtgtcatagaatgattacatccaggcattattgccagccaagattgataaatatgcccaataagtataattgttctctgtgttagcccttgttgaaggaatactaatggcaatggtgatcactgctatcatagctatcattaaattactcattgtgactggttgtcccactttcctcaggttttcttccaccctctatggcagtttcttgatctgtccccaggtagatggctgtgtttgatggttgttgctcgtgatagtttgggtcctcctcagcatcagtctcgacatggctgcaaccagagggtcctcgggatcctcccagaatctcttccttggcatctggctcatgataaggtttcaggtgtcttgatggtatccaaatcagctattgattctggcctggagaaacacaagcataacctctaccccaagttattattttacctatttcccaactttttgttgtcagatctctgcaccaagccagttgttctgcttctgtttttgcagctggtttctgtagatgctcttcagctgctgatagcatctggcctttaggcaggctcaaaaaatttaaagtcattaatgctagattcagttgtatatggggtgtcctgtaatccctgtttcccctttttgcttttgcaactgctgtttcagggagagattcattctttctacaatggtttgtccttgagaattatatgggatgccagtaatgtgtttaatattccatatagagaaaaatgtagctagagcttggctagtatagcctggggcattatctgttttaacagaagttggaattcctatcaccacaaaacactgcaaaaggtgatgcttaacacatgcagtctcctgattggcatgtagcccagacaaagtgagaaaaggtgtccacacatacatgtacataagctagtctcccaaacgagggaacgtgtgacatccatttgctaaagataattaggttccaatcctcgaggattaactcctcctgttaaagatgaggaatgcaccatttggcaagttgggcatcactggataatagctttagcttctttccaggtactgttatatctgcatttgagaccagaggcattaacatgggttaaattgtgaaagtgtctagcattagatattgcagtagcaactaggcgatcagccatttgattcccttcagttaaaggtcctggaagaggtgtatgagccctaatgtgagtgatgtaaaaagggtgcattctactcctaaatgctgtttgcaattgggtaaataaagtcatcagttgttcatctgtatgaagtcataactgagcattttcaattaattgtatggaatgaaccacataggaagaatcagaaatcacattaataggcatatcaaaagcagtcaatacctcaattacagctaaagctccactttttgagctgaagtatagggcgtgtgaaaaactttaccttttgatccagaataagaggctttaccattacaagacccatctgtaaaaacattctcagcaccttcagttggtttaaatttagttattttggggagaatccaattagttaatttcaaaaattgaaataatttcattttaggaaaatgattatcaagaatacccacaaagtcagctaaatgggtttgccaagtaagactatttatagaagcttgctgtatttgtgcctttgtgagagggacaataatttttccaggatcatatccatgtaatttaacaatccgaattctcccatttcttatcatcgtagccatttgatccaaataaggagttagagtctgtgaattagtatgtggaagaaaaagccactgtacaaagtcttgctcttatacaataacaccagtaagtgaatgctgagttggaaaaattagcaaatctagggtcttttttggatctattctatttatttgagatttatggatttgctttttgattagctgcagctctgcctcagcttcttttgttaattgctgagggctaatgagactaggatctcctctaaggatagaaaatagattactcagggcataggtgggaatgcctagagcaggtcatatccgattaatgtcccctagtaatttttgaaagtcatttaatgttttcaattgatccctacgtatagttactttctgtggcacaatggtagtgtcatttactaaggtccccaagtaggagtaaggagtagtagtctgaattttgtcaggagctatataattaaactggcatgagaaatcgagttttgcaagtgatcataacattggagtaatatttcttgagtgggggcagcacaaagtatattatccatataatgaataatgtaacactgtgaaaattttttacgagtaggttcaattgcttgcccttcataagtctggcaaatttttgaactgtttcacatgccttgtagcaacactttccaatacaaatgctttagtatgctgcaggttttttactgcaggaattgtaaatgcaaacagttcacagccttgctcagctaaggggatagtaaagaaacagtcttttaaatttatgactattaaaggccaattttttggaatcatagcagaagaaggcagtcccggctgcaatgtccccataggttgtataactgaattaatggctcttaagtcagttaacattctgcatttacctgattttttcttaattacaaaaactggagaattccaaggggaaaatgttgagctatgtgtcctttttctaattgttcagcaactaagtcctctaaagcctccagtttctctttactcagcagccattgtgctatccaaattggcttatctgttaaccattttaaaggtatataggttctggaggcttaacaatggccaccatcaaaaatgatatcctaaaccttggtgggaactttgtctttccgcttgaagcatttccttcaaagcttgcaaattttttcctagtcccataccagggacataccccatttcatgcatcatatgttgactttgagggctgtataattattctggaattagaacttgtgatccccattgttgtaataaatctcttccctataaatttataggtacagaagttataattttttgtatagtcccaggttgtccattgggcccttcacaatgcaaaatataactactttgatatactttaagggctttaccaactccaactatgttaaattgagcaggttgaattgaccatgcagatggccagtgctgtacagaaatgattgaaatgtccgctcctgtatctaccaaacttttaaatttctttccctgaatagttatttcaccagtaggatgtttatcagtaatttgattcacccaataagctgctttgccttgtttatttgtgcttccaaatcttcctgttcatttaatttcacttttccccatttccacatatggcataatcaggagctgtgctatatgctctcctggctctgctttccagggaacagaagtagatataacaatttgaatttcccctttgtaatctgaatcaatgactcctgtttgtacttgcacgccttttaaatttaaactagacctacctagaagtaatcctaccatccccgctggcatcatctgactggagacagcaaccttctttaacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcaccctctcttctaacttgctgaattcctggctgaatagaactgagagtggtcgctcgaggtgctgctcagtcactggggcgactactttttgcccagtgtcctctggaaaagaaagatctggaggatcaggctactcttttgcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtggaatgagctagagcccacacttgcccattgttaccctgatgcttccgagctccccttcttactcaccatggggattgcttaagagtactcgggtatcctccagctttgttccacgttttccaaccattgctccagcgagccttcatcctgggtttgagtccccacgttgggcgccacttgccgagaccagctcggtcgtggagaccctaacccagcagtgctagaggaattaaagacacacacacagaaacatagagtgtggagtgggaaatcaggggattcacagccttcagagctgagagccctgaacagagatttacccacgtatttattgacagcaagccggtgataagcattatttctgtagattatagattaactaaaagtattccttacaggaaacaaagggatgggccaaaacaaagcgatgggctctggctagatatctgcagcaggaacacgtccttaaggcacagatcgctcatgctattgtttgtggcttaggaatgccttaagtggttttccatcttgggtggaccaggtgttccttgccctcattccagtaaacccacaaccttcagtgtgggcgtcatggccatcacaaacatgtcacagtgctgcagagattttgtttatggcaagatctggggccagtttatggccagatttgagggcctgttcccaacagtggacaaagaagaaaagctgcttaaggcaaacaggcacatattttttaaagctacaatagctagacaaactaagagaatcctgtgtatgttttacttttgtatttttatttttaatatttgtggatacatagtagatgtatatatttatggggcacttgagatattttgatacaggcatacaatggataataataacatcacggtaaaaggggtatccattacctcaagcatttatcctttctttgtgttataaacaatccaattaaaccttttatcataaaatgtacaataatgttgactgtggtcaccctgttttgctatcaaagaataaatcttattcattttatctaagtatatttgtgtacccattaaccatcccagtccccctgctcctccaactacacttcccagcctctgttaaccatcattctactctcttatctccatgagttcaattgttttaatttgtagctcccacaaataagcgagaacatgggatgtttgtctttctgtgccttatttcacttaacataatatcctccagttccatccatgttgttatatgacagaatttcattctttcttatggctgaatagtaccccattgtatatatataccacattttctttatccattcatgtgtaggtggacacttggattgcttctagatcttggctactgtgaatagtgcagcactaaacatgggcgtgcagatatctccttgatatattgatttcctttattttgggtatatacctagcagtgggattgctggattgtgtggtagctctactgttagtcttttgaggaacctccaaattgttctccatagtggttgtactaatttacattcccaaccaacaacagtgtacagggttctgttttctccacatccttgcagcatttttattgcctgtcttttggataaaagccattttaactggggtgaaatgatatctcattgtagttttgattagcatttctctgatgatcattgatgttgagcacctttttatatatctgtttgccattcatgtgccttcttttgagaaatgtctatttagatcttttgcccatttaaaaaattggatt

SEQ ID NO: 1719 - DNA, 7592 bp, Homo sapiens
gtcccgggcaggccggctcggaggcagcgagaaagcgcagccaggcggctgctcggcgttctctcaggtgactgctcggagttctcccagtgtttggtgttgcaagcaggatccaaaggagacctatagtgactcccaggagctcttagtgaccaagtgaagctctctgactttatttgagcaattctttgatggattggctccagaattggattggattcagtgaagaaactgaaactggactggtgctctaggaggcctcaagtagataaggttactagaagacagggaatcctgggcttatctggatttaaggagtctacaactccatctgcaactccagccgatttcatttataagaattatggaccaagaacctgtgcttttctagagaaatgtgtgagccttactaaaggtaacttagaattacaatggactgctgagaccagctcggtcgtggagaccctaacccagcagcgctagaggaatcaaagacacacacacagaaatgtagagtgtggagtgggaaatcaggggactcacagccttcagagctgagagcccctaacagagatttacccacatatttactgacagcaagccagtgataagcattatcgctatagattatagattaactaaaagtattccttacaggaaacaaagggatgggccgaaacaaagggataggctctggctagatgtctgcagcaggaacacgtccttaaggcacagattgctcatgctattgttgtggcttaggaacacgttaagcggttttctgccctgggtgggccaggtgttccttgccctcattccagtaaacccacaaccttcagcgtgggcgtcatggctgtcacaaacatgtcacagtgctgcagagattttgtttatggccaaatctggggctagtttatggccaggtttgggagcctgttcccacatgtcccccttttttgttttgcaaagcaataaaagcaaaggcagctttgtcacagtgagctacttcttgcaggagtcgggattcgcatatgcatactatacaaagacaaacaacacagattaaaagcacaaccatcattgaaatcacagagcttccaagtgtctttatctattttaatgggttaatcactgctaatctgtctgcagctccttcaagcactccagttcctggcattaaggtctggtgtgcctggaatgctttaaatatttgttcttttaatattgcaatatggaaagacaagtttgtagagtgtcttctaggtgcttttttattctttcctgaatttggtcttatttaagagccattaatagtttccacaaatccttatgtttagctcctacagcgggccatatcatttgagggtgaggtgccactataccatcatgtttccagataataggaactcttgccatatttcttgctatttctaccatctgaccattttgtttagaccagctaaacatagtgtggccatggcacgcagactgagaggtgcaatttaagctaaacatccccttaggggaccaatcaataatgattccataggaatcactgcgcagcacctctgcctattctgcaatgcaatcttcccaaacaagtatgttcattatttctggccaggtccaattctgtttacaaataggtttttgagggcaatatgcctcaattatagaaacagatttattatggtaaatactgagatcagaaagcatgtgtaactgtgtcatagaatgattacatccaggcattattgccagccaagattgataaatatgcccaataagtataattgttctctgtgttagcccttgttgaaggaatactaatggcaatggtgatcactgctatcatagctatcattaaattactcattgtgactggttgtcccactttcctcaggttttcttccaccctctatggcagtttcttgatctgtccccaggtagatggctgtgtttgatggttgttgctcgtgatagtttgggtcctcctcagcatcagtctcgacatggctgcaaccagagggtcctcgggatcctcccagaatctcttccttggcatctggctcatgataaggtttcaggtgtcttgatggtatccaaatcagctattgattctggcctggagaaacacaagcataacctctaccccaagttattattttacctatttcccaactttttgttgtcagatctctgcaccaagccagttgttctgcttctgtttttgcagctggtttctgtagatgctcttcagctgctgatagcatctggcctttaggcaggctcaaaaaatttaaagtcattaatgctagattcagttgtatatggggtgtcctgtaatccctgtttcccctttttgcttttgcaactgctgtttcagggagagattcattctttctacaatggtttgtccttgagaattatatgggatgccagtaatgtgtttaatattccatatagagaaaaatgtagctagagcttggctagtatagcctggggcattatctgttttaacagaagttggaattcctatcaccacaaaacactgcaaaaggtgatgcttaacacatgcagtctcctgattggcatgtagcccagacaaagtgagaaaaggtgtccacacatacatgtacataagctagtctcccaaacgagggaacgtgtgacatccatttgctaaagataattaggttccaatcctcgaggattaactcctcctgttaaagatgaggaatgcaccatttggcaagttgggcatcactggataatagctttagcttctttccaggtactgttatatctgcatttgagaccagaggcattaacatgggttaaattgtgaaagtgtctagcattagatattgcagtagcaactaggcgatcagccatttgattcccttcagttaaaggtcctggaagaggtgtatgagccctaatgtgagtgatgtaaaaagggtgcattctactcctaaatgctgtttgcaattgggtaaataaagtcatcagttgttcatctgtatgaagtcataactgagcattttcaattaattgtatggaatgaaccacataggaagaatcagaaatcacattaataggcatatcaaaagcagtcaatacctcaattacagctaaagctccactttttgagctgaagtatagggcgtgtgaaaaactttaccttttgatccagaataagaggctttaccattacaagacccatctgtaaaaacattctcagcaccttcagttggtttaaatttagttattttggggagaatccaattagttaatttcaaaaattgaaataatttcattttaggaaaatgattatcaagaatacccacaaagtcagctaaatgggtttgccaagtaagactatttatagaagcttgctgtatttgtgcctttgtgagagggacaataatttttccaggatcatatccatgtaatttaacaatccgaattctcccatttcttatcatcgtagccatttgatccaaataaggagttagagtctgtgaattagtatgtggaagaaaaagccactgtacaaagtcttgctcttatacaataacaccagtaagtgaatgctgagttggaaaaattagcaaatctagggtcttttttggatctattctatttatttgagatttatggatttgctttttgattagctgcagctctgcctcagcttcttttgttaattgctgagggctaatgagactaggatctcctctaaggatagaaaatagattactcagggcataggtgggaatgcctagagcaggtcatatccgattaatgtcccctagtaatttttgaaagtcatttaatgttttcaattgatccctacgtatagttactttctgtggcacaatggtagtgtcatttactaaggtccccaagtaggagtaaggagtagtagtctgaattttgtcaggagctatataattaaactggcatgagaaatcgagttttgcaagtgatcataacattggagtaatatttcttgagtgggggcagcacaaagtatattatccatataatgaataatgtaacactgtgaaaattttttacgagtaggttcaattgcttgcccttcataagtctggcaaatttttgaactgtttcacatgccttgtagcaacactttccaatacaaatgctttagtatgctgcaggttttttactgcaggaattgtaaatgcaaacagttcacagccttgctcagctaaggggatagtaaagaaacagtcttttaaatttatgactattaaaggccaattttttggaatcatagcagaagaaggcagtcccggctgcaatgtccccataggttgtataactgaattaatggctcttaagtcagttaacattctgcatttacctgattttttcttaattacaaaaactggagaattccaaggggaaaatgttgagctatgtgtcctttttctaattgttcagcaactaagtcctctaaagcctccagtttctctttactcagcagccattgtgctatccaaattggcttatctgttaaccattttaaaggtatataggttctggaggcttaacaatggccaccatcaaaaatgatatcctaaaccttggtgggaactttgtctttccgcttgaagcatttccttcaaagcttgcaaattttttcctagtcccataccagggacataccccatttcatgcatcatatgttgactttgagggctgtataattattctggaattagaacttgtgatccccattgttgtaataaatctcttccctataaatttataggtacagaagttataattttttgtatagtcccaggttgtccattgggcccttcacaatgcaaaatataactactttgatatactttaagggctttaccaactccaactatgttaaattgagcaggttgaattgaccatgcagatggccagtgctgtacagaaatgattgaaatgtccgctcctgtatctaccaaacttttaaatttctttccctgaatagttatttcaccagtaggatgtttatcagtaatttgattcacccaataagctgctttgccttgtttatttgtgcttccaaatcttcctgttcatttaatttcacttttccccatttccacatatggcataatcaggagctgtgctatatgctctcctggctctgctttccagggaacagaagtagatataacaatttgaatttcccctttgtaatctgaatcaatgactcctgtttgtacttgcacgccttttaaatttaaactagacctacctagaagtaatcctaccatccccgctggcatcatctgactggagacagcaaccttctttaacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcaccctctcttctaacttgctgaattcctggctgaatagaactgagagtggtcgctcgaggtgctgctcagtcactggggcgactactttttgcccagtgtcctctggaaaagaaagatctggaggatcaggctactcttttgcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtggaatgagctagagcccacacttgcccattgttaccctgatgcttccgagctccccttcttactcaccatggggattgcttaagagtactcgggtatcctccagctttgttccacgttttccaaccattgctccagcgagccttcatcctgggtttgagtccccacgttgggcgccacttgccgagaccagctcggtcgtggagaccctaacccagcagtgctagaggaattaaagacacacacacagaaacatagagtgtggagtgggaaatcaggggattcacagccttcagagctgagagccctgaacagagatttacccacgtatttattgacagcaagccggtgataagcattatttctgtagattatagattaactaaaagtattccttacaggaaacaaagggatgggccaaaacaaagcgatgggctctggctagatatctgcagcaggaacacgtccttaaggcacagatcgctcatgctattgtttgtggcttaggaatgccttaagtggttttccatcttgggtggaccaggtgttccttgccctcattccagtaaacccacaaccttcagtgtgggcgtcatggccatcacaaacatgtcacagtgctgcagagattttgtttatggcaagatctggggccagtttatggccagatttgagggcctgttcccaacagtggacaaagaagaaaagctgcttaaggcaaacaggcacatattttttaaagctacaatagctagacaaactaagagaatcctgtgtatgttttacttttgtatttttatttttaatatttgtggatacatagtagatgtatatatttatggggcacttgagatattttgatacaggcatacaatggataataataacatcacggtaaaaggggtatccattacctcaagcatttatcctttctttgtgttataaacaatccaattaaaccttttatcataaaatgtacaataatgttgactgtggtcaccctgttttgctatcaaagaataaatcttattcattttatctaagtatatttgtgtacccattaaccatcccagtccccctgctcctccaactacacttcccagcctctgttaaccatcattctactctcttatctccatgagttcaattgttttaatttgtagctcccacaaataagcgagaacatgggatgtttgtctttctgtgccttatttcacttaacataatatcctccagttccatccatgttgttatatgacagaatttcattctttcttatggctgaatagtaccccattgtatatatataccacattttctttatccattcatgtgtaggtggacacttggattgcttctagatcttggctactgtgaatagtgcagcactaaacatgggcgtgcagatatctccttgatatattgatttcctttattttgggtatatacctagcagtgggattgctggattgtgtggtagctctactgttagtcttttgaggaacctccaaattgttctccatagtggttgtactaatttacattcccaaccaacaacagtgtacagggttctgttttctccacatccttgcagcatttttattgcctgtcttttggataaaagccattttaactggggtgaaatgatatctcattgtagttttgattagcatttctctgatgatcattgatgttgagcacctttttatatatctgtttgccattcatgtgccttcttttgagaaatgtctatttagatcttttgcccatttaaaaaattggatt

SEQ ID NO: 1720 - DNA, 584 bp, Homo sapiens
ttatttcttccttcctaatcagcatactatttatttccttgtcttgtgttatttcattagctagaccttcccacaggtctagctttgttgaaaagcagtgctgaaaaatgatatctttgttcctgatctcagcagaaaaatttgtttctcttgactattatgtgagctgtagggtttcatgaatattctttatcaagtttatgaagctccccttgattcctagcttactgagagtttttatcatgaatgggttttggattttgtcaaattctttcatctattgatatgattttgtgatttttctcttttagcctgtcaatgtgatagattacattaattgattttcatgggttgaaccagccttgcatatctggaataaatcccacttagttgtgaggtgttcgccgtgaccgttacaatgaagaggaaagagatcatcccctttctactcctacatccccaagtgaagaggacatggagtacagccacagccacacttaaagggcatgtaacatgaacaaaaataaatgtttgttgtaagcaattacaattcatgatgcatttatttctatataataacctgg

SEQ ID NO: 1721 - DNA, 728 bp, Homo sapiens
cttttgggaaaattattttgaagcctgtagtgctttacttatagagagttttatattttaaaaacacctgctataatattttacaaaaaatgatttattatggaaataacttacatgtaccttttgataattataaggacattaaagtcgcaaagtgatctgtgaatgttcctaccttgtcttttttttcccccaatagttgttgctcattgttttggttctccatcttccttccaattctctaataatcctttaggatcagtacctaatcccagcaaacaaaaatattcaacaagtctctgcgaattacgatgaagaaaagatgaattttaattaaaaagaggtgactaaaatgtaaagagatgagtgggaggacttgccacagaagcaacaaagaccgagaaggcaatacactttgtgataccatttccttactttgggcagcagagcaattcgctgaagttgcagtaacagatcatctcacatcccttcccatcccagaaatgatcctggacattgacatcaatctgtgtcaggtcagctactccttccggaaggttgtgacagttgtgatcttttagtatctttctgtagcaagagaggcgatttgcaggcatggcttgaactcctagcagcaaagttagcccaatggtgaaaacaagtaccatcagtttcattttggcttttggccctgaaatagaagaaagaccaaaatgtgtcaatgtttg

SEQ ID NO: 1722 - DNA, 815 bp, Homo sapiens
ctcctaccatgatggggaactcattattaactaagtcaacatatcccattgatacagttctaacatttcccttattgtaaaatacttttctgtggcttccacccactaatcctagtttgaaccctgaagtcataccaacaattctaatttctcttccaggagataatttttcaagtacaggatttgcatagaagtatagaatattaaatatctatctaattagacttctctggtttctacattagatgtgaagaaaatggagactattgtagtaaaggaagaatagcaaaatagtggaggaaccaggattagaatccagagccattcagattttatcttgttaacaggtgccaaagtatctttccttccttggaaagagggaaaacagatggaggacattgtacttggaaagaaaacaatattgtggaatagccagacgtggtggctcacacctgtaatcccagcactttgggaggccaaacccggcagatcacctgaggcttgactccttctgggctcaccaaggctggcagtatggggagaagcagcagctggtttcggccttcacagctcacatcttcccaggagagaggtcctgagttattgccctaatcttctcaaagctgtttcacagacacaagcatctggatctcattctgtagcccaggatgaagagcagtggcataatcatagcccacttcagctttgacctctcagtctcaagtgatagtccccccacagcctcctgagtagctgggaccacaggcatgcaccaccatacccaggtaattttttaattttttggtagaaacagg

SEQ ID NO: 1723 - DNA, 433 bp, Homo sapiens
ggccactaaactgaccataaacaaaatctctgcagcactgtggcatgttcatgatggccatgacacccatgctgaaggttgtgggtttactggaatgagggcaaggaacacctggcccacccagggcagaaaactgcttaaaggcattcttaaaccacaagcaatagcatgagcgatctgtgccttaaggacatgttcctgctgcagataactagccagacccatccctttatttcagcccatccctttctttcccataaggaatacttttagttaatctagaatctatagaaacaatgtttatcactggcttgctgtcaataaatatgtgggtaaatctctgtccgaggctctcagctttgaaggctgtgagacccctgatttcccactccacatgctatatttctgtatgtgtgtctttataattcctcta

SEQ ID NO: 1724 - DNA, 651 bp, Homo sapiens
ggagcccgcggccagggctggactctcgccccgccacctccaccgactctctcctcagcctccgcgcctggcaccgcagcaagacttgaatgaagtgatcatgtaaactagagaaaggagattaaaaataacctctggatattcctctcatgtgatctttattctggatgaagcattaggacagctaatagccgtgtgtcactgtaagtattgtgtaatgaacttagaatgtttatttttttgttgctgcataacctcgtatgttgtacactttcacagaatttaagaatagtagatgtagtgtagtagcagtaatgggcagaacaataaaaactaaaatactaagtggcagggatagcaacacagaaggggaaaattattctggttatagaatcccttaaattgagtaaatatttgatataaacaaaagtgaaggacaaaatgataattatttatgatatcaaagtgatctttgctagaatatacttgagagtgtgacagctttctgatgaggaagtaaactaattgtaaagctatgctgagaagaatcataatcttactatgaataagaaatgcgttacgagttacaggatttgaaaaataacagaatgagaagcttttacaagccaggctattttaattttggtgacg

SEQ ID NO: 1725 - DNA, 484 bp, Homo sapiens
aagtgatcatgtaaactagagaaaggagattaaaaataacctctggatattcctctcatgtgatctttattctggatgaagcattaggacagctaatagccgtgtgtcacttaaaaatccaacttgagaactgtcaccaaagatgtctaggaactttgaagaaacatgaaggtttgtcctcattctgtcctaagttgaaatgagatttagaaaagagtctaagtgaacatttcccaacccaattcctgtagcactcgatgaaatacacagctatcctatttctctctattgaaattacatataccctaaaacagtttgagaatttatcacgcaccaggcttaccaagtactttatagaaaccatatatgctcttttattccttacaagagccccatgagaaagattctgttatatcattctttgtaatacctttgaggacatgaggaacaaagaagttaaatgacatgaaattcccacaaccag

SEQ ID NO: 1726 - DNA, 734 bp, Homo sapiens
cccaaatagctgggattatagcaggatgggctgcaggcaaaactcctcagacaccggctgaaagagggaagaggctttatttagctgggaaccttggcagacttgcatctcaagaaccaagctccctgaagaaaaaattcctggcctttttgagaggtgaagcgagctggacttcctgggttgagtggggacttgcagaacttttctgtctagctagaggattgcaaacgcaccagtcagcactctgtgtctagctaaaggattgtaaacacaccaatcagcactgtgtaaaaatgcaccagtcagcgctctgtgtctagctaaaggactgtagacgcaccaatcagcactctgtaaaaatgcaccaatcagcactctgtgtctagctaaaggattgtaaacgcaccaatcagcactctataaaagcgcaccaatcagcgcactgtgtctagctaaaggattgtaaacgcaccaatcagcattctgtgtctagctaaaggattgtaaacgcaccaatcagcactctgtaaaaatgcaccaatcagcacttggcatctagctaaaggattgtaagtgcaccaatcaacactccgcaaaaacacaccaatcatcactctgtgtctaactaagggattaaatgcaccaatcagaactctgtaaaaatgcaccagtcagcactctgtaaaatggaccaatcagcactctgtaaaatggaccaatcagcaggacatggg

SEQ ID NO: 1727 - DNA, 694 bp, Homo sapiens
cccgaagtgctaggattacaggttcttctaaggaactattctttttgtgaggaactttctatggaagctggttggcccacagcttttgcagatgatctgctgccctgagtacactctaatgaccaagaccacaagtgggcccctaactcatctagggtacgtactgtatcgtatatgcatttttttaattcttaagatttcctcaaaagtcctggacgctcagaaggtattaataaatgccaccatacgatagccaagttttctttctcttgggaatctgaactgagaggtgcagagttagccaggcagccaggagcaggaaatgcagttggaatgaggcatacactgggcagctgaggaagaacaggaaaaagtgacacacaagctgaaacagtgaggatacagagggtatgaggtggagcagacagagtaaaagttaagaacaggccagttaggatcacaagcatacacagaaagcaatagcaatgccaccaaggtatccacggagtccttgagagagactgaagacacctgctagtcacagggctgctgtttctaagaggcccagctctattggtattcctaatcttggatgccttataaggtcctttctcactggcctccatgtatccttaaagtaacccttccaccaccctccgccaattcactcttatttgagctacctttagggagg

SEQ ID NO: 1728 - DNA, 1651 bp, Homo sapiens
gcgaggagtgaagaggagaaactgaggcaggtcagagggaggccagcaggcgatttcagacctggcggaagagaatgtgcgtgagcagagatgcggacgggtgggagtcacgacgcgtgagaacggtccggcccgcggcccctgcgcccctgctgggcaggcaccacctgtgctaggctcagcccctctcagcacagcaagcagcatgagatggcacgcatgagagcacggtgggggccgtgggggagagggcagaaaggaacaggggtcaggccatcgccggatctactgaagacagacactgccttcaaacgttctgaggaaaaatgcttcaggctgggacttggatacccacgtccactgtcccactcaggctgaggggagcaaggccacctgcagtgggtgtgacctcagagacgtggccacaccccctgcggaggtgcttggtgactgggcttcccaggaagacgagggtgacagccgtcaacagccgagaagaagtagtagatgcaggaacccatggccgtcacacgggagtgagtccacgggcgcttgggagggctgagaaccaggcccaggcagttccggagggaaaagtggaacccgtcccaactcagccccagcctttctgcaccaaggggtggagcagtgccgacctcagacgccagctgccagaaatgcttccaaagcccgcctctgcgtggggtgtgtgctgaggggtctcacgtggggactcgcctcagagcccatctgagcttcactgttctaggttcttgtagttttgttttacctcaaacatgcattagcttaacaaaatattttttaaaaggtttttaaactaaaaatgacaatgaattaggcacgacgtgccgctgtgggaagtcagccaggctgctgctgggtctggaggagcaggacacgggccacagacacggagcaggagtggaggagatgggagccacactgtctggatcgcttcattagacccacgtgctgtttccacaatgacggtaataagaatacatttaattttgagagaacatggaggtgtcagacggacaacgagcctgggtgggcgcctctcccttggcgctctccaccgagcatggcatgctgctgtgccagctgcttctccttggatgggcagaggccaggtgtcctccactttcccagtttctgggcacagcacacctgagccctgggtgcagaccctcacaccatttcccccagaggctctgctctttcaccgtgagggaaaagaaggttgtgtagcagaagagactccaggaagacaaactgctcacctggggtcaaaggacaagctcccaggcgtgtacccaccatctccacgcgtgtgccctgagcccccagggggtcaccctgcactcccaggcctgtgcccaccatcccacatgtgcccagcactcccaggcctgtgcccgccatcccagttgtgcctgtactcccaggcctgtgtcttgcatccagatgtgcacctgcaccctctcccactggccggcacctccctggtaggagggacgtgccaagccctgacctgacccaggtgcctgctcacagcacatgccccttccctggccaaaccccacgggagcccaagtggggcctggccaggaactgcttggaggctgag

SEQ ID NO: 1729 - DNA, 4484 bp, Homo sapiens
cccaggacaactggagccaccagaagctagaagaggcagggagcgtcccaccaagcctccagaggaagctgactcatgagatgcctggacgctgggcttctggtctccaggaggatgggggaatgcgtccctgttgtgttaaccccggactgtgtcaattgtcagaagcctctggacacagtgacacagcgggtgggaccagaggctcagcacccctcatggggaacaaagtctttgaggccctcaggtggcactgagagaccacagggggctccagaggcccttgggggtccacctaagccaggatgggtgttaggccagggctgccaacagcacctgccttctgagacacatccagcctctggttgcccatttttaggtggagaaaatgaaggctgcatacgtggctggtgtgaggaagtcagctgacgggaatttgctgatttaagggaaggttcagctgcgtctgcatgctaaagggctgtcctccagatcagatctagaagctttgggaaggtaatgcaaaagaatttctgatgttcttggcgtgggggaaatttgttacacggacacagaaagccttgtcctgcaggaaaagattcttagaaggcaccagattaaaagaaagaacttctgttcgttgaaaaaatatcatcaagagagtgaaaaagcaaaccccagggtaggagatgtttgctatgcacaacaaatgttggcttgtctccagaatatataaagaacctctacaaatcgataggaactcaatccacaaagggcagctgacttgaacaggcccctcggggacgagggtatccaagtgcccagtgctcggtgggaagcactcagcttcgttagtatgaccaggaaaatgcaaatcataaggcttccacacagccttacaaaaggctaagacattgcaaaggctgacagtggctagtgccggcaaggatgtgggtcaacaggaaactgtgggggcgaatggctttaatccctttgggaaactgcttggcatcatctgatgaacgaaaagacacactagatcccagactcaacggctccacttccagattgacccaagagactcatgaccacatgccccaaagaacatcccaggaatgcccacgacagcttcatccctagttgccaagaaaggggaaccgcgtggacatgcacctgctgacagtatggtggtctcagggacagcgggcatccccgtgggagtgtgggcggcgctgagcacgagcacctggggctcctcgacgcagtgtggacggaccactcgcgcacagtattgatccacgttagccagcacagcagtgtgcccaccacgtggcttctggttaaaggttaaaaacaggcaaagccaaagcacagtgctcaggaattgcagcttcgacgggaaaacggacggtgagtaagaccccatcccactcccggaacacgaagagaggcggcccagaacggctggcactagaactgcaggtggactgtgccaggtgccaggtggggccctcccagcaggcggcctggggacacgtgggcactggcgaaggtggcaggaacaagcctggtgggaggtgaggctgagatgagcttcaccccagtggctctgtccatggcccaggctcctcaggcactgagaaggcagaggtgccaccccgccgaggggcagaggaaaccggcccttgggcagccttaggagaagcgggggccggtgtgcgcaggagagggtggacgccccagaagcagccacggtggccaggttacctgcgagatgccatgggtgggagatgcaggtggctgtgcagcggtgccctgggctcagggggaggggctgggtcaggtccccggggctggctggggcctggacatggctccctggccctgaggcaccagcagcacttctgagtggggtgggactggcctggtgtgtttctgggcggggatccagtgtgagtgggtgaacagtgagtggcagccatgggcacgctgaggtacgcacacttcacccacctctgtgggccaggaaggcatgtcacatactcctgacaaggcagagggtgctgggagctcgcctgtgtcagacatgagggcccttggaccagggcctgggtttgaagccacctccataccccatacacggtgctcactgctcctggccccattgactgatgactgatggccagagggggacagcagctgtgtgaagtcgcctggcaggtgcggctgttggtggcactccctgggcggaggccacgttggacatttgtgaacaaacgagcaggttggggttacaggttataggatctgggaaatgtggtctgtgatgccatgcgccctgggggatctcatggagcccacatgggcaggcaccttttatcatgccaagaagtcaaacgtgggatgccatgtggggaacatgccctgggtgggggaataccctgggtggagatgccatgtggggaggatgctctgggtggggaatctttgtgggggttgtcctgggtggtggagccttggtgaaggaatggcctagggggtggctctgggagggggtggctctgggatgtggatgtcctgggagggggatgtcaccttagggggaaagcctgttgcagatgccctaggagggaagccctgtgtgagagatcatctgggtgggggctgccccgggtgggggatcatctgagtgggggctgccctgggtgggggatgtccccggtgggggatcatccaggtggcagatcatctgggtgggggatcatctgggtgggggatcatctgggtggaggatcatctgggtgggggatcaactgggtgggggctgccctgggtgggggctgccctgggtggaagatcttatcagggggatgcagtgggttatggccctgtggcaaccccaaacacacacacaccaagaagaagctggtctccctaggaggaggatccacgcagggcagcttggggtttggctcgtggatgctggggacaaggcctgagccccagatgtggctgggcctgacccaggcagctccaccccttccttcccaggaaacaccttttgctcgagcagtaggaactaggcgtgtgtagattctgctgcctgatcctggctcctggctgagggtttgtgggctcagatggactagacacccggccacaaccctcctgggcatagccttctggctcccccagcccaggcggaggcattgagcgactctcctcacccagagtgttttcccgaaggcgcttctgcctgagggcaccaggctgggccaggtactgcagggcgctgaccagcactggcctgggggccccaagagccccagatggcatccctctcacacactccccctgtctcaccaacagctataaatagactcggctctctgctggcacggcctctcccgaggaagcttttaattctctgcgtcctctgcagggggtggctcccacaggcctgggagggaacagactgcctgactctccagagagctccccagtctccatctgcgatgggtgatcctaattttcttcaggaagttctcctgagccctgcgtgtggcgctttggcctttgtgcccacggaagccccctgcggcccctccctccgggccctgcccagcccggtgcacgaaccctgtttaccgattcccaggcctagggcagccactgccagtgtgaggcttgcaaattagggtagggggtcaaaaggaagcccctgttgaccatttctgtgagcattctatgctcatttccacaacgagcatttataacctcgtataatcgctaaaacatttattgcaacttcagggaattcgggaagatagaccaaccgcagctgtaagattaaaacgcagccagtgaccagcggagcttcctccacgcacacgcggtccaatccccatgacttcatgttttgtgaagatgcaaagcgagttcatgccggcgcctttctgaatcagagatccctttagaaaccatgaaagctgcagacccctcccgggaaaacgcacacaccctcctggagctcgccttctgcagccgctccgggagcccgcccctcccccacaggccctccgaggatcacgtggtggggaggcgctggcaccgagcggctgacaggcgcgagagcccagttcaaggcgccggcatcaggctgcagctgcctcactcccctccacttcctgccccttcccggccttggtccagccccatctcctagtcccaggccacagggagctgggtcacctcccaggggcaggggctggctgggcgtggggggagacctctccccctgagaagtcaggcggggaggggtggccggggtgggcggaggggcccagtcctctatcggtcccccaggggccctgcacgcagaagagccaataaacatgccaggtggatcagcggtgacactgagagggaacgcaacaccccatcaaaacagcagccccccaacccccatcaaaacaatagccccc

SEQ ID NO: 1730 - DNA, 10242 bp, Homo sapiens
gtcggggtgtggaaataagggattgggggttcttgccccctagaaaagcgggacttgccgctaagcgtgaaggagaaggggttgaggggtacttgcccctcccccagaaaagcgggacttgccgctgagggtgaaggagaaggggttgaggggtacttgcccctctcccagaaaagcagagaagggatagagacaaggagagaaggggttggggggtacttgcccctctcccagaaaagcagagaagggatagagacaaggagagaaggggttggggtacttgccctttccccagaaaagcagagaagggatagagacaaggagagaaggggttgcggtacttgccctttccccagaaaagcgggacttgctgctaagggtgaaggaccaaggcaggcgtccctgcgtggtctgacacccttgaaacgtgggtgaataatcagagaggcgtccctgcagtgattaaacaccaagggaaggctgccttcccagtctgtgaccggcaccacagttttgggtccacgtataaaacgtgtctcctttgtctctaccagaaaatgaaaggaattaaaattaagagaagggagagattgaagtgtggcgccaagattgaaaggagaaagaggttgagggatagtgagggaagttggagaagagagtaaaaggaggccgcttaccggatttgaaattggtgagatgtttcttgggctggttggtctgaggacctgaggtcataggtggatctttctcatggagcaaagagcaggaggacaggggattgatctgccaagggaggtcccctgatccgagtcacgacaccaaatttcatgcgcgtccgtgtgaagagaccaccaaacaggctttgtgtgaggaataaagctgtgtatttcacctgggtgcaggtgggctgagtccaaaaagagagtcagcaaagggtggtggattgtcattagttcttataggttttgggataggcagtgaagttaagagcaatgttttgtgggcaggggtggctctcacaaagtacattctcaagggtggggagaattacaaagaaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgtgatggcttggcttgggctcagaggcctgacagagaccttgtcagcctggccttcattatgcatatttctatctgtattttggttccaaccacttaataagtcactaagttccaaacttttcccatctttctatcttcatctgagccctccaaagtcttccaacctctgctcactacccagttccaaagctgctaccacattttcaggtatctttatagcaatgtcctgctcctcagtgccagttttctgaatggacccatttttgcattgctataaagaaatacctgaacctgggtaattgctgacaaaagacctgaatccacaggtatatgatgagtaattcatgacaagctgcacgaataaaaataagaaatccaggcctagacacattgtagggtaatggggaacacaaaagaaaatctaactttaaaaacaaccagaaagaaacaacaaatcatccatagaagaaaagcagttagacagcagatgtattaattgtaacaacactagatagacaaataatattcacaaagtgtgacaaaaaaaaaaaaaaaaaaaaaaaaaaaaaacacttttgacctggaattatgtaccagcaacactatctttaggaaaaagagcaaattaatcacatttccagataaatcaaagccaagtttgccaccaacaatcctacactaatgggacttcaaaaaagatgtatttattgagggaaaatgtgtaaagcaaacacagatagagcccacagggaataatttttaaaaattcactatcacttgtggaagttttcagtgcaactctcaattacagttaggtcaatcgtatttttaaaataataaaaacatagatttggacaacaccattaacaggcttgaattatgggatatctgtggaactgcaagctcatttattaatagaaaatgtgcattctccttaggcacacaaggaatattgcccaaaacactgcttactagcctcaacaagtcttaaataacttctacaggatggaccagtgttcccctttacatactttgtctgacaatttttcctgtctgcttttaaaatttctacttatcactgggattgagcgatttgattataatgagacatgatgtaattttcttcaatggtacttgtgcttgaggtacattgaacttcttgcatctgtaggttaatagtttacatcgaattggggaaaaaaaggttgtcattatttttccaaacatcttttttaatgcactaccctcattcctcatgttttcttctctcctttggggacttcaattaaacatatattaagccacttgaagttgtcccacagatcacagataatttggcttaaatttttttaaatcctctttgcttttggtttcattttggatagtttatattgccatggtttcacaatgaataatcttttcttctttaatatctaatctgccattaatcccatgcagtgcagttctcattttatacgttctagctttcacctctagaacagtgatccagagtgttgttatatcttccgtgcctcaaattagcttttacaatatgtggaatacagttttgatattgtttaatgccactgtgcccgttctgcatcagttttaatagactaatttgtctccttatggctattttcccacttgtttgtgtgcctaatatttctgattggatttcaaaaattgttgccttctctggtgttggatatttctgtagtcctataaatattcctgaggatttcatagaactgacaaaagacatgaatccacaggtatatgaagagttgatttatgacgagctgcataactaaaaagaagaaatccacacctaggtaaaccttattcagggatgcaggtaagataaaatcttattctgagatgcaattatttaagaacagagttttaaaatatttatagatgtaaggggtagaagtgcagatttcttccatgcatatattgcatagtggtgacatctgggcttttagtgtacccatcgcctgaatagtgaacattgtactgaagaagtaatttttcaactctcacccccttccaccctcccaccttttggagtgtccagtgtcatcttattccactccatacgtccatgtgtatacattgtttagctcccacttatacttgagaacatgtggtatttgactttttgtttctgagttatttcactcaggataatggcctctatccatgttgctcaaaagatatgatttcattctttgttaacggacgggtagtattaccttgtgtatatatgctacattttctttaaccaggcctccactgatggatgcttaggttcatccattttcttttctgttgtgaatagtattgtgataaacataaagtgcaggtggtttttgatataattaattctttccctttgggtatataccgagtagtggggttgctgaaccaaatagttgttctatttttagttctttgagaaatctccatactgttttccagaaagattacactgatttacattccccccaacagtacttcagcattcccctttctccacatcttcactaaaatctcttacttttagactttaataatagccattctgacttgtctaagatggtattgcattcagattttaatttgcctttctctgataattggtgatgttgagcatttttttcatgttttttgaccacttttgtgtcttctttgtaaaaatggctgttcatatcctttgcccactttttaatgggcttatttggtttgagttccttgtagattgtggatattagccctttgtcagatgcatagtttgcaaatattttcccattctgcaggttgtctatttaccctgttgatagtttcttttgctgtgcagaaggtttctagtttaagttccatttgtctatttttgtttttgttgcaattgctcttgaggacttgttcataaattctttgcctaggccaatgtccagaagaatttttcctaagttttcttctaggatttttatagtgtttggtcctatgtttaggtcttcaatccctcttgagttaacttttgtatatggtgagaggtatttgtccagtttcattctgctgcatatgccaatccacttttcccagcaccatttattgaaaagggtgtcatttcctcagtgtcatttcctgatttttattgactttgtgtctttatttctgagtcctctattctgttccattaatctagatgtctatttttgtactactaccatgctgttttggttaccatacccttgtagtataatttgaagtcaggtaatgtgatgcctgaaactttgttcttctagctttggattgctttggctagttgggctctttttgggttccatgtgaattttaggattttttttctaatttgatagagattgtgttgggtctgtagattgctttgaacagtatgataatttttaacaatattgattcttccaatccatgagcatgggatgcttttctgtttgtgtcatgtatgatttctttcatcagtgtgttgtagttctccttataaagatctttcacttccttggttaaatatatatctaggtaattttttgtagctacaataaatgagattgccttcctgatttggttcttggccagattgttattggtgtataagaatgctattgatttctgtacattaattttgtgtccttaaatgctactgaatttatttatcaaatctaagagttttttggtggagtcgtaatacggtttggctgtgtccgcacccaaatctcatcttgaattgtagctcccataattcccgtgtgttgtgggagggaccagctaggagacaattgaatcatgggggcagttttcaccatcctgttctcatgggagtgaataagtctcatgagacctgatggttttataaggggaaacccctttcacttggctttcaccctctctcttgcctgctgccgtgtatgatctgccttttgccgtccaccatgactgggaggcctccccagccgtgtggaactgtaagtccatgaaacctcattttgtttataaattacccagtctcaggcatgtctttaccagcagtgatacaagtcttcagggttttctatgtagaatataatttcaccaacagaaagggatagtttgggctccttcttctccaatgtgcattccctttatttctttctcttgcctgattgctctggccaggactttcagtactgtgttgaataagagtggtgaaagtgggcatccatgtcttataccagttcttagaaggaatactttcaacttttcccccttaattctgatgttggctgtggatctgtcatatgaggcttttattatgttgatgcatgttccttctatgcctcatttgttgagaatttttatcatgaagagaggctgaatttaatcaaatgctttttctgcatctatttaatgatcatatggtttttatccttaattctgttcatgtgatacgtcacatttattgatttgcgtccctgggataaatcccacctgatcagggtgtattatccttttgatgtgctgttgggttctattttctggtatttcgttgaggatttttgcatctatattcacagggatattgatctggagttttctttttttgttgcgcctttgtctggttttggtccgagggtgatactggcctcatagaatgagttagagagatatcccccctcttcgatttcttggaatagtttcagaaggattggtattagttcttcatatgtttggtagaatctggctgtgaatccatctagtcctgggctgagtgcagggcatccacacaacaagtgaagccacttctggcagtggggaaaacagttacagggacagaagctgaccaggctccttgtggtctgcttggagccatctcggctttacagagctcattgcccactgcctctgaaagccacacccagggctgcccttgccagaggggtgtgtcctctccactgcagacacaagttcctcccttctctgcggccctccgctctgcaacgccatcctctctctggtcctccgtgtctctgccaggcatgggctcctgtccacatcttttcttcccagcacgctgtcctgttgccgtgtccccgcatctttcttccctaacatcggctgtggaactgaggtagcgatggctggcgtattaagaatgtgctccaagcagctcagcctagggctgaacaccccccatttggcttcccctcctcatcagcccctgacctgtggcaacagtgaagccgcaaggctcacctgccgttctctgggtcacaggtgtgtgataggggggccagagtcgctccctggcagcaagacccggaacctgcactttaattccatgttccacagcaattccacccccagaataaccagatgcaatcacagcccaaacacacacaggcacgtgcacacacacaggtgcaaacacacacacatgcacacaaagacacacaggcccatgcacacacaggcacacgcaggcacacagacacatgcacacacatgcaaacacacagacacaggcacgtggacatacaggtgcaaacacacatgcacacacagagacacaggcacacgcagacacactcatacacacagagacacacaaatagacacacacacagctgaacatacacagctgaacacataccaacatacatacaccggcatgcatactcacacatacaggtgcacattcacacataggaatgcacaaacacacgcatgcatgtgcacactctcacactctcacacacaggtgcacacacacatcccggcagacattttccctaagctgccaaggacccatgggagctgcttcaacacccccatgaggcttcccaggccccacacccaggcaggcacgtcgttacttcactgaccaccccctctgacctcatgcacctaggctgtagcttgtccccagcccagggcccacacaggagctggttagggttctcaaggggccctgactgctcacctgctgtgggacacacccctacggggcccaaagaagctgctcagcctataggccgtcaaaggacattcagctgccaggggtgggtggacacctgacaggtccagctgcaggacacctcagtgctgggacccggcatcctcacacttggcctcggaggccttttcatgtctgctgctgtccgcgtgagtccattgctccccccgctccccgtgcctctgtcttcagcatggggcctcccaatggacctgggctcctgtcctggtctcccactgcagacccagatggcccagcatctcccaccatcccttccacccagggcttccagtgctacccaccatgctgtgtctgctcttcccaacctccactgtcagcctgaacctctacccacaaaacccaaccccaaacccaggcaggggtgggcgcgggtgccaggcagcaggggcttgtcccggagagctgtcctcctcctatgtgacagctgcctggcctggtgctcccaactgcggacgcagaacctgtgcaggaagccgtggaaacagctacaagcaggcaggtgtcccggggaacgctcctggtcactgacacggtaacacaggtggagctgggaaaagcattggtgctggggtggtagtgacccccacccaagaaagtcacattgacccggaacctcagagtaagaccttacgttaaaataggatctttgtagatgtaattcgattaaagatcttgagattatcccagcttctcctggcggcccttaaatccagtgacaggtgtcccgataagcaaaggaagagacagacacactaactcgggggaggaggccccgtgaggacaggggcagaggtggagccatgcggccaccacccaggaccgcctggagccacagaagctggaagaggtgggaacctccggagcgcacaggccttgatctcggacttctggcctcctaagccgtaagaggaaagccctgttgttcaacccatttgtagtgattttctaaggatccccaggaaacatcttataacgggacacttggcgtggatcacatcattggctgtgagtcggttttcagtaattgcagggttaatggaggctgtccaggtctggcagtggagcaagagctgggggccaggaagggccaccggacgggcagccatggccaggtgaagagcctggagtcccgaatcaggatccacctctccctgctgagcaagatcctgtgcccctgtttctggtgattttgtaagtgctgactgaaccgactgtcgctgggaaataacacacccgtgaccccaagccaaagtttcacccacagacaaggaaacagactccatgaacacgccgactcccgacggtagaaccggggtgcccaccccagccccggtcactgtgtgtcctgcgcaggggccagggcagcccaaggctcagctctgtcctcctgcccagacctcgctcagccccctggacgccgccccgcgcccgctgcctctcctctcctctcctcccaaaggctccaggaccatgtctgcctctgaagcctgacgttacctcccactgcgattttattgtaaactcactgcatttatgtcaagagagtttgtacaggttttggaaaatgcactgaagagtccccttgtgcctattaggacggtaagaacacaccaaggagagattatttcattatttctttgatgctgttagtaggatctacccgagggggaggcactccgggctccgcgggacgagaaggcagccgagcccgcacccgagcaggagggaagcaggagccgcagcgtggccgccgcacagcttcgggggtcccccgacttcccagctgcgagtgtggaatttctcaggagaactagacagaagcccatctctgggcagcactgagtggaaggagaaaccacaggagaggagaggaagtgtggggcgcgggaccaccgtggggtgggtgggggccaagccgccgggctgtgaggcctcagcaccccctgcccagcacccagcaccccaacttccccttctgcctttgcggattccagggcctgctggacacctggtgcagggacagagccggggctgggggaggagctcagctgcactagagtccagctggaagagtccagctgaaagtcaccagaggcaccccttcctcctggggggctgcgcctcggcctcctccagggcaggtgcccctatgcccctcaagtcccagcacccagcaccacagaaccgccctgtcatctcggccccggaaccttgtggggagccaactcctgcggagggccgggcagccccgggcggaatgagccccctccgcaaagcctgtctggggagcgggggaggggcggcaggtgcccggagaaaggcgagattggaagagcggccgggatggtggcgctgcatacgggcgacctgcagggagaacggaagctgaggccggggtcaggggtgcgcgctccgctcctccactcctgcgtgaagggcggcccactcccgagcagctgcgctgggcgcccggcacggacccgtctccctgctcaggtcgatccccggccgcgctgcccccacctggaagcccagtcccctgggtgcgccccgccttggggtccgagcaccctcacagcccggccctgccgcttccctgcaccgtctgcggctccttaaagaactgggcgcggtcggggctcgccccgcaccgtcctcgaggccccgccgccaacccaccccaccccaggaggccgcggccgcgctcatccatcccccgccgcaccgtcaacgcgcgtcctgcggggcggagagatcggggtccggtcgtccccggggggccccagagccaggtgaggggccccgccgccccctgcccagcggttcccacgacccgcgggtcggccgcgccctgcgctgagcggatacccggcggtccgcggggcctgagcagagtcggccttgtaaggcagaggtctcggtgcgcccgcgcgtccccgggccgggtggggcggcgggggcgggg

SEQ ID NO: 1731 - DNA, 10145 bp, Homo sapiens
ctgtaatctagggggaagctgccaatgccccttcactcttgtgttctgtgttcctgcagatttcacaccacttggaagccagcaaggcttgccctctagagcagcagtccacactgtacctggagactgttgaactaccactgtagctgaagaagttggggtacagggaccagtgtcctgaggctgcacagggcatcagggccctagtcctggcccattaagccattcttttctcctaggcctctgggcctgtgatgggaggggctgctgcgaagatctttgaaatgtcttcaaggtctttttcccattgtcttggatattagcacttggctcccttttagccatgcaaatctctctagtaagtggttgctctgcagcctgtttggattcctctcctgaaaacatttttttctttgtctaccatatggctaagctgcaaattttccaaacttttacaccctgctttccttttaggtataaattccaactttaagtcattcatttgctcccctatctgatcataggttgttagaagcagccatgtcacctcttgaatgtttagctgcttagaaatatcttctgccagatgtgctaggttaccattcttaagttcaaacttccacagatcactaggacacaaatacaatgtagccaagctctttgctaaggcacacaagggtgacctttgctccagttcccaataacttcctcgtttccatctgagactttcatgcgcgtccgtgtgaagagaccaccaaacaggctttgtgtgaggaataaagctctttatttcacctgggtgcaggtgggctgagtccaaaaagagagtcagcaaagggtggtggattgtcattagttcttataggttttgggataggcagtgaagttaagagcaatgttttgtgggcaggggtggctctcacaaagtacattctcaagggtggggagaattacaaagaaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgtgatggcttggcttgggctcagaggcctgacagagaccttgtcagcctggccttcattatgcatatttctatctgtattttggttccaaccacttaataagtcactaagttccaaacttttcccatctttctatcttcatctgagccctccaaagtcttccaacctctgctcactacccagttccaaagctgctaccacattttcaggtatctttatagcaatgtcctgctcctcagtgccagttttctgaatggacccatttttgcattgctataaagaaatacctgaacctgggtaattgctgacaaaagacctgaatccacaggtatatgatgagtaattcatgacaagctgcacgaataaaaataagaaatccaggcctagacacattgtagggtaatggggaacacaaaagaaaatctaactttaaaaacaaccagaaagaaacaacaaatcatccatagaagaaaagcagttagacagcagatgtattaattgtaacaacactagatagacaaataatattcacaaagtgtgacaaaaaaaaaaaaaaaaaaaaaaaaaaaaaacacttttgacctggaattatgtaccagcaacactatctttaggaaaaagagcaaattaatcacatttccagataaatcaaagccaagtttgccaccaacaatcctacactaatgggacttcaaaaaagatgtatttattgagggaaaatgtgtaaagcaaacacagatagagcccacagggaataatttttaaaaattcactatcacttgtggaagttttcagtgcaactctcaattacagttaggtcaatcgtatttttaaaataataaaaacatagatttggacaacaccattaacaggcttgaattatgggatatctgtggaactgcaagctcatttattaatagaaaatgtgcattctccttaggcacacaaggaatattgcccaaaacactgcttactagcctcaacaagtcttaaataacttctacaggatggaccagtgttcccctttacatactttgtctgacaatttttcctgtctgcttttaaaatttctacttatcactgggattgagcgatttgattataatgagacatgatgtaattttcttcaatggtacttgtgcttgaggtacattgaacttcttgcatctgtaggttaatagtttacatcgaattggggaaaaaaaggttgtcattatttttccaaacatcttttttaatgcactaccctcattcctcatgttttcttctctcctttggggacttcaattaaacatatattaagccacttgaagttgtcccacagatcacagataatttggcttaaatttttttaaatcctctttgcttttggtttcattttggatagtttatattgccatggtttcacaatgaataatcttttcttctttaatatctaatctgccattaatcccatgcagtgcagttctcattttatacgttctagctttcacctctagaacagtgatccagagtgttgttatatcttccgtgcctcaaattagcttttacaatatgtggaatacagttttgatattgtttaatgccactgtgcccgttctgcatcagttttaatagactaatttgtctccttatggctattttcccacttgtttgtgtgcctaatatttctgattggatttcaaaaattgttgccttctctggtgttggatatttctgtagtcctataaatattcctgaggatttcatagaactgacaaaagacatgaatccacaggtatatgaagagttgatttatgacgagctgcataactaaaaagaagaaatccacacctaggtaaaccttattcagggatgcaggtaagataaaatcttattctgagatgcaattatttaagaacagagttttaaaatatttatagatgtaaggggtagaagtgcagatttcttccatgcatatattgcatagtggtgacatctgggcttttagtgtacccatcgcctgaatagtgaacattgtactgaagaagtaatttttcaactctcacccccttccaccctcccaccttttggagtgtccagtgtcatcttattccactccatacgtccatgtgtatacattgtttagctcccacttatacttgagaacatgtggtatttgactttttgtttctgagttatttcactcaggataatggcctctatccatgttgctcaaaagatatgatttcattctttgttaacggacgggtagtattaccttgtgtatatatgctacattttctttaaccaggcctccactgatggatgcttaggttcatccattttcttttctgttgtgaatagtattgtgataaacataaagtgcaggtggtttttgatataattaattctttccctttgggtatataccgagtagtggggttgctgaaccaaatagttgttctatttttagttctttgagaaatctccatactgttttccagaaagattacactgatttacattccccccaacagtacttcagcattcccctttctccacatcttcactaaaatctcttacttttagactttaataatagccattctgacttgtctaagatggtattgcattcagattttaatttgcctttctctgataattggtgatgttgagcatttttttcatgttttttgaccacttttgtgtcttctttgtaaaaatggctgttcatatcctttgcccactttttaatgggcttatttggtttgagttccttgtagattgtggatattagccctttgtcagatgcatagtttgcaaatattttcccattctgcaggttgtctatttaccctgttgatagtttcttttgctgtgcagaaggtttctagtttaagttccatttgtctatttttgtttttgttgcaattgctcttgaggacttgttcataaattctttgcctaggccaatgtccagaagaatttttcctaagttttcttctaggatttttatagtgtttggtcctatgtttaggtcttcaatccctcttgagttaacttttgtatatggtgagaggtatttgtccagtttcattctgctgcatatgccaatccacttttcccagcaccatttattgaaaagggtgtcatttcctcagtgtcatttcctgatttttattgactttgtgtctttatttctgagtcctctattctgttccattaatctagatgtctatttttgtactactaccatgctgttttggttaccatacccttgtagtataatttgaagtcaggtaatgtgatgcctgaaactttgttcttctagctttggattgctttggctagttgggctctttttgggttccatgtgaattttaggattttttttctaatttgatagagattgtgttgggtctgtagattgctttgaacagtatgataatttttaacaatattgattcttccaatccatgagcatgggatgcttttctgtttgtgtcatgtatgatttctttcatcagtgtgttgtagttctccttataaagatctttcacttccttggttaaatatatatctaggtaattttttgtagctacaataaatgagattgccttcctgatttggttcttggccagattgttattggtgtataagaatgctattgatttctgtacattaattttgtgtccttaaatgctactgaatttatttatcaaatctaagagttttttggtggagtcgtaatacggtttggctgtgtccgcacccaaatctcatcttgaattgtagctcccataattcccgtgtgttgtgggagggaccagctaggagacaattgaatcatgggggcagttttcaccatcctgttctcatgggagtgaataagtctcatgagacctgatggttttataaggggaaacccctttcacttggctttcaccctctctcttgcctgctgccgtgtatgatctgccttttgccgtccaccatgactgggaggcctccccagccgtgtggaactgtaagtccatgaaacctcattttgtttataaattacccagtctcaggcatgtctttaccagcagtgatacaagtcttcagggttttctatgtagaatataatttcaccaacagaaagggatagtttgggctccttcttctccaatgtgcattccctttatttctttctcttgcctgattgctctggccaggactttcagtactgtgttgaataagagtggtgaaagtgggcatccatgtcttataccagttcttagaaggaatactttcaacttttcccccttaattctgatgttggctgtggatctgtcatatgaggcttttattatgttgatgcatgttccttctatgcctcatttgttgagaatttttatcatgaagagaggctgaatttaatcaaatgctttttctgcatctatttaatgatcatatggtttttatccttaattctgttcatgtgatacgtcacatttattgatttgcgtccctgggataaatcccacctgatcagggtgtattatccttttgatgtgctgttgggttctattttctggtatttcgttgaggatttttgcatctatattcacagggatattgatctggagttttctttttttgttgcgcctttgtctggttttggtccgagggtgatactggcctcatagaatgagttagagagatatcccccctcttcgatttcttggaatagtttcagaaggattggtattagttcttcatatgtttggtagaatctggctgtgaatccatctagtcctgggctgagtgcagggcatccacacaacaagtgaagccacttctggcagtggggaaaacagttacagggacagaagctgaccaggctccttgtggtctgcttggagccatctcggctttacagagctcattgcccactgcctctgaaagccacacccagggctgcccttgccagaggggtgtgtcctctccactgcagacacaagttcctcccttctctgcggccctccgctctgcaacgccatcctctctctggtcctccgtgtctctgccaggcatgggctcctgtccacatcttttcttcccagcacgctgtcctgttgccgtgtccccgcatctttcttccctaacatcggctgtggaactgaggtagcgatggctggcgtattaagaatgtgctccaagcagctcagcctagggctgaacaccccccatttggcttcccctcctcatcagcccctgacctgtggcaacagtgaagccgcaaggctcacctgccgttctctgggtcacaggtgtgtgataggggggccagagtcgctccctggcagcaagacccggaacctgcactttaattccatgttccacagcaattccacccccagaataaccagatgcaatcacagcccaaacacacacaggcacgtgcacacacacaggtgcaaacacacacacatgcacacaaagacacacaggcccatgcacacacaggcacacgcaggcacacagacacatgcacacacatgcaaacacacagacacaggcacgtggacatacaggtgcaaacacacatgcacacacagagacacaggcacacgcagacacactcatacacacagagacacacaaatagacacacacacagctgaacatacacagctgaacacataccaacatacatacaccggcatgcatactcacacatacaggtgcacattcacacataggaatgcacaaacacacgcatgcatgtgcacactctcacactctcacacacaggtgcacacacacatcccggcagacattttccctaagctgccaaggacccatgggagctgcttcaacacccccatgaggcttcccaggccccacacccaggcaggcacgtcgttacttcactgaccaccccctctgacctcatgcacctaggctgtagcttgtccccagcccagggcccacacaggagctggttagggttctcaaggggccctgactgctcacctgctgtgggacacacccctacggggcccaaagaagctgctcagcctataggccgtcaaaggacattcagctgccaggggtgggtggacacctgacaggtccagctgcaggacacctcagtgctgggacccggcatcctcacacttggcctcggaggccttttcatgtctgctgctgtccgcgtgagtccattgctccccccgctccccgtgcctctgtcttcagcatggggcctcccaatggacctgggctcctgtcctggtctcccactgcagacccagatggcccagcatctcccaccatcccttccacccagggcttccagtgctacccaccatgctgtgtctgctcttcccaacctccactgtcagcctgaacctctacccacaaaacccaaccccaaacccaggcaggggtgggcgcgggtgccaggcagcaggggcttgtcccggagagctgtcctcctcctatgtgacagctgcctggcctggtgctcccaactgcggacgcagaacctgtgcaggaagccgtggaaacagctacaagcaggcaggtgtcccggggaacgctcctggtcactgacacggtaacacaggtggagctgggaaaagcattggtgctggggtggtagtgacccccacccaagaaagtcacattgacccggaacctcagagtaagaccttacgttaaaataggatctttgtagatgtaattcgattaaagatcttgagattatcccagcttctcctggcggcccttaaatccagtgacaggtgtcccgataagcaaaggaagagacagacacactaactcgggggaggaggccccgtgaggacaggggcagaggtggagccatgcggccaccacccaggaccgcctggagccacagaagctggaagaggtgggaacctccggagcgcacaggccttgatctcggacttctggcctcctaagccgtaagaggaaagccctgttgttcaacccatttgtagtgattttctaaggatccccaggaaacatcttataacgggacacttggcgtggatcacatcattggctgtgagtcggttttcagtaattgcagggttaatggaggctgtccaggtctggcagtggagcaagagctgggggccaggaagggccaccggacgggcagccatggccaggtgaagagcctggagtcccgaatcaggatccacctctccctgctgagcaagatcctgtgcccctgtttctggtgattttgtaagtgctgactgaaccgactgtcgctgggaaataacacacccgtgaccccaagccaaagtttcacccacagacaaggaaacagactccatgaacacgccgactcccgacggtagaaccggggtgcccaccccagccccggtcactgtgtgtcctgcgcaggggccagggcagcccaaggctcagctctgtcctcctgcccagacctcgctcagccccctggacgccgccccgcgcccgctgcctctcctctcctctcctcccaaaggctccaggaccatgtctgcctctgaagcctgacgttacctcccactgcgattttattgtaaactcactgcatttatgtcaagagagtttgtacaggttttggaaaatgcactgaagagtccccttgtgcctattaggacggtaagaacacaccaaggagagattatttcattatttctttgatgctgttagtaggatctacccgagggggaggcactccgggctccgcgggacgagaaggcagccgagcccgcacccgagcaggagggaagcaggagccgcagcgtggccgccgcacagcttcgggggtcccccgacttcccagctgcgagtgtggaatttctcaggagaactagacagaagcccatctctgggcagcactgagtggaaggagaaaccacaggagaggagaggaagtgtggggcgcgggaccaccgtggggtgggtgggggccaagccgccgggctgtgaggcctcagcaccccctgcccagcacccagcaccccaacttccccttctgcctttgcggattccagggcctgctggacacctggtgcagggacagagccggggctgggggaggagctcagctgcactagagtccagctggaagagtccagctgaaagtcaccagaggcaccccttcctcctggggggctgcgcctcggcctcctccagggcaggtgcccctatgcccctcaagtcccagcacccagcaccacagaaccgccctgtcatctcggccccggaaccttgtggggagccaactcctgcggagggccgggcagccccgggcggaatgagccccctccgcaaagcctgtctggggagcgggggaggggcggcaggtgcccggagaaaggcgagattggaagagcggccgggatggtggcgctgcatacgggcgacctgcagggagaacggaagctgaggccggggtcaggggtgcgcgctccgctcctccactcctgcgtgaagggcggcccactcccgagcagctgcgctgggcgcccggcacggacccgtctccctgctcaggtcgatccccggccgcgctgcccccacctggaagcccagtcccctgggtgcgccccgccttggggtccgagcaccctcacagcccggccctgccgcttccctgcaccgtctgcggctccttaaagaactgggcgcggtcggggctcgccccgcaccgtcctcgaggccccgccgccaacccaccccaccccaggaggccgcggccgcgctcatccatcccccgccgcaccgtcaacgcgcgtcctgcggggcggagagatcggggtccggtcgtccccggggggccccagagccaggtgaggggccccgccgccccctgcccagcggttcccacgacccgcgggtcggccgcgccctgcgctgagcggatacccggcggtccgcggggcctgagcagagtcggccttgtaaggcagaggtctcggtgcgcccgcgcgtccccgggccgggtggggcggcgggggcgggg

SEQ ID NO: 1732 - DNA, 2646 bp, Homo sapiens
cccatgctcatggattggaagaatcaatattgttaaaaattatcatactgttcaaagcaatctacagacccaacacaatctctatcaaattagaaaaaaaatcctaaaattcacatggaacccaaaaagagcccaactagccaaagcaatccaaagctagaagaacaaagtttcaggcatcacattacctgacttcaaattatactacaagggtatggtaaccaaaacagcatggtagtagtacaaaaatagacatctagattaatggaacagaatagaggactcagaaataaagacacaaagtcaataaaaatcaggaaatgacactgaggaaatgacacccttttcaataaatggtgctgggaaaagtggattggcatatgcagcagaatgaaactggacaaatacctctcaccatatacaaaagttaactcaagagggattgaagacctaaacataggaccaaacactataaaaatcctagaagaaaacttaggaaaaattcttctggacattggcctaggcaaagaatttatgaacaagtcctcaagagcaattgcaacaaaaacaaaaatagacaaatggaacttaaactagaaaccttctgcacagcaaaagaaactatcaacagggtaaatagacaacctgcagaatgggaaaatatttgcaaactatgcatctgacaaagggctaatatccacaatctacaaggaactcaaaccaaataagcccattaaaaagtgggcaaaggatatgaacagccatttttacaaagaagacacaaaagtggtcaaaaaacatgaaaaaaatgctcaacatcaccaattatcagagaaaggcaaattaaaatctgaatgcaataccatcttagacaagtcagaatggctattattaaagtctaaaagtaagagattttagtgaagatgtggagaaaggggaatgctgaagtactgttggggggaatgtaaatcagtgtaatctttctggaaaacagtatggagatttctcaaagaactaaaaatagaacaactatttggttcagcaaccccactactcggtatatacccaaagggaaagaattaattatatcaaaaaccacctgcactttatgtttatcacaatactattcacaacagaaaagaaaatggatgaacctaagcatccatcagtggaggcctggttaaagaaaatgtagcatatatacacaaggtaatactacccgtccgttaacaaagaatgaaatcatatcttttgagcaacatggatagaggccattatcctgagtgaaataactcagaaacaaaaagtcaaataccacatgttctcaagtataagtgggagctaaacaatgtatacacatggacgtatggagtggaataagatgacactggacactccaaaaggtgggagggtggaagggggtgagagttgaaaaattacttcttcagtacaatgttcactattcaggcgatgggtacactaaaagcccagatgtcaccactatgcaatatatgcatggaagaaatctgcacttctaccccttacatctataaatattttaaaactctgttcttaaataattgcatctcagaataagattttatcttacctgcatccctgaataaggtttacctaggtgtggatttcttctttttagttatgcagctcgtcataaatcaactcttcatatacctgtggattcatgtcttttgtcagttctatgaaatcctcaggaatatttataggactacagaaatatccaacaccagagaaggcaacaatttttgaaatccaatcagaaatattaggcacacaaacaagtgggaaaataggagccataaggaggcaaatgagtctattaaaactgatccagaacggacacaagggcattaaacaatatcaaaactacattccacgtattgtaaaagctaatttgaggcacagaagatataacaacactctggatcactgttctagaggtgaaagctagaacgtataaaatgagaactgcactgcatgggattaatggcagattagatgttaaagaagaaaagattattcattgtgaaaccatggcaatataaactatccaaaatgaaaccaaaagcaaagaggatttaaaaaaatttaagccaaattatctgtgatctgtgggacaacttcaagtggcttaatatatgtttaattgaagtccccaaaggacagaagaaaacatgaggaatgagggtagtgcattaaaaaagatgtttggaaaaataatgacaacatttttttccaaattcgatgtaaactagtaacctacagatgcaagaagttcaatgtacctcaagcacaagtaccattgaagaaaattacatcatgtctcattataatcaaatcgctcaatcccagtgataaatagaaattttaaaagcagacaggaaaaaatgtcagacaaagtatgtaaaggggaacactggtccatcccatagaagttatttgagacttgttgaggctagtaagcagtgttttgggcaatattccttgtgtgcctaaggagaatgcacattttctattaataaatgagcttgcagttccacagatatcccataattcaagcctgttaatggtgttgtccaaatctatgtttttattattttaaaaata

SEQ ID NO: 1733 - DNA, 1947 bp, Homo sapiens
cttgctaatatctggtgctgaaaagagtgaggaaattgaaggaaatttgcattgtttaaaccttttggtaaagtaagcaaaaagaaactatgaggatttaaaatgcaaatgccctttgacttttaagtgttctacagaaacaaaacaatattgtcagtatctgacaaccttggcacaaaggtgcttcttgcaattttgtttgcaaaacctaaacttggtcataaacttaatatcctgtagtgaacaatggttgactaagccacggtatatgcacatcatgagagggtgaatttcctgacaagaataaaacacatctatatgaaacgtcatgagtgtaatctatgccatattgttgaagaaattaaaattcaggaagggaggtgcagaatatttttaacctatactatcatcttcaaactgatacaatcagcatgtaataaggttataagttctgagtataagttaggtattaaattctcccccatctaaatgttgctccatggccagacacagtgactcatgtctgtagtcccaacactttaggaggctgaggcaggcaaatagcttgagctcaggagttcgagaccagtgtgggcaacatggtgacaccccatctctacaaaagttggctcagcgtggtggcatgagcctgtggtcccagctacttgggaggctgaggtgggtggactgcaagaatccaagtggcaaaggttgtagtgagctgagattgtgccactgcactgcagcctgggtgacagagaaagaccctgtctcaaaaaaaaaaaaaaatgttgctccatgatccagggcagctgggttgggaggatgaggccagctgggtgcactcatctgtgagggggagaccgggaggcatgcggtgacctcagcagtctggggtcccaggtgcctctagaggaaccccaagcagctccgagccatgaggtgtgggtgctccttcttcccagcacgagcagcctccctcacacaccctccctgaataatgtcggccgtgtcactgggcttatgtccactgggccctacctggtttggccatctggcccccctgagcagcatgacctactggaatggtggcagagaccccagaggtcctaggccaggacggctgcagctgctgtgtgcccagagagcacggggctgttctgtgcaggctggggcgggggcttcccctgtggggccggctgggactccctgcagtgatgggaggaatatggcaggcaggctggggactgagatgtgaggaatatggcaggcaggctggggactgagatgtgaggtgaaggcaggaaggaggctgtgtcagtgtgagagagtgtgactgtgtgcgagtgtgtgtgtgtgcacgtgcctgtgtctgtgcacctggggtggtttgagccaatgactcttacctttccacttcattttcttttaggttgtattaaatggttctagatgaaactttagtagagtgtaggagcgcaatatctaaaccctaaaactctgggaaatgttgtataaagctgctttttaaaatataaagttaatatatgttcattttatggaaagaaaaatgaaacagcaaacaaggagtaaataatttactcagcatcatgtgtgagtagatttcctattactctatgttctgtgagaagtgtatcctgtacttgagattctctgggaagaatatgcatttgtcatggctgtacaattttatttcatcatgggaacagggtaccctttagaatgtgtgcttaaaactggatcatggtcctctttataagggtcttctttcagctttgtagtttggagggtgaaaaagtggtgtgcagttgggctggaattgtgcagtgttggggcagagctgtcatcagtggatgtatttagagttgaaatgacaagatctgactctcaatgaaacactattagaaacattaaaaaacattcagg

SEQ ID NO: 1734 - DNA, 2403 bp, Homo sapiens
gcccctcagacccttggagccagctgccccgcaggcacgcatgtccagccccgggcagagtggagccaagcgaggccttgcccactgccatcattgggccaaggaccccctaagccaaataaagccagcagcacgcagagcccagggtgggagctgagctgggtgccaggggctccaggcctaggaggctcagtgtgtgactggcagcatcagagcctattccgggtcccctccccgccgcagttccactgtccctcctgtggacgcccgctctgcagctctggaggacacctcgggatcacgcactccccagggtctgtgacgtgctgccttcctctgggaaggtccacagcagtcgtgcgacagccgctccctccccactgcagagcctctgaccttagatggagctttaggctggggagggtgtgtggtggccctgggggtgcctcaggatgctcttcccaggagccctgggcctggccccagccaggggaggggactgccagtgtgcagggctgaggcagtgctgggggcaccggtgtcagggtgcagggatgccctctggacttggtaaggcgcccgcccccagagcaggtggctgggctgtggggctaagattgaggggtgccacccaggcagggcttggggacgcagggctacgccacagggcagggctgccgaggccacctccctaccatgcatgggcttcggtaagacccagtcaggccctgaaggactcaaggctgaggtgctggactcagggcatgaaagctgcttcccaaaggggcctggacaccaggtgggccgtcagcactgcactgagagctgaacatggcctctgcccacagacacaagagccggtgggagggtccgtgccgaggacacatgtgcgtgtcccaaccctgggactcacgaagccctctcagatctggagttctcagcgccagtcatggccaaagtgtggctctgtcatcgtgggggtcctgagtgtggcccctgctgaacttgagatcccacaaattcccccaaaacagccggaaaaaaatccaggggcactccctacactgaagaccttaagggcctcaggccccacccactcacccctttccctggaagacaccaaaaatgcagatgccaacccagcggaggatgcaggggcaggatcctggtgggggctgggccgcatgggggcagggtctcatgggggcaggaccgcgtgggggcaggatcctggtgggggcaggatcctgggggtggaagggccgtctgggggcaggatcctgggggtggaaaggctgggtcaggtgtcgagccaggaaccgtttccagttttatcgctgacaacatttctttgaaacaggagcttctcacaggcctggcctgtgtttcccctgggcctctgcagcaggggtcgctggacaggaggagcagctgagaaattaccagaagcaatggtgggttttgtgagcacccagaacagtggtgggcgtgcgggtcagagagaaagaaccttctgggatgcttcaaactcagggctgcgttctgtggtctcatctcctgtggggatgcgcctgaacagagacccttattcacacacctcagagagtcatctgagaacctgcaccccgtggggcccgcctgggagcaaagggatgagggaagcccctcagagccaccttcagggctcacgcaggacttcccagcccatcagcacctcttaagcagcaagaggccctgcagctggctggctggctggacagcacagttaagcaggtggctgcatcctctgcagttgctggcagcccatcttcctggagatgtaaaccctcctgcaaggctggctcttctttgggtgtgatgaagatgatgacagagatggatgctgggctctgagggtcctggttccttcgaaggacatccaggggcctctgagatgatgggctctggttcctggcctgtagcatgggtaggagcaggaggctttgcaaggtagactctacaggcaggaccttgatggagggtggggtttcagggtagaagacctggatcacaggggcacctgagctcctgcaggacaaaacaaagtcactctttgagcagccaccagggaggaagctcagctctacttgtgatggaaacccaccggtggcttttaccccaacctgttgcctggagaggcagggctggtttctgggtggatcatcaccttggcttagacacagagccccactcccagctgggtctagtgagagtcctcccgagccaggctcctgccctccccatccttccagaaagcttagagatgagtgcatcaccgacagaggccattttctattgttcttcttcggaaatacatccttttgaaagataacccatcttttatcactagatattttaaaaaat

SEQ ID NO: 1735 - DNA, 3393 bp, Homo sapiens
ccgccctcctggggtgcctctcagggacccaggcgctcagctgctggggccgcggagggcgttcgcggggcgccggggaaggctagggccgcggggtccccggggcgccgtccccaaccgccgacgcctgccagaccaccaagtgggggccatgtcgacgtgtgaggagcctggtggaaggtgatactggaattccggcactgggcctgcaacccttttagtccacagttgtcagaatctaaagggaagaaaaacgaagtgctcagaaccctcacagaagccgggcacctcatcccgtgtgtgggttttttccccagtacaaacccattgtggggacaggcgcttttgaagaaaaaattcagattcccgggctgaagtggctcctcacagccttgaacctgacccccagcttcccgctaaagccgagcgtgcccagcacggcgaggtcagcagaggcccctcggagggcggccgggggaggtcagtgggaggccctcgggcagccggtggatgggccggcgacctccccgactccatcagaagcgctcagtctgtgcccttcagttactggagcagctcccgtcctttggccagttctctggaaggtcgtttccgtttctgtgtctgccacacgtgcagcacaatcgaaaaaccttgttcgacatttctagaaagagtagatgctactgaagacccaatagattgctgagggttttcagagcagggacaattgcatcagggtgctgggctccgggaagaactcagaggacttggctgacgggcggatgggacagtgattggtgccgagaatgggccagagaagcaggtctgcctggagcaggcacccgaggccgcgtgcaggggcggtcctgggccaccaacccctggaagctgggccaggagcttcggagccatccgaggcttttttcgctcctctcactctcatgcacctagttaccctccccacagagtcttctcacggcgcggttttcggctaccattgcagtggtgtctgactacacccagtgcctctatcgttcccccctcagtctgttctcgcttcttggcaaacctgtccttggaaagccctctgctgactcctgttaccctgatcaaatgcatcctcctcaggaggctcgtgagccctttgcagggtggcccaagaggcatcacgccctgctctccagccactcttggggtcccctacagggccaggcgtcccacaccagcagcgggtgctggtcctgccacagtctgtgcgacacgtgaatgaaggctgtagacctgtggtctgcgggaggcaaattccaactccagctgtcaaacataaggggactggtaggctctccagggtggattgtctcacggcatccagaggcagggaccgaggcagggacctagccaggcctcgggaaggagctgcaaacccaggagctctggggtgtggcttcatctccctccctccctaccaccctacccccatctctccgtgttcttcagatgcctcattttcctgtcaggcacctggccagctctaggagctggaatcaggttggtgcctccttggtcagtgtccacccctagtgtcatccacagtgaccaacggaaggggtggccggtggtacaggacattggccatcttgggaaagatcacagagacaggaagggcctctccagctgagcagatgagaggttcttcagtggtctggacacatttgcccactcatggccgtccccctgccctgttgagagaaccgatgaggaaagggagccctgcatctgtcgccttccgactccgaccgcctgaggctgggctgccggcaagccgcggcagcatatgacagcacttgaaagaaagtccctggaaagaatgtggatcattgcagaactccctcaagaaagcgccagaggaggaccccattcagcaccccgcagaactcctcaaactcctgcgtccacactcccccagcgtggtggctgcttctatctccccaggcttagctggcctgggtcttgaaggcctctcctcctgctgtccccacgcagcatcctctctgccactgcacagctggatgcagtgaaggccaggcggctgtggctgcttgggcaacaggagctgcttgaccctgttctgctggccttgttggcctcactcccgtagagagccaaggttacccacgtctctgaagctaaggctttctttctaggcctgggggagtcacatcttgcattcgtactcactgagctccacgtctatggccctggtgtgtgatgttgcccgcactgtgtccaagtgttctcattgttcaattcccacctgtgccaactcctgggatcttatcgggaagtggctcatcatcagctttaggtgttttctatctattgggagcctgcctttctctggcaccagctgcaaccaataattattttagacagtttaacaacagcttgaccatcacctgatgatcacctgacatttctgttggggcgcgggcccatctcctgccccgctcatgtggggctcagtctgcccaacctttccccaagggcctgtctttacttcatttgtggtaagccccaagcagaatggactcttgttatgatcccaggaactgctcacggccacctctgtggatgaacacctagcggctgctctaaatacatgctgtgaaagttgtcagaatcaaaatggagtcactaatgttaagaaagccctgacaaagagttggtggggaaggccacgaagagaggacacttatgcttgcatgcctgataccagaaaggactacaaaaaccacagcccggcacagaggccatcacacccttacacaaaaaatatttctgcaaggacaactgcccagcaattgcctgtccaacctcagactggaatgacctttgttattgatgtttgtagccaaggagaattatctcaaaaccactgtgatcctgctcgcttttcctttaaagacctttgtcttccttgacctccctgaataggcatatggtttactatggcgtgtgtactctccttgtaatgttctgttctcaagctaacatctattcttctagagaacctctctcttaggctgacaacgctgtggatctgggctcccaggaactggggctgacatcagaggggtggaaagagaacagcagctctccctgaggggatgcttgccaaggataaggagacgatggttctctaaggattattttatattcatctaaaagggtatttttgttgttacccctagccttttttcccttttaattttctgatgaataatttatataaagaaaacccattctaagtgtgcaattctatgagttttgacaaatgtcttcacccatgcaaatcctgttacaacggagatatagaacatttccattact

SEQ ID NO: 1736 - DNA, 2067 bp, Homo sapiens
aagagaaagattttcacttggaggaaacatatacaaaattaatccttcttaaatcactgttacctctaagtctggaaccgctgccttcacacattgtctgctgccgatcttgtcaatgacccttgttaacgcctctcccgacaggtggacggcatccagacgcggagggaagtttcctcctggggagcagcgcacgtgctgcctggagacagaagcgaagatcagattgcacgtgcgtggaatgtggccgcagcaccagttctgagctccacgatttgccggagcatgactctgttcttcatgaaaattattataaagagtgcttccaggaggctgaggcaggagaatcgtttgaacccgggaggcagaggttgcagtgagtggagattgcgccactgcactcccagcctgggcaacagagagagactccgtctaaaaaaaaaaaaaaaaaaaaaaaaaaaaaagagtgcttccacattaaatcaagaaagacacacacacaagtgaactggaagagtatcacaccctcttaggcctcaatgtccacaacatcactggccacagcttttagtttcaggaggtgagatatgaaaacaaacctaatgggcaaagcagatctaaacagggtaagacctggagccccggccccatgcagcctgcagaagagaagaaaatgacaggagcagaaggtcaaagggaagcatcgagagaaagaggatgaattgacacctgtggctaattgaagtgaaatcagatcacagaggccatgagacccacgtccagagggccctaggagggagctgtgggctcagctggttgatttactctggcttgggtcgctgctactgctttgaggacaataagcttggccatcaccagacaccagaggatgctgaagggacagccggctagactatttcatggactctctgagcatgtcctattgcagtccaggtacaaacttttcctccagaaatagacagagggatgctgcttcccaatttcagcaaaggcagtggaaagatcccggtcaaaagtagaaactctgggtccaggccttccagctgacactcactctgatatggtttggctgtgttcccacccaaatctcaacttgaattgtatctctcagaattcccacgagttgtaggagggatccaggtggaggtaattgaatcatggggtgggtctttcccatgctattctcgtgatagtgaataagtctcaccagctctcatgggtttattaggggtttccacttttgattcttcctcattttctcttgctgccaccgtaagaagtgcctttcgcctcccgccatgattctgaggcctccccagccatgtggaactgtaagtccaattaaacctctttcttcccagtctcaggtatgtctttatcagcagcatgaaaacagacgaatacagtaaattggtgccactagagtgggcactgctggtaagatacctgaaaatgtggaagcgactttggaactgggtaacaggcagaggttggaagagtttggagggctcagaagaagacaggaaaatgtggggaagtttgaaacttcctagagacttgttgaatggctttcccccaaatgctgatagcgatatggacaagaaggtccaggctgaggtggtctcagatggagatgaggaacttgttgggaactggagcaaacgtgactcttgttatgttttagcagagagactggcagcattttgcccctgccctagagatttgtggaactttgaacttgagagggatgatttagggtatctgatggaagaaatttctaagcaggaaagcattcaagaggtgacttgggtattgttaaaggcattcagttttatcagggaagcagagcatcaaagtttggaaaatttgactatgagatagaaaagaaaaacccattgtctggggagaaattcaagatggctacagaaatttgcagaggtagcagggagcctaatgttaatccccaagaccatgggaaaatgtctccaggccatgtcagagatcttcacagcagcccctcccatcacaggcctggaggccctggag

SEQ ID NO: 1737 - DNA, 2771 bp, Homo sapiens
ccgtctgcctgtggatcagaccctgtggtgagtggtgacagcccaggggtggggaggcagatcaccctgctgggttgctggggaaggctgtgtggaggccatagggtctgagcaatatactaagacctagttaaagatttgcagcgagagaatccatgaaacatgaaacacggaggctgtggggggtcgagttaggactctggatggccacatcctgacccccagaacatgcaaccaccgccttgtatggaaagggggctttgcggatgtgatagggctgaggctcctgagatgggtgattttcttggatgatcctggcgggccaatgaaatcacagggtccttctgagagggagggaggacagcagagaggggaaggtgatgtggccacagagccagagatgacggaaggggctgccagcccaggggtccaggtaccaccggaagaaggaaagacagagacatggggtctccccatgcccagccctgcagagaccctgaattcagcgcaggggtactgatttgggggttatggcctccagaactgtgagagaataagtctccgttgtcttatgccaccgagtgtgcggtacgtgttatggcagccacatagcaggtgtgaggaagctggagaagggactgaagatggggtgcagctgggaccaccctgctgggctaaggccagttctggaaagagactgaacagctctccctcaggagcagtgagggaggaacccgtgagtcagtggagggtgggaggaaacgtgggaggagcctccgacatcctagaaacgcgggggtaccaaagccagcaccggcctgcggggggaaagccggcctcttacgccctggaagaggaaactcacagagatccccacaacgacacccagctgtgcaggaggcccacgtcctgtctcatttcattttctcctctcggtgaacaaaaagagaagaaaatgacaggagcagaaggtcaaagggaagcatcgagagaaagaggatgaattgacacctgtggctaattgaagtgaaatcagatcacagaggccatgagacccacgtccagagggccctaggagggagctgtgggctcagctggttgatttactctggcttgggtcgctgctactgctttgaggacaataagcttggccatcaccagacaccagaggatgctgaagggacagccggctagactatttcatggactctctgagcatgtcctattgcagtccagatgtgcctttcacctcccgccatgattctgaggcctgcccagccatgtggaacgaccgaggacttccgccagctttcgcatgggagagcgtcctggcacggggtgtctttgacgtgggcagactgaggacttcagccagctttcaaatgggagagcgtcctggcacggggtgtcgttgacgtgggcagaccgaggacttcagccagctttcacatgggagagcgtcctggcacggggcgtcgttgatgtgggccatgagtttgcaccttttcagatggtgggaagccactcacaagtgacagagggtgtcacatgatacacaaaaccgaaaggaagccctaatcccggcaggaaaggtctgtgtgaggattcaccaagagtggacgtccaggagtgtgtgacgccggagccggtgtgccccacgcatgtgtaggtgctcacaggcacacgcctgcacggagggctgtctgtccaggccactgctgtgtggtggcctcactgctgccttccttaatggctgataacactaaactctttgatgtatccaattccctgctttattttaactcagattattccttactgtgcctttggccatcaaatattgactgcatgataacattgtactttgtttctgttgtcagtgcatgacgttttccactctctagggagttccactgccaagagaacacaactcatcaccagaggagacaggatcggggaggaggcggccaggccagccctggccccggccacaggaacactggcgtcccctggctgggaaaggacaaggtgtgctccagttctggccacgtctgtctggtttccccatcagaggtggtggcttgtgaactaggagcgctcgagtcccagcgccgtggcccagtcaccagacggtgggtggggagccgggctgggccctcgccctggccacagtgcagcccgctccactagctgggacccggcttcctgcaaaaccaaagctcaaggctgggcagggcagccagctgtgtcccaactcaccccaagtttctgcacttcatgtccgagcagatgggctttcagaggggacgctgccctagggtttcacagccacttatgctgagtgatgcccaaacctgtaactcccagtcactgatcctaggatccttgaaccacaggatgctgacctcatttccccacccattggtggatgcgttcatcagagtcttccagaaaccgcggtggggggatcgcccaggatcgcactcaggaatcccgccgagggagctctgtgaatgcaatttaggcgaccgcactttctaatgtttgaaatattgcgtctaaggagacatttctctaaatgtcacaggagacacatgcatgtttaagaaatgtacatgaaagaacatacttgagtatatgccaagtatgatgacctagctatgataattttcaaaaatgtagcaatcgtattgtcagaaactattattttagaggttagaatgttgaccacccatttgtttttaaattattattatactttaagttttagg

SEQ ID NO: 1738 - DNA, 1362 bp, Homo sapiens
atttaggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcaccacactgacttccacaatggttgaactagtttacatggcacccaactactactcgacattcgtaaccttttattcattagaaatgaccaacgggaactttaaattacatgacagcagtttccttcttagaaagaggaaggtaaaactcagagaaacctatcaagcctgaataaaggagtaaacacaaaaatgaagcagttccaactcttctatggggctccctacctgtggtccttcatcctcataatattattttctgaatggcctctgacagccacgatttccccaaatgatcaatgtcgtcaaactattcagcatggcagatcaggaaaattgtcagatttattttagaaagaattttaaaggacaggtggactctaaagggatgttgtgcttagctagatattcaaaaatgcaattaacgaacacattccttctccagatacaccgagttttcctgtgtgttcaggtgtttgttccgagggtgcgttagtggacgaattcctccacctgtgcatctggagacctggggatgtctatgctctttgccccctgccagggttgagcatgtgatcatatctccagcggacgacaccaaaagaatgtctgtgacctcgtcccctggcgaccacgtctacagtgactgagtgctgccgtggctggaaagccagggtctgcatctcccaggacctcaggacctgtgatgaggtgttgtggggccaagaagaggagggggtccatggtgggctctgccgcaggtgaccctgcgcactgtcctagcacctgtgcctaaggagatgccctctatggtaccaagcatctcccaaaatgtgatttgctcttcctgtgatagaatggagtgggctgagggggcgatgggtgctggaaagccacaaggctgccattgatctgccagagaaggcacctgctcacctggcaggatgctcacctggcaggatgttcacctggcaggatgctcacctggcaggaatagcaaatttgctagaaaaatgcaggttcccctgttctgggtgatctgtgacttctgccacacaggggatccagagtgcgaggatatccagagagctggaatgaggattttgctgagctgaggtgggttgctttcctctccttccctcatgaaatcacaaaacccatgctcatctcccagatgacctaagggtggcagttcctagag

SEQ ID NO: 1739 - DNA, 542 bp, Homo sapiens
tgaagcagaagaaaccacagtaaaaacactggtcaatgtatgctcggatctactcagcgactttccagagagccgtgtggctttactaatgacagacatcgtggtgcattccagacccctgggcttgttcatctgacgtcactgcaacctcctgattccactcaataggccaagacaagcggaagctccggttcagggagaacgttccccaggaaatcagggcagcagagttttccaggaacggaggctgtgacggtggagggtggccaggcagcaggaggccggggaagcgggtgtcctgaagcagaggccgcggcgccacgtgtatggcagcttgcagagtcctgcaaagtggatcttgatgctgtggcccttacgggtgaggcgggagcagcccatagatgccggggcctggccggcctgggcttttctctgtgcagcctacaggggagcctgtaagggcctgcagccggtgctccgatacagcggctgggaagtggaacacttggcaactgctgggtcacctcgctgtgttttctgag

SEQ ID NO: 1740 - DNA, 839 bp, Homo sapiens
tttcaggataaaagccaaagtgattgctccaaatggacatccatgccagtcatctgtgtaaggatcgctgagtgtctcacaaaagcacgtgggtatgaaggtggggttgacattgatgattaaaccaagcagtacagaagcatcggtgctggtcacttatccccgtccttcccatcattcgagatccccttccagcgaatggcatcttctggtgtgtgcaggacccgatggaggagtgatgagacctcagagccatgtccaggctcttccagtcagttggtggcctccacaaatgccagccagcccgcccaatgcaagcttctgcttggccaacgtgtagcagttacgatgcagcaattggaagaggctgtggggatcagtaattccagtgggggagcgacggacacccctaagaacccattccacgattttagtcccaaattggattttgcttggagaaattctctgccctgtagtagtggtttttaagatcacagatattggagtaagaaagacaaggctcttctatttgctggtctattgactcacaggggaataccagagaacttggcatccagaaaacagtcaacaaatgaagacagtgcaactaagacctgggcgccatgttccttccctaaggctcatttcactaggatgctgtgtcagcacgcgcacacacacacacacacacactcacacactccaggaagcctctaaaagaaatgcaagtgttctccagtagaaggagcatcgctgaaatttactcaacagcacggtcttcgtgtctttccctcccaggcccacactctcagctgcctcctcccctctcgctcctttcc

SEQ ID NO: 1741 - DNA, 2588 bp, Homo sapiens
gggagagtagctttaaatcttgattcaatgcgagagaccacagtgcactttgtaaggtggaccctgtgagggagtgttgggaggagggcccaggaggggcaggccaaggggagggcagtcagctgctgctcctcagcaggaaggaggggggtcaactcccacgggtgtagacttgggtgttgggggtggatctgtgctctggtggattctacttcgtctgtgctgtagagacaattttccaacatcggtctcgttcctgagagttataagagagttggaaaagtcagaggctgacaatggaggggacatttctgagtaacttttgctaaaggtgagagagcgagatgcccagacagacagtaagcttgcagggtgatggatacaggtggggagactgggcgggggacctttctatcttcagagctttgctgcttaaggcacaggctcagaagaggaagaagacggcctgccctgctggcactttcccaggatggggggaaaggcatggaggcgtgtgtgaaggtgctcgcagggatggaccatggactccaagcccagtgtgaggctgtgggatgggacatggctggagactgtgtcccatgaacggggagcctgctgcagctcagtgtggagcaaatgcactgaggagctgagggtggggaacctttccacgggtgacagattcgccccaatagcgggaggtaaatagggcggtgggcgccaggaggctgaaggatgtgctgaccgtgctattctctctgtcacctctgttggtgcttattaactgaaaaacacatttgtgtgggcagggaaaatgttaatggatctgggcatgtttcctttaatacagatttcacaagaaaccaaaagcaaattaaattacattgttatggtattttcctcactatttaaatttgtgaaatgcccacaggtgctgaggacgtatctgaaggggaaactttattaatctctggacaggaaaggaggcgggatgcctatgggaccgtcctgaattgctgtcctacgatggtcgggccctgccggagagagggttcctccgactttgccagggctactgagaaggggacacagtcctgggcccaagagtgaggccaagctttggttttccacctatccaaaaaggaagagcagaaggcgctaggtgggttctggaagttagtctgatttgccagctggactgggggctcctctgttttgtagaagagactctggcggtgggagagagacagccaccataggtgcagaggaccccaaagcactggtctagggctacagcatgctttggtgtggggaaaacacatcctgaatttccaagaaaaatattaaagtgatgtttttcaagaaccgcaaatcatcatgagaagaaaaacataattcaagggcaaatatatcgtctcgaaagggcttaggctgccgaagcaattggtggcacgtttccttctccgcagcactttgtgtgaaagtttcctttcaatgccaagactttcagagtcctcggggagaggtgagagtgacgataagcacaataaatccagtgccgtccaccctgctccatagcaaagagggagaaaaggagggtgcagcgagggagagggggagcagagccgtgactctgcagccggcctctgtgggtgagcagccggcctccagctgccctttccggttcctcagtgtgtgctttgtttttccttgaactgtacttcgtttacagcaatcaatcattttaaaaagaaaggatccattacccatcaatatttttgatcgttccatacaacctagatgatccatagaacagaaccggcttgggtgagcctcacagtgcggcagcaacaccttgaccccatcacttggaaccccggggctcctgcagaggctgcgacagcccagcctggggcgactggatctggccttccctagcggaagagagagggatacagctttacatgccccctggtatcctaaagaatacagcatcattggaaaggcagtgttttcatataaaaagtgaaatagcagcatgttccattgtggcctaggaataaaacaataggatgtttgtgcaaccaacagaaaatcaggcgacttggggaacaggaggttaactgggaatttactctcactgtatttcagcagaggctgtgaacagggaacaagagtcctcatcctaaagagtggctcggccttgccactcagaacctactcccagaaggcacggaccctgtctgccgtcactcccagtgcaccctctgacacacacagaaggccaggcacttccagccactcccccacacagaaggccaggaacttggaaggagttgatgagaggggtttcctggctttctgtcttccagctctgcctgaggggagggtatgctccccaaccgcaggtccatgaggggcctcccaggaagcaggtatggagatcaggactcccataaaaggggagatgggaagccccgccccttaccaaccaaaatggacggtgggaaggaggtggactgtgtgcgatattgagggtttggctgaagctggagacaggggccttaggcaaactgtccagaaccccc

SEQ ID NO: 1742 - DNA, 413 bp, Homo sapiens
atgctggctataatgaatgatgctgctaagaataaacaaacaaatctttacatggacatatgtatttatttctcttgggtaactacctgggagtggaattgctaatgtcttatggagaatacattggagtggaattgctggccatttattttgctcatgatcttgacttagacatgactcagtgaagcagcacatctctgatccatggaatgacaactgagatatcttgaaagatggaaggtcttgttatccagaggctgaaattactgggagattcactcacttcctgtctagtggttgaggtcgacgggtgaccaccatcctagctatggtgtcatccagagcgcatacatgtggtctctctttgaggatgcctggcttcctcacagcatggcagctggattctaagagca

SEQ ID NO: 1743 - DNA, 1472 bp, Homo sapiens
gtgcttcttccagtccatggctccagcagctcctgctctaggaaaaagaattacatttgagtctatctccaaaagctccagctatcattttggctgctctccctgtgatcaaatattgaaggtgaatgtaggaaaatcgatggcagggtgaaggtgcagagttatgtaagagccgcatgaatgaaacattaaacgccagaaatcaagagcgggctttgaaatcctggacctagtgctgtgctgctatttggactctattttggaattttgagaaatcaatatgaagaagcatataccaggagcaacttaaagaaaagtgtccactgacctagaagcaagacccagagtgcttgcatcagttagcttgtggcctgggagaactgccgatatcaaatgagaggagcgacgaactctccaacatcacacaaaaaacattttcctttcagagcctcggagtgcagcatggcaggggcagtagcactcagcatctgcaggcatttgggttcatgggagcatgaaaaacaggtctagcaaaatgtcgaaaaatgtggagtgtagacttttacaaaagaatgcaggtatattacttttaaatacacaagttgactcaagctagccatggtgagtgctacctatgaaggggtcttgatttcatgagattattctagctcatgttcggtaaccctgttgatattaatggtttttcagatatatctaaaagcaattcagtttcttgaggagtaaacttgtctttgttatcgttacacattttaggttagacacgggtgtttcgaagaacctagggaagtgactttggcatgggccctatgggatggctgctggcaggccccatgctctgggtggctgtgaggacagtggtgaatgagggccgcttctgaggatgcacccagccagcctcctctgcaggctctgtctgtggatgttgattcacgtgacaggctgtcaggctccaggaggcccctccttcccaatgactcctacacacagttagcattgtctgaggactgtgaagataaatggacactgttcctgcttgaaggcacctagagtctagttgggggtgtcttctgcagacaaagcagcaagaccatgtgacggggaccacagtagatgtgagcacagggcacacaggagtgggggacatgaggagggaggagtttgctctgctgcggtggaagtgggggctcaggagcctcatgcagaggtgaatttatcaggtttgaattttgagagaggaattggctgaggaacagaatccaagatgaaggggcaatgaaaggctaggcccttgggcgtgaagcagcgtcctgcttttacgggcctgtgtggatagggtggggttgaatagtgatggcatgtgagtgtctgggtgtggggagtgtatgttgagggcagaacctttcatctgggatcacgacagacagaaccagacagatagcaacagcaggggc

SEQ ID NO: 1744 - DNA, 1579 bp, Homo sapiens
ccctcacgcctcctgccatgctgtggtttccagaaatttctcagtctcttgctggtccacactaagcctccagcaactcagacgactgtgtatgtgcttcttccagtccatggctccagcagctcctgctctaggtacacagaccgtggaaaaagaattacatttgagtctatctccaaaagctccagctatcattttggctgctctccctgtgatcaaatattgaaggtgaatgtaggaaaatcgatggcagggtgaaggtgcagagttatgtaagagccgcatgaatgaaacattaaacgccagaaatcaagagcgggctttgaaatcctggacctagtgctgtgctgctatttggactctattttggaattttgagaaatcaatatgaagaagcatataccaggagcaacttaaagaaaagtgtccactgacctagaagcaagacccagagtgcttgcatcagttagcttgtggcctgggagaactgccgatatcaaatgagaggagcgacgaactctccaacatcacacaaaaaacattttcctttcagagcctcggagtgcagcatggcaggggcagtagcactcagcatctgcaggcatttgggttcatgggagcatgaaaaacaggtctagcaaaatgtcgaaaaatgtggagtgtagacttttacaaaagaatgcaggtatattacttttaaatacacaagttgactcaagctagccatggtgagtgctacctatgaaggggtcttgatttcatgagattattctagctcatgttcggtaaccctgttgatattaatggtttttcagatatatctaaaagcaattcagtttcttgaggagtaaacttgtctttgttatcgttacacattttaggttagacacgggtgtttcgaagaacctagggaagtgactttggcatgggccctatgggatggctgctggcaggccccatgctctgggtggctgtgaggacagtggtgaatgagggccgcttctgaggatgcacccagccagcctcctctgcaggctctgtctgtggatgttgattcacgtgacaggctgtcaggctccaggaggcccctccttcccaatgactcctacacacagttagcattgtctgaggactgtgaagataaatggacactgttcctgcttgaaggcacctagagtctagttgggggtgtcttctgcagacaaagcagcaagaccatgtgacggggaccacagtagatgtgagcacagggcacacaggagtgggggacatgaggagggaggagtttgctctgctgcggtggaagtgggggctcaggagcctcatgcagaggtgaatttatcaggtttgaattttgagagaggaattggctgaggaacagaatccaagatgaaggggcaatgaaaggctaggcccttgggcgtgaagcagcgtcctgcttttacgggcctgtgtggatagggtggggttgaatagtgatggcatgtgagtgtctgggtgtggggagtgtatgttgagggcagaacctttcatctgggatcacgacagacagaaccagacagatagcaacagcaggggc

SEQ ID NO: 1745 - DNA, 560 bp, Homo sapiens
caaccctgtaatatgtgcataaaatatttaatggccataaagaaaagttaaaaccagattttcaagtgcctgtgacttaagaaaaattaaatgttttggctctttccatttacttaacagtaagcaaaaaatgttacttttgaaaagttcatgtttctaaattttaaaatcatctttaaaagaatgaactgaggctgggcatggtggctcccgcctctaatcccagcactttgggaggccaagtgggtaggagttcaagaccggccaaggcaacttggttggtgaaactccaccgctacaaaaaaatacaaaaattagtcaggtgtggtggcacacggctgcaatcccaggtactcgggaggctgaggtaggaggactgcctgagcccagaaaatcgaggctgcagtgagcagtgactgtgcctccagcctaggcaacagagcaagactctgttgttttttttttgagacagagtctcgctgtgtcacccaggctggggtgcggtggcgcgatctcggctcactgtaagctccgcctcccgggttccagcgattttcctg

SEQ ID NO: 1746 - DNA, 210 bp, Homo sapiens
cccgtcaagcaacttcgtgtcagaccattccttgtccccttttgcctttttttttttttcctttgagacagagtctcgctctgtctcgcccagggtggaatgcagtggcgcaatctcagctcactgcaacctccacctcctgggctcaagcaattctcctgcctcagcctcccgagtagctaggattacaggcacccaccacaacgcctg

SEQ ID NO: 1747 - DNA, 1739 bp, Homo sapiens
cttgagcccaggagtttgaagctgcagggagctatgattgagccactgtgctccatcctgcataacagaatgagatcctgtctctaaaaaaggtggggggaagaagagttgtggccctctgccttcactgagggcagatgaaggctggaatccattacacccatccttgccaccccgatctccaccacccatttagatgtatgggctcggctttagctaggcatccataagttagagttgcttctggtggatctgtaattgccctgttttgtaataccgatgagtttacaccagaaggaaattcatgcttttcctccagataaactgagacttaagaaatcttttgacctacccaaagttctgaaagactgctagagccaaaacttaatgttaaatcacaagaatcccagtgcactctgccaattttcttagttcacttatatctactatgataatttgaatagctagaagaaagcaaaagagcgaattgggtaataactctgtctcaaccagctaaaagatgacctctccacccctgcttaactttaggaagcgttccactgtaaaggagcaacttgacaggctgagcctggcggtgacagcatacaggatgggcgcagcccccacatctgggtcatttcgtgtcatcatgtctggaatatcaagtttgagcacgtatgcagcaaggatacccttcaactaaaagttgcatcctcaaattggggctttctaactcagcgtggcgatgttgtggatcaggtcaaaagtgcttttccttagagccaagttgagagttgagaggcctctgccacctgcatctgtgcttatgagcaacacatgtggtctcggagggggcttcggcgagcacaaactccagcattgtcattcagaacccaggacaaagcctttcacacttgcacgacatgtgctttctgaaatgaatgcaactgcatacttccttcttgagctcgcagtaatgaatgacttcacagatggatggatgatcttgtggctggctacaaagaatagactaaaacccgcggaaatgcagatagattaaaaaggagtgacaggattaatgaaaataaaacgcagaccttataagcagacgctgtgattttgtaataaagaggggcagcttttacaggaaaaagaacccgagggaagctgttggcagtctgtgaaacgacggtcatggtggaattcgtttttctgcacattagatgtttaaaacagctggttttcgttgttgttgttgttgttgttttcctgaaagaatcttgttccccacaatatgttcttggtattcaaaatggcttttgctcctactttttggaaaatgcacttcagtttccaatttattcatttgttagtgggttcatcaattagtttattcatcaattagttcatccattgtggaagacagtgtggcgattcctcaaggatctagaaccaaaaataccatttgacccagcagtcccattactgggcttattgaagtctcctaatgtgaatttctactcctggacataataccttcttctcagaaataagacagagttttcccctgcacttctttatatgcttttttctctgacttttgccatgtggttttgtttctcccatggcttgaaagagcaggaaaactgaaggtaccaactgaaagtgctgcttcctgcttttggttttccttcattttatttcatttttcaagctgagtctcactctgttgcccaggc

SEQ ID NO: 1748 - DNA, 564 bp, Homo sapiens
cacgtgttgttgatagaagattgtaccaaaggaataattcatagaacaacaaggaagaattaagctaacaacagattccaaaatgttattcaagaaatgagacaaagttcatcaaaaacactacaaagatgccccagagagaagaacagatgaactttgcacagcattgctgtagagaagagggactctgtacgcctataagaaagtgcaaagcagcataagaacacacattgtcacctctcgcagacagccaatcccaggagcacactgtgtgcacaattcaaggaatcctgtagatgagttacaaaaatgtagctgtgccccatgcatttgttatgtggcttccccttaatgcaattatagaagctataaaataagtgaagtaatctctgtttaaaaatctggcataaccaattactcaattaggtgaggaggtggatgtttttaggttgtttccataggggaaaaggagcaaatattaaaatgattactcgcactcttaaaatgtatgcaaagttttttaaagaagtatcactcaacaggttgaaatccattccaatgact

SEQ ID NO: 1749 - DNA, 2389 bp, Homo sapiens
tttgatggtcacaagagaagtgctattggcatacaggcaatagaggctaaggatgctgctaaccatccgaaaacaggaaagccccctacaacaaagaattgtctggacaaaatgtcaatagtgtcagtgctccagaggcttgtatcatcaagttctttttttttttttttttagccaggagacacttgataagtaatatcctgttcttctattcagatacatacctgtctgtttcattttcactgctgtcactttacctgctcttgggctcttgattcctaatagaccctatccacaagctccagagacatgagggacactggccaagtgcaaaactttatttctggataaagcgcttgtgtcctatcctggtgaacccaattacacttcaacatttattgaccatccacaatgtgcaggatacaacagcccaggagaagatgcagagcctatgaggaaacaaaggggccatgaatgtaaatgcacaaggagtatcaaaaatattaagtcaaaattatctgaagagcctacactgaccaggtaagcacttcaccctgatttaataactaatcattctatgtcaaatgttaacagtgaatgaagtcaacagggcacagaataataatacacagcagtggggaaacacttctgaaacataacattttgtgaaaactagttttcaaataatgaccccttgagagggaaataagaaatgttaaaaagaagaggtaacagtggagtaattttattcacatagggttgcgattaaaaggttaactcattcaaacacatttttgctatgctaacattcctttgcctcttattcttacaaataaacccccatcacagagcagaaatgttagaaattatatcacaaatggagcacaataagtatttttaaaaccttttaaaatatggcttataattttacacagcaagttacctattaatatgttacatattaacagatctatttggacaatcagatttccttgagattaaggatggagttggcatttttcctttaagaaggcattttaaggccgggcatggtggctcatgcctgtaatcccaatactgggaggccgaggcaggcagatcacaaggtcaggagttcgagaccagcctgaccaacatggtgaatccccatatctactaaaaatacaaaaaattagccaggcatagtggtgcctgcctgtaatcccagctacttgggaggctgaggcaggagaatcgcttgaacctgggagatggaggttgcagagccgagatcatgccactgcagtccagcctgggtgacaaagcaagactccgttctcaaaaaaaaaaaaaaaaaaaaagaaggtattttaagcctgttaggggaggttctatagtatggagcttctttataaagtggtatcttatgtatatcaaaaaaaaaaagccagatcaatctctgggaaaacactacattttaatgtatttctatctgatatgtcataaattctttgctatgaatgtctacgcagatactttaagaaaaattgattctctggatatacatcaaaacctagattaactttgtacattaacatttattttaaaaaattgataagaacaacatgttaaatattggcaaaactaagagcactcaattcgactatccgtccagctttcacagaatttacttctgagcccacaagactcaaattgtataaggatagagtctgtttcattcatcaacatatccagcacctgacatagttttacatggcacagagtgggtgttcaataaatatttgtcaatgattgaacagaaattttcagcaccaaatgaaagaaacacatgactttgaacaacggcacgagaataccaactgtttgattatgcaacgacaggatcttttggcaaaaattctaggattacttataagtagatcaataattagataataatttcctccaaaaataaaggaattctcatggggaaaaaaaaaaagtcctaacatcttatcctaaaagctattctgtaaatcttggaatataagctaggtgaaaaccacaatactaaggaaggcaattccaaaactactgtgttttacatatttattaaagaatccattctttctgataatactcctaacacaggtgaagatatttttacaatattttaccaaactcctaatagaaaatgtctaatcagttcatccttttagtccctgaatccatgtttgagcattttaaagatggaagaaacctgtaagactcatatcattttaaaaaaattgacttaaaacacttattggataactaatacatttgtaacagcatcatgatttgttttgctatctgtatttcacccagaactgctgaattacagaatgaaactcaaatgaaagcattcatc

SEQ ID NO: 1750 - DNA, 1627 bp, Homo sapiens
ccctcccccctcacaagtttgatagatcttaaattcatgtttctttctttgtttacttgttttgttttaaaatatttaactttcaatcttcctggaacccaatctggtgtaaggcatttaattctgatttacaatgtgcattatttaacacagcagtatccataacttataggaattaataaaatactttggttatatctgtctttttcctgcttgctcacataaaagccaagtcacacaaagataagtgctttatcacatataaataaacaaacattttgctttacttccaatcaaattaattttactggaattgatgatgtgtctttctgatcttcatttaaatggatttaaacacttgacattcaattataacaaaacatgtgcatgataaacacaaggggctcattttggtcatctggaatttgaacgtatcaagctgtcacgagttttagatattctgcaaacaacagttgaagaccagacttggttttacaaattcatatccaagttggctgtttgttattagaaatacacttacttacatacagtaatatttccaagggtaggcaggatactatctagtccataaaatttatcttatttataagtaattgatagaatagctgttctgctaatgatataggttctagaagcaaaagtcaaacaagggctgatgaaggaagcgattattctaaatactaggtgcacttgatctcatcttccagagtctcatctgagcctacactaactctactcccattgatacaacaacactggttgtgtatacagcctcttcctctccttgggtgttctactaccttctctcctcttccccactcaagccctgcacttactcagtgcaaccaatttttatttaggtattaggagggaaagtaagccagctccatgaatgaattctgggtaatgtgtgaatgacacagtctcttacctgccaaacagatatctaacagaacaatgcaagacagtaagggaagcaaagtctcaagaggtggtgatattttgtgtgtgtctctccttatagtcagcaagctggtcttgctgggaagtgcagtcctactctaggatgtgtctctatttctttacattccttaagacaacacctacattgtctaaaagttcttctctatagtaggaggacgtcatttctctaaagtaggacatctcttctctatagagaggagacatcatttatttataagggatagttttaggtcaaaagttttgaagagaggtgttgtttagagtgatagtagattcagacacattttgaatcatttttatccctgactatgctttggttggtttactatttctgggtttaccaggtgagctatttctactcttgaaaaagatgagattacactgggaaaggggaaaatttattgagcccttactatgtgttaacgatggtgtttaacactcatcacaactttatgaggtagatattattgtatctattttattttctttttatttttttgagatagagtcttactccgtcacccaagctggagtgcagtggcacaatctcggctcactgcaacctccgcctcctggttcaagcaattctctgcctcagcctcctgagtagctgggattacag

SEQ ID NO: 1751 - DNA, 3400 bp, Homo sapiens
tttccgcctccccactagctacggctccactcccgggcgaggcctgtcaccgaccagcagtcgctccgctcagcccggagctctcctaatccccgagctcaagtagattccgctggcccgcggcctgcactctccgccgggcctacgcctccccggccgcccagcaggagcccagtccccgccaccggagccggccgggagagggtacaaaaccaccgctacccaaggcggctgccaccagagaggagcgaactctagactcgcctgtggaagagacctggggccgctaaggaaacggcggggaggggagcgaggaggagagacgctgaggacctggcgccggcgccgccgccgccgccgccgaaataaagagcaggaatttacctgggcgaatcggcgtctgaatccaaggggaggccgaggccgctgtggcgagagactataatccgggccgggagggggggtggctacggctcctcttccgtctcctcagtgcggggaacatgtagagccggggggagaccagccgagaagacaaatcgttgcttcttcttcctcctcctcctccttctcccacatagaaacactcacaaacacccgaccacgggcccgagctaccgggggggcatcgccgcgggcccgggaaccaattctcctgtcggcgggggcgtccctccctgcggcttggtggtgtcgggtgagtcggtaccgacggagggaggggggggagggcggggggaaggagccctgtgtgtgtctctctctcgttccgtctctccctctcagaacaaaatgccgaccggaagtgcagctgcaggaatgactccctccgccggcgccaaacactaacaaccaccccctcttccccactccacttccgccaccgccgcagccgccgctgccgccacttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaactctcatttgcc

SEQ ID NO: 1752 - DNA, 2205 bp, Homo sapiens
gttggccaggctggtctcttaactcctgacctcaggtgatctgcccacttagacctcccaaagtgctgggattacaggcatgagccaccacgcctatcctggagcatagttagaacccagtgcaaagaatctaagaaccatgataaaactacaggagctgatagccagaataaccagtttagggaagaagaaaactgacctgatagagctgaaaaactcaacacaagaaattcactgtgcaatcacaagtatcaataacagaataggccaagtggagaaaagaatctcagagcttgaagactatctttctgaaataaaacatgcagacaaaaataaagaaaagagaatgaaaaggaactaacaaaacctccaagaaatacgggattatgtaaaaagacatcctatgactgattggggtacctgaaagagatggggagaacagaatcaagttggaaaacattcttcaggatatcatccaagagaacttccccaacctagcaagacaggccaaaattcaaattcaggaaatcctgagaaccccagttctcgagatactttacaagaaaaccccaaaacacaccatcatcacatttgccaaggtcaaaatgaaagaaaaagtgttaagggcagccagagaggccaggtcacctaaaaaaagtaagcccatcagactaacatcatatctctcagtggaaacccaacaagccaaatgagattggtggcaaatattcaacattcttaaagaaaagaattaacaacccagaatttcatatccggccaaactaagcttcataaatgaaagagaaataagctccttttcagacaagcaaatgctgagggaatacatctccaccaagcctgccttgcaagagctcctgaaggaagtacctgatgtggaaaggaaaaaccattaccagccactacaaaagcacaccgaagtatacagaccagtgacactatgaagcaaccacataaaacaagtctgcaaaataaccagttagcatcatgatgacaggatcagattcacacataacagtattaaccttaaatgtaaatggacttaatgccacaattaaaatacataaaatggcaagctggatagagtcaagccccattaatgttctgtcttcaagagacacatctcacatccaaagacacacataggctcaaaataaagggagggaggaaaaatggaaaacagaaaaaagctggggtcacaatcctggtttctgacaaaacagactttaaaccaacaaagataaaaaaagaaggccattacataatggtaaaggattcaattcaacaagagctaactatcctaaatataaatacacccaatataggagcactcagattcataaagcaagttcttagagaccttcaaagagacttagattcccacacagtaatactggacactttaacaccccactgacaatattagatcatcaagacagaaaattaacaaagatattcaggacctgaactcagctctggatcaagtggacctgatagatatctacagaactctccatcccaaaacaacagaatatacattcttctcatcacatggcactctaaaattgatcacataattggaagtaaaacacccctcagcaaatgcaaaagaactgaaatcaaactgctcagaccacagcacaatcaagttagaactcaagattaagaaactcactcaaaaccacacaactacatggaaattgaacaacctgctcctgaatgactcctgagtaaataatgaaattaaggcagatgtcaagaagttatttgaaattaatgagaacaaagagacaatgtaccagaatctctgggacacaggtaaagcagtgttaatggggaaatttatagcactaaatccccacaacaaaaaggtctcaaatcaacaacttaacatcacaactaaactagaggccaggcatggtggctcatgcctgtgatcccagcactttgggaggccgaggtgggtggatcgcctgaggtcgggagttcgagaccagcctgaccaacatggagaaaccccatctctgctaaaaatacaaaattgggtgggcgtgatggcgcatgcctgtaatcccagctattcgggaggctgagacaggagaatcacttgaacctgggaggcggaggttgtggtgagctgagatcgtgccactgcactccagcctgggcaatgacagcgaaactccg

SEQ ID NO: 1753 - DNA, 249 bp, Homo sapiens
ctgtaagtagcctatataggtgctgtatttttaattttttttttttttttttttgagatggagtctcgctctgtggcccaggctgaagtgcagtggcccacagcgcccggcctctcactcagactcttttaaagacatctttccttatctttggtttccagcaatcttattacaatgtttctaggtgtggtttcctttgtagctatcctgcttagggtaaacaaaacttcctaaatctctgggttgatc

SEQ ID NO: 1754 - DNA, 670 bp, Homo sapiens
atggaatggaatggaatggattggaatggaatgcaatggaatggaatggaatggaatggaatcattccgagtggaatggaagtgaatgtaatcgagtggaatggaaaggaatggaatcaacaccagcgcaatggaatggaatggaatggaatggaatggaatggaatggaatggaattgaatggaatggaatggaatggaatggaatcaactcgagtggaatgcaatggaatggaatggattggaatggaatgcaatggaagggaatggaagggaatggaatggaatggaatcattccgagtggaatggaagggaatgtaatcgagtggaatggaaatggaatcaacaggagtggaatggaatggaaacgaatggaatggaatggaatggaatggaatggaatggaatggaatcaacccgagagcaatggaatggaatggaatggaatcgaatggaatggaatcaacctgaatggaatagagtggaatggaatcaacccgagtggaatggcatagaatggaatggaatggaaaggagtggaatggtacggaatagaatggaatggaacgaaatggaatggaatggattcaacccaattggaatgatatggtatggaatggaatggaattgtgtggaatggaatggaatggaatggagtgtaaaggaattg

SEQ ID NO: 1755 - DNA, 1420 bp, Homo sapiens
atggaatggaatggaatggaatggaatggaatcaacccgaatggaatggaaaggaatggaatcaacccgagtgaaatggcatggaatggaatagaatggaaaggaatggaatggaatggtacggaatagaatggaatggaacgaaatggaatggaatggaatggaatggaatggaatgttacggaataaaatggaatggaacgaaatggaatggaatgggaaggtatcattccgactggaatagaagggaatgtattcgagtggaatggaaaggaatggattcaacccgagtggaatataagggaatggaatggaatggaaaggaatagaatggaatcaacccgagaggaatggaatgaaaaggaatggaatggaatggaatcaactcaagtgcaatggaatggaatggaatggaatggaatggaatgcaatggaacggaatggaatggaatggaatggaatcaacccgaatagaatggaatgaaatggaatcaacgagagtggaatggcatggaatggaaaggaatggaatggaatggaatggtacggaatagaatggaatggaacgaaatggaacggaatggaatggaatggaatggaatggaatggaaaggaatcattccgagttgaatagaagggaatgtattcgagtggaatggaaacgaatggaatcacccctagtggaatggaagggaatggaatggaatggaaaagaatagaatggaaacaactcaagtggaatggaatgggaaggaatggaatggaatggaatgcaatggaatggaaacgaatggaatggaatggaatggaatggaatcaaatggaatcaacccaagtgcaatggaatggaatggaatggaatggaatggaatggaatggaatggaatcaacccgaataaaatggaatgaaatggaatcaaccccagtggaatggcatggaatggaaaggaatggaatggaatggaatggaatggtacggaatagaatggaatggaacgaaatggaatggaatggaatggaagggaatggaatggaatggaatcattccgagtggaatggaagggaatgtaatcgagtggaatggaaatggaatcaacaggagtggaatggaatggaaacgaatggaatggaatggaatggaatggaatggaatggaatggaatcaacccgagagcaatggaatggaatggaatggaatcgaatggaatggaatcaacctgaatggaatagagtggaatggaatcaacccgagtggaatggcatagaatggaatggaatggaaaggagtggaatggtacggaatagaatggaatggaacgaaatggaatggaatggattcaacccaattggaatgatatggtatggaatggaatggaattgtgtggaatggaatggaatggaatggagtgtaaaggaattg

SEQ ID NO: 1756 - DNA, 1536 bp, Homo sapiens
aatggaatggaatggaatggaatcaacccgaatggaatggaaaggaatggaatcaacccgagtgaaatggcatggaatggaatagaatggaaaggaatggaatggaatggtacggaatagaatggaatggaacgaaatggaatggaatggaatggaatggaatggaatgttacggaataaaatggaatggaacgaaatggaatggaatgggaaggtatcattccgactggaatagaagggaatgtattcgagtggaatggaaaggaatggattcaacccgagtggaatataagggaatggaatggaatggaaaggaatagaatggaatcaacccgagaggaatggaatgaaaaggaatggaatggaatggaatcaactcaagtgcaatggaatggaatggaatggaatggaatggaatgcaatggaacggaatggaatggaatggaatggaatcaacccgaatagaatggaatgaaatggaatcaacgagagtggaatggcatggaatggaaaggaatggaatggaatggaatggtacggaatagaatggaatggaacgaaatggaacggaatggaatggaatggaatggaatggaatggaaaggaatcattccgagttgaatagaagggaatgtattcgagtggaatggaaacgaatggaatcacccctagtggaatggaagggaatggaatggaatggaaaagaatagaatggaaacaactcaagtggaatggaatgggaaggaatggaatggaatggaatgcaatggaatggaaacgaatggaatggaatggaatggaatggaatcaaatggaatcaacccaagtgcaatggaatggaatggaatggaatggaatggaatggaatggaatggaatcaacccgaataaaatggaatgaaatggaatcaaccccagtggaatggcatggaatggaaaggaatggaatggaatggaatggaatggtacggaatagaatggaatggaacgaaatggaatggaatgtattaaacccgattggaatggaatggaatggaatggaattgaatggaatggaatggaatggaatggaatcaactcgagtggaatgcaatggaatggaatggattggaatggaatgcaatggaagggaatggaagggaatggaatggaatggaatcattccgagtggaatggaagggaatgtaatcgagtggaatggaaatggaatcaacaggagtggaatggaatggaaacgaatggaatggaatggaatggaatggaatggaatggaatggaatcaacccgagagcaatggaatggaatggaatggaatcgaatggaatggaatcaacctgaatggaatagagtggaatggaatcaacccgagtggaatggcatagaatggaatggaatggaaaggagtggaatggtacggaatagaatggaatggaacgaaatggaatggaatggattcaacccaattggaatgatatggtatggaatggaatggaattgtgtggaatggaatggaatggaatggagtgtaaaggaattg

SEQ ID NO: 1757 - DNA, 291 bp, Homo sapiens
aatggagtgtaaaggaattgaatagaatcaacccgaatggaatggaatggaatggaacggaatggaatggaatggaatggaatggaatgcaatggaatggaatcaaatcgagtggaatggatggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1758 - DNA, 2523 bp, Homo sapiens
aatggagtgtaaaggaattgaatagaatcaacccgaatggaatggaatggaatggaacggaatggaatggaatggaatggaatggaatgcaatggaatggaatcaaatcgagtggaatggatggaacggaatcaacccgagtggaatggcatggaatggaatggaatggaaaggagtggaatggtacggaatagaatggaatggaacgaaatggaatggaatggattcaacacaattggaatggtatggtatggaatggaatgaaattgtgtggaatggaatgaaatggaatggagtgtaaaagaattgaatagaatcaacccgaattgaatggaatggaatggaacggaatggaatggaatggaatggaatgcaatggaatggaatggaatggaatggaatcattctgagtggaatggaagtgaatgtaatcgagtggaatggaaggaatggaatcaacgcgagtgcaatggaatggaatggaatggaatgcaatggaatggaatctaccagaagggatggatgggatggaatgaaatggagtggaatgtaccgaatggaatggaatggaatcgtatggcgtggaatggaatgaaacggaatagaatggaatggaatcaaatcgcatggaatggaatggaatggaactcaatcaaacagagtggaatggaatggaatggaatggaatggaatggaatggaatggaatggaatggaatcaccctaatggaatggagtggaatggaatggaatggagtggaatggaatggaatggaatgtaatcaacccaagcgcaatggaatggaatcgaatggaatggaatggaatggaatggaatggaatggaatggatttaacacgaatgtaatggaaaggaatggaatcaacccgagtggaatggcatggaatggaatggaatggaatggaatggaatggtacggaatagaatggaatggaacgaaattcaatggaatggaatggaatggagtggaatcattccgagtggaataaaagggaatgttttcgagtggaatggaaaggaatggaatcaacccgagtggaatggaagggaatggaatggaatggaaaagaatagaacggaatcaacccgattggaatggaatggaaaggaatggaatggaatgcaatggaatggaatggaatgcaatggaatggaatcaactccagtgcaatggaatggaatggaatggaatggaatggaatggaatggaatggaatcaacccgaacagaatggaataaattgaatcaacccgattggaatggcatggaatggaaaggaatggaatggaatggaatggtacgcaatagaatggaatggaacgaaatggaacggaatggattcaacccaattggaatggaatcgaatggaattgaattgtgtggaacggaatggaatgtaatggagtgtaaaggaattgaatagaatcaacccgaatggaatggaatggaacagaatcaatggaatggaatggaatggtatggatagaatggaatgaaatggaatagaatggattcaacccaattgggatggaatggaatggaatgcaatggaattgtgtggaatggaatggaatggaatggattgtaaagaattgaatagaatcaacccgaatggaatggaatggaatggaatggaatgcaatggaatggaatggaatggaatcatctcgagtggaatggaatggtatggaatggattggaatggaatgcaatggaatggaatggaatcattcggagtggaatagaagggaaattcatcgagtggaatggaaaggaatggaatcaacccgagtggaatggaagggaatggaatggaatggaaaggaatggaatggaatcaacacgaatggaatggaatggaatggaatggaatggaatggaatggaatggaatggaatggaatcagcccgagtagaatggcatggaatggaatagaatggaatggaatggaatggaatggaatggaacggaatggaatggaatggaatggaatggaatggaatggaatcaaatcgagtggaatggaatggaatggaatggattggaatggaatgcaatggaagggaatggaagggaatggaatggaatggaatcattccgagtggagtggaaggaaatgtaatcgagtggaatggaaatgaaatcaacacgactggaatggaagggaatggaatggaatggaaaggaatggaatggaagaaacacgagtggaatggaatggaaacaaatggaatggaatggaatggaatggaatggaatggaatggaatcaacccgagaggaatggaatggaatggaatcgaatcgaatggaatcaacccgaatggaatggagtggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1759 - DNA, 1684 bp, Homo sapiens
aatggagtgtaaaggaattgaatagaatcaacccgaatggaatggaatggaatggaacggaatggaatggaatggaatggaatggaatgcaatggaatggaatcaaatcgagtggaatggagtggaatagaatggattggaatggaatgcaatggaagggaatggaagggaatggaatggaatggaatcattccgagtggaatggaaggcaatgtaatcgagtggaatggaaatggtatcaacacgagtggaatggaagggaatggaatggaatggaaaggaatgggatggaatcaacacgagtggaatggaatggaaacgaatggaatggaatggaatggaatggaatggaatggaatggaatggaatcgaatggaatggaatcaacccgagagcaatggaatggaatggaatggaatggaatggaatggaatggaatggaatggaatcaacccgaatggaatggagtggaacggaatcaacccgagtggaatggcatggaatggaatggaatggaaaggagtggaatggtacggaatagaatggaatggaacgaaatggaatggaatggattcaacacaattggaatggtatggaatggaatcaacccgagtggaatggcatggaatggaatggaatggaatggaatggaatggaatggaatggtacggaatagaatggaatggaacgaaatggaatgaaatggattcaaccgaattggagtggaatggaatggaatggaattgtgtggaatggaatggaatggaatagagtgtaaaggaattgaaaagaatcaacccgaatggaatggaatggaatgtgaaggaatggaatggaatggaatggaatggaagggaatggaatggaactgaatcaaacagagtggaatggaatgcaatggaatggaatggaatggaatggaatggaatggaatggaatggaatggaatggaatctaccagaatggaatggaatggaatgcaatggaatggaatggaatggagtctaccagaatggaatggaatggaatggaatggaatggaatggaatggaatggaaaggaatggaattgtgtggaattgaatagaatggaatggagtgtaaaggaattgaatagaatcaacccgaattgaaaggaatggaatggaacggaatggaatggaatggaatggaatggaatggaatggaatcaaatcgagtggaatggaatggaatggaatggattggaatggaatgcaatggaagggaatggaagggaatggaatggaatggaatcattccgagtggagtggaaggaaatgtaatcgagtggaatggaaatgaaatcaacacgactggaatggaagggaatggaatggaatggaaaggaatggaatggaagaaacacgagtggaatggaatggaaacaaatggaatggaatggaatggaatggaatggaatggaatggaatcaacccgagaggaatggaatggaatggaatcgaatcgaatggaatcaacccgaatggaatggagtggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1760 - DNA, 2261 bp, Homo sapiens
gaattgaatagaatggaatggagtgtaaaggaattgaatagaatcaacccgaatggaatggaatggaatggaacggaatggaatggaatggaatggaatggaatgcaatggaatggaatcaaatcgagtggaatggagtggaatagaatggattggaatggaatgcaatggaagggaatggaagggaatggaatggaatggaatcattccgagtggaatggaaggcaatgtaatcgagtggaatggaaatggtatcaacacgagtggaatggaagggaatggaatggaatggaaaggaatgggatggaatcaacacgagtggaatggaatggaaacgaatggaatggaatggaatggaatggaatggaatggaatggaatggaatcgaatggaatggaatcaacccgagagcaatggaatggaatggaatggaatggaatggaatggaatggaatggaatggaatcaacccgaatggaatggagtggaacggaatcaacccgagtggaatggcatggaatggaatggaatggaaaggagtggaatggtacggaatagaatggaatggaacgaaatggaatggaatggattcaacacaattggaatggtatggaatggaatcaacccgagtggaatggcatggaatggaatggaatggaatggaatggaatggtacggaatagaatggaatggaacgaaattcaatggaatggaatggaatggagtggaatcattccgagtggaataaaagggaatgttttcgagtggaatggaaaggaatggaatcaacccgagtggaatggaagggaatggaatggaatggaaaagaatagaacggaatcaacccgattggaatggaatggaaaggaatggaatggaatgcaatggaatggaatggaatgcaatggaatggaatcaactccagtgcaatggaatggaatggaatggaatggaatggaatggaatggaatggaatcaacccgaacagaatggaataaattgaatcaacccgattggaatggcatggaatggaaaggaatggaatggaatggaatggtacgcaatagaatggaatggaacgaaatggaacggaatggattcaacccaattggaatggaatcgaatggaattgaattgtgtggaacggaatggaatgtaatggagtgtaaaggaattgaatagaatcaacccgaatggaatggaatggaacagaatcaatggaatggaatggaatggtatggatagaatggaatgaaatggaatagaatggattcaacccaattgggatggaatggaatggaatgcaatggaattgtgtggaatggaatggaatggaatggattgtaaagaattgaatagaatcaacccgaatggaatggaatggaatggaatggaatgcaatggaatggaatggaatggaatcatctcgagtggaatggaatggtatggaatggattggaatggaatgcaatggaatggaatggaatcattcggagtggaatagaagggaaattcatcgagtggaatggaaaggaatggaatcaacccgagtggaatggaagggaatggaatggaatggaaaggaatggaatggaatcaacacgaatggaatggaatggaatggaatggaatggaatggaatggaatggaatggaatggaatcagcccgagtagaatggcatggaatggaatagaatggaatggaatggaatggaatggaatggaacggaatggaatggaatggaatggaatggaatggaatggaatcaaatcgagtggaatggaatggaatggaatggattggaatggaatgcaatggaagggaatggaagggaatggaatggaatggaatcattccgagtggagtggaaggaaatgtaatcgagtggaatggaaatgaaatcaacacgactggaatggaagggaatggaatggaatggaaaggaatggaatggaagaaacacgagtggaatggaatggaaacaaatggaatggaatggaatggaatggaatggaatggaatggaatcaacccgagaggaatggaatggaatggaatcgaatcgaatggaatcaacccgaatggaatggagtggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1761 - DNA, 2571 bp, Homo sapiens
atggaatggagtggaatggaatggaatggagtggaatggaatggaatggagtggaatggaatggaatggaatggaatcaaaccgagtgcaatggaatggaatcgaatggaatggaatggaatggaaaggattcaacccgaatgttatggaaaggcatggaatcaacccgagtgtaatggcatggaatggaatggaatggaatggaatgccatggaatggaatggaatggaatggtacggaatagaatggaatggaacgaaattgaatggaatggaatggaatggagtggaatcattccgagtggaataaaagggaatgttttcgagtggaatggaaaggaatggaatcaaaccgagtggaatggaagggaatggaatggaatggaaaataatagaatggaatcaacccgagtggaatgtaatggaaaggaatggaatggaatggaatggaacggaatggaatggagtcaacgcgagtggaatggaatggagtggaattgattggaatggaatgcaatggaatggattggaataattccgagttgaatggaagggaatgtaatcgagtgaaatggacaggaatggaatcaacccgagtggaatggaagggaatggagtggaatggaagggaatggaatggaatggaaaggaatggaatgcaatcaacccgagtggaatggaattgaatggaatggaatggaatcatcccgaatggaatggagtggaatggaatcaaatgcaatggaatgtaatggaatggaatggaatcaactcgagtgcaatggaatggaatggaatggaatggaatggaatggaatggaatggaatggaatctaccagaaaggaatggaatggaatggaatggaatggagtggaatgtacccgaatggaatggaatggaatggaatcgtatggcgtggaatggaatgagacggaatagaatggaatggaatcaaatcgcatggaatcgaatggaatggaactgaatcgaacagagtggaatggaatggaatggaatggaatggaatggaatggaatggaatcacccgaatggaatggagtggaatggaatggaatgaagtggaatggaatggaatggaatgaaatcattccgagtggaatggaagggaatgtaatcgagtggaatggaaaggaatagaatcaacccgagtggaatggaagggaatggaatggaaaggagtggaatgtaatcaacacgagtggaatggaatggaaacaaatagaatggaatggaatggaatggagtgtaatagaatggaatcgaatcaacccgagagcaatggaatggaatggaatggaattgaatggaatggaatcaacccgaatggaatggagtggaatggaatcaacccgagtggaattgcatggaatggaatggaatggaaaggagtggaatggtacggaatagattggaatggaacgaaatggaatggaatggattcaacccaattggaatggtatggaatggaatcaacccgagtggaatggcatggaatggaatggaatggaatggaatggaatggaatggaatggtacggaatagaatggaatggaacgaaatggaatgaaatggattcaaccgaattggagtggaatggaatggaatggaattgtgtggaatggaatggaatggaatagagtgtaaaggaattgaaaagaatcaacccgaatggaatggaatggaatgtgaaggaatggaatggaatggaatggaatggaagggaatggaatggaactgaatcaaacagagtggaatggaatgcaatggaatggaatggaatggaatggaatggaatggaatggaatggaatggaatggaatctaccagaatggaatggaatggaatgcaatggaatggaatggaatggagtctaccagaatggaatggaatggaatggaatggaatggaatggaatggaatggaaaggaatggaattgtgtggaattgaatagaatggaatggagtgtaaaggaattgaatagaatcaacccgaattgaaaggaatggaatggaacggaatggaatggaatggaatggaatggaatggaatggaatcaaatcgagtggaatggaatggaatggaatggattggaatggaatgcaatggaagggaatggaagggaatggaatggaatggaatcattccgagtggagtggaaggaaatgtaatcgagtggaatggaaatgaaatcaacacgactggaatggaagggaatggaatggaatggaaaggaatggaatggaagaaacacgagtggaatggaatggaaacaaatggaatggaatggaatggaatggaatggaatggaatggaatcaacccgagaggaatggaatggaatggaatcgaatcgaatggaatcaacccgaatggaatggagtggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1762 - DNA, 5685 bp, Homo sapiens
gaatggaatggaatggaaaggagtggaatggtacggaatagaatggaatggaacgaaatggaatggaatggattcaacccaattggaatggtatggtatggaatggaatggaattgtgtggaatggaatggaatggaatggagtgtaaaggaattgaatagaatcaccccgaattgaatggaatggaatgcaacggaatggaatggaatggaatggaatgaatggaatggaatggaatggaatgggatcaactcggctggaatggaatggaatggaatggattggaatggaatgcaatggaatggaatggaacggaatggaatcaacccgaatgcaatggaatggaatgggatggaatggaatggagtggaatggaatggaatggaatggtttcaacccgaatggaatggaaaggaatggaaaggaattgtgtggaattgaatagaatgggatggagcgtaaaggaattgaaaagaatcaacccgaatggaatggaatggaatggaacggaatggaatggaatggaaaggaatggaatggaatcaaatcgagtggaatggaatggaatggaatggattggaatggaatgcaatggaagggaatggaagggaatggaatggaatggaatcattccgagtggaatggaaggcaatgtaatcgagtggaatggaaatggtatcaacacgagtggaatggaagggaatggaatggaatggaaaggaatggaatggaatcaacacgagtggaatggaatggaaacgaatggaatggaatggaatggaatggaatggaatggattggaatggaatcaacctgagagcaatggaatggaatggaatggaatggaatggaatggaatggaatggaatggaatcaaaccgaatggaatggagtggaatggaatcaacccgagtggaatggcatggaatggaatggaatggaaaggagtggaatggtacggaatagaatggaatggaacgaaatggaatggaatggattcaacacaattggaatggtatggcatggaatcaacccgagtgtaatggcatggaatggaatggaatggaatggaatgccatggaatggaatggaatggaatggtacggaatagaatggaatggaacgaaattgaatggaatggaatggaatggagtggaatcattccgagtggaataaaagggaatgttttcgagtggaatggaaaggaatggaatcaaaccgagtggaatggaagggaatggaatggaatggaaaataatagaatggaatcaacccgagtggaatgtaatggaaaggaatggaatggaatggaatggaacggaatggaatggagtcaacgcgagtggaatggaatggagtggaattgattggaatggaatgcaatggaatggattggaataattccgagttgaatggaagggaatgtaatcgagtgaaatggacaggaatggaatcaacccgagtggaatggaagggaatggagtggaatggaagggaatggaatggaatggaaaggaatggaatgcaatcaacccgagtggaatggaattgaatggaatggaatggaatcatcccgaatggaatggagtggaatggaatcaaatgcaatggaatgtaatggaatggaatggaatcaactcgagtgcaatggaatggaatggaatggaatggaatggaatggaatggaatggaatggaatctaccagaaaggaatggaatggaatggaatggaatggagtggaatgtacccgaatggaatggaatggaatggaatcgtatggcgtggaatggaatgagacggaatagaatggaatggaatcaaatcgcatggaatcgaatggaatggaactgaatcgaacagagtggaatggaatggaatggaatggaatggaatggaatggaatggaatcacccgaatggaatggagtggaatggaatggaatgaagtggaatggaatggaatggaatgaaatcattccgagtggaatggaagggaatgtaatcgagtggaatggaaaggaatagaatcaacccgagtggaatggaagggaatggaatggaaaggagtggaatgtaatcaacacgagtggaatggaatggaaacaaatagaatggaatggaatggaatggagtgtaatagaatggaatcgaatcaacccgagagcaatggaatggaatggaatggaattgaatggaatggaatcaacccgaatggaatggagtggaatggaatcaacccgagtggaattgcatggaatggaatggaatggaaaggagtggaatggtacggaatagattggaatggaacgaaatggaatggaatggattcaacccaattggaatggtatggtatggaatggaatggaattgtgtggaatggaatggaatggaatggagtgtaaaggaattgaatagaatcaacccgaattgaatggaatggaatgtaacagaatggaatggaatggaatggaatggaatggaatggaatggaatggaatcaactcgggtggaatggaatggaatttaatggattggaatggaatgcaatggaatggaatggaatggaatggaatcattccgagtggaatggaagtgaatgtaatcgagtggaatggaaaggaatggaatcaaccccagtgcaatgcaatggaatggaatggaatggaatggaatggaatggaatggattcaacccgattggaatggaatggaatggaattgtgtggaatggagtggaatggaatggactcaacccgattggaatggaatggaatggaatggaattgtgtggaattgaatagaatggaatggagtgtaaaggaattgaatagaatcaacccgaatggaatggaatggaatggaacggaatggaatggaatggaatggaatggaatgcaatggaatggaatcaaatcgagtggaatggagtggaatagaatggattggaatggaatgcaatggaagggaatggaagggaatggaatggaatggaatcattccgagtggaatggaaggcaatgtaatcgagtggaatggaaatggtatcaacacgagtggaatggaagggaatggaatggaatggaaaggaatgggatggaatcaacacgagtggaatggaatggaaacgaatggaatggaatggaatggaatggaatggaatggaatggaatggaatcgaatggaatggaatcaacccgagagcaatggaatggaatggaatggaatggaatggaatggaatggaatggaatggaatcaacccgaatggaatggagtggaacggaatcaacccgagtggaatggcatggaatggaatggaatggaaaggagtggaatggtacggaatagaatggaatggaacgaaatggaatggaatggattcaacacaattggaatggtatggtatggaatggaatgaaattgtgtggaatggaatgaaatggaatggagtgtaaaagaattgaatagaatcaacccgaattgaatggaatggaatggaacggaatggaatggaatggaatggaatgcaatggaatggaatggaatggaatggaatcattctgagtggaatggaatgcaatggaatggaatggaatggaatggaatggaatggaatggaatggaatcaacccgaacagaatggaataaattgaatcaacccgattggaatggcatggaatggaaaggaatggaatggaatggaatggtacgcaatagaatggaatggaacgaaatggaacggaatggattcaacccaattggaatggaatcgaatggaattgaattgtgtggaacggaatggaatgtaatggagtgtaaaggaattgaatagaatcaacccgaatggaatggaatggaacagaatcaatggaatggaatggaatggtatggatagaatggaatgaaatggaatagaatggattcaacccaattgggatggaatggaatggaatgcaatggaattgtgtggaatggaatggaatggaatggattgtaaagaattgaatagaatcaacccgaatggaatggaatggaatggaatggaatgcaatggaatggaatggaatggaatcatctcgagtggaatggaatggtatggaatggattggaatggaatgcaatggaatggaatggaatcattcggagtggaatagaagggaaattcatcgagtggaatggaaaggaatggaatcaacccgagtggaatggaagggaatggaatggaatggaaaggaatggaatggaatcaacacgaatggaatggaatggaatggaatggaatggaatggaatggaatggaatggaatggaatcagcccgagtagaatggcatggaatggaatagaatggaatggaatggaatggtacagaatagaaatgaatggaacgaaatggaatagaatgcattcaacccacttggaatggaatggaatggaatggaattgtgtggaatggaagggaatggaatggagtgtaaaggaattgaatagaatcaacccgaatgcaatgggatggaatggaacggagcggatgggaatggaatggaatggaatggaatggattggaatggaatggaatggaatggaatcaacccgaatagaaaggaatgaaatggaatcaacccgattggaatggcatggaatggtaaggaaatgaaaggaatggaatggtacggaatagaatggaatggaacgaaatggaatgaaatggattcaaccgaattggagtggaatggaatggaatggaattgtgtggaatggaatggaatggaatagagtgtaaaggaattgaaaagaatcaacccgaatggaatggaatggaatgtgaaggaatggaatggaatggaatggaatggaagggaatggaatggaactgaatcaaacagagtggaatggaatgcaatggaatggaatggaatggaatggaatggaatggaatggaatggaatggaatggaatctaccagaatggaatggaatggaatgcaatggaatggaatggaatggagtctaccagaatggaatggaatggaatggaatggaatggaatggaatggaatggaaaggaatggaattgtgtggaattgaatagaatggaatggagtgtaaaggaattgaatagaatcaacccgaattgaaaggaatggaatggaacggaatggaatggaatggaatggaatggaatggaatggaatcaaatcgagtggaatggaatggaatggaatggattggaatggaatgcaatggaagggaatggaagggaatggaatggaatggaatcattccgagtggagtggaaggaaatgtaatcgagtggaatggaaatgaaatcaacacgactggaatggaagggaatggaatggaatggaaaggaatggaatggaagaaacacgagtggaatggaatggaaacaaatggaatggaatggaatggaatggaatggaatggaatggaatcaacccgagaggaatggaatggaatggaatcgaatcgaatggaatcaacccgaatggaatggagtggaatggaatcaacccgagtggaatggcatggaatggaatggaatggaaaggagtggaatggtacggaatagaatagaatggaatggaatgaaatggaatggaatggattcaacacaattggaatggtatggtatagaatggaatggaattgtgtggaatggaatggag

SEQ ID NO: 1763 - DNA, 1754 bp, Homo sapiens
tgattccattccattccattcccttccattcccttccattgcattccattccaatccattccattccattccattccactcgatttgattccattccattccattccattccattccattccattccgttccattccattcctttcaattcgggttgattctattcaattcctttacactccattccattctattcaattccacacaattccattcctttccattccattccattccattccattccattccattccattccattctggtagactccattccattccattccattgcattccattccattccattctggtagattccattccattccattccattccattccattccattccattccattccattccattgcattccattccactctgtttgattcagttccattccattcccttccattccattccattccattccattccttcacattccattccattccattcgggttgattcttttcaattcctttacactctattccattccattccattccacacaattccattccattccattccactccaattcggttgaatccatttcattccatttcgttccattccattctattccgtaccattccattcctttcatttccttaccattccatgccattccaatcgggttgattccatttcattcctttctattcgggttgattccattccattccattccattccaatccattccattccattccattccattcccatccgctccgttccattccatcccattgcattcgggttgattctattcaattcctttacactccattccattcccttccattccacacaattccattccattccattccattccaagtgggttgaatgcattctattccatttcgttccattcatttctattctgtaccattccattccattccattctattccattccatgccattctactcgggctgattccattccattccattccattccattccattccattccattccattccattccattcgtgttgattccattccattcctttccattccattccattcccttccattccactcgggttgattccattcctttccattccactcgatgaatttcccttctattccactccgaatgattccattccattccattgcattccattccaatccattccataccattccattccactcgagatgattccattccattccattccattgcattccattccattccattccattccattcggggtgattccattccattccattccattccattccattccattccattccattccattccactctattccattccattgcattccattccattccattccattgcactcgcgttgattccattccttccattccactcgattacattcacttccattccactcagaatgattccattccattccattccattccattgcattccattccattccattccattccgttccattccattccattcaattcgggttgattctattcaattcttttacactccattccatttcattccattccacacaatttcattccattccataccataccattccaattgtgttgaatccattccattccatttcgttccattccattctattccattccattccattccattccattccattccattccattccattccattccattgcactcgagttgattccattccattccattacattccattgcatttgattccatt

SEQ ID NO: 1764 - DNA, 312 bp, Homo sapiens
gaacaaactctggacacgacgcctttaagaactgtaacatgtaatcccagcactttgggaggccaaggcgggtggatcacgaggtcaggatatcgagaccatcctggctaacacgggatattttggtctgtttcaaagaagaggaaatcagcccctagcagagtgtttcagaaaagcagcagaagaaaagaaaaaagattaaagccatatctcttggggagagagataaaaatctggattttgtttgaaacaatgtttccatttccaacacctcaggtccataaaaagtaggagaaaaaaagtcttcttggg

SEQ ID NO: 1765 - DNA, 341 bp, Homo sapiens
agaaaacgctgatgcggcacctccatcgagggatcacccctcttttgggctttcctggcgcgtgttgtatgatctggttacgtccttggaccctacagacacaaagggaagctggtttgaaaaaactgttgagttggcatgctccctccgtcgtctagatatttgggctgagaaaataatttcaagcaaggctgggaaacacaaaagtaaatagtatgaaatgatgtcagcaaaaaatgggaaaaaagtagggaactcaaaaatgaataagctggcaaaactgtcaggagcaccttttttggaaactctgaaactgataaaaaaaactcacaaaatccagg

SEQ ID NO: 1766 - DNA, 1216 bp, Homo sapiens
gtagtttcacagtaaattgcctaagatttcttaagatatatttatctgagggctcattttcaccaagctccaaacagttgcctctgataactctttcgaggtcactatccaaatgtcaccttatcagtgagcagtcacttaaacaccaataaaaaatagcaacatcctttccccttcaccttagcaccccctatacatcttacttcagcttatttcattttccagattgccatctgatatactacatatatatatgattttgttattgttgcttattttctctgttctctctgttgtaaattccttaagatctgagactgtattagttagcttttccaatataacaaattattccaaattttagtgccttaaaataacaaccatttatttagttcaaaagtctgtgctttgataatttagattgaatgaagctgagagtttcttctggtctaggctgccctcactcttgtgtctaccgtcagctgccaagtctgtcgggctttagctgatccagaatggcctcagctgggatgactcctctgctccatctggtctccttgtctccagcaagtgagcacaggattgttcacatgacagttgggcagggttacaaggaagcaagtggaagacaacagagcctcttgagttccatggtcagaactggtaccacatcaatgctgccccatcgtactcatcaaagcaaggcataaggccagcccagattcaaggtataagaaaagctccttgaattactggcctggacaacgttctcaaaggcagggcaattgcgcggggttataggcagttggcatgataatacttgggatagtgtcagatatggaaatgtctgtggattctactcatttccctattcttgccattgccacataagcaaagtagatggaaaaataaaagaaattcactggatacattagcctcactgctatggtctgaaagtttgtgtccccctaaaatgcaagtgttgaaacctaatcaccaatgtaaaagtattaccaggtgcagtattggggaggtgattaggtcagaaggaaagaggcttcatgaatgagattcatgcacttataaaagaggcttcagagaggttcctgtcgctcttgccatgggaggttacagagaaaagacagccatctgtgaacaagttagcagtccctcaccagacaacaaacctgctagtaccttgattttggacttccca

SEQ ID NO: 1767 - DNA, 474 bp, Homo sapiens
gacacctgtgatactgccaatttctccacttcactgctgccatagacaatgtagtgagtaagttttttggcatttattttctggccatgatggatttaccctaactcctgaaatgaataaaaacagacaaaatatttgaaacaatgattttcaaaatactggacatcaagaaatgaaggaccgtggtccctgaaggatggagaaaaaaaagaggtgagcactatgattatccccagattactaccttgatagaatttccaggccatggagcaggaagggagaaccctgcagagcctggcacactccttatgttgaggaagtggaactaagagttcagagaaaccaacgaaggtacagttgacaaggcagaataatggagagaacagggctgcacacagagaaccccaaagaactgcatagagttgcctttgtaaattcacccaagtactgcagcacattgtgtgagtaaagtgc

SEQ ID NO: 1768 - DNA, 1081 bp, Homo sapiens
tgactgcttggccctgtttttggaaatgtccaactgtattttttacttgtttcaggggtacggatatgcaggattgattctacatccatctgatacaatttcagtctaagatgctcgtgggtcagcaaatgactctgccctacatgtggttgctgaatccctaaaagaaacagagatttcagaaaatcatagaggtgtctcttgttctgatagtccttaagttactggccaaatacataaagaagcgaatttcaaatcagagttctacaaatgcctaataaactgctgaccgaggaatctgtgattggttttatcaataccaacaggaaaaccacaggagaacctgagggaacattctgaagaagatacctaattttatagctaagatggtcatccattctttcactaagaagaatggaaacacagtttgccgtcagatccttccatattgcctttccagtaaagcggagaggacgatttataatttctcttaagtgttcattttaggccttgttgttttacttttcaaaaatgttccagacattgcaaataacttaggaagagtgaaggatgacagatcaattagctgggaaataaaaaatgagaagactgggggacattggtactggaaaatttcacttacctgggcagctaggatccaggggaagctgacgttgaagagaggataaatacaaagtgtttcctggtgcctttaataatgtggcaatagaaagaacaagctaaggaaattcaatcaaaggcaggtaatagcaacttcccattgctttaaaaagtaataataaccacaacacactatgagataaagctccaggagaaacaataaacaaaagagaagaaatgcacccttgagacttggggttctaaatggcaataatcacttgccaaagattattgtgtgactattaaccacaactattcctttggccatccagcaagagctgaggagcataagggcaccagagattcatcctgtgtgaaaggtaaatatctgagtggaatgactggatcatatgccctttaaagacatcagtgcattatcttttggcttccatggtttctg

SEQ ID NO: 1769 - DNA, 2607 bp, Homo sapiens
aataggatatagcatattttacttaaaaatccaaattataaaataaagagggattttaagttgagtctaaaatttttgtttcaattttgtttttatttaaagacttgctataattctgtgagagagctataaaagtctgctcagaaacattataatgtaaaatggacagagaaggacaatgagatatttaatttgccacggcaaagccattgctgtgaagaatggataatatatgtcaatggtaatatatgaagaaataacacaggtgaatagcagaggcaataaatctgtttttaccacaggacttgtcttacacttttctcttagtaataaataaaataattttcgaccagatggagctggcttgaaatcctcttgtttatggcagtacatatcggttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggtgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacggtaagaacacatggacacagggtggagaacaatacacactggggcttgatggggggtggaggggagggatggggagcattagaaaaaataactaatgcatgctgggcttaatacctatgtgatgggttgataggtgcagcaaaccaccctggcacatgtttatcaatgtaacaaacctgcacatcctgcacaggtactccaaaactaaaagtaaaaaaatctaaaagaaaaaaaaaaaagaattaaacccaaaatcacttccccatctggacttgatttagatgaaaagcttctggactttgagctgatgctatagtgggttgaaaattttggggtcctcagaaggggatgaggatatattgcatgagagagcaacatgaatcattgagagccagagtatagagagtggtaggtagactgtaggagagccctcaatgatcccggctttcttgtattcgcgttgcacttacttgtataatatggcagatgggatgtgatgtcactttcaagattaggttataaatagactatggcttcaatcagagggttttctctctgtctagctctcttttgggtagttcattctgaggaaagccagctgccacgttatgatgtaggcctgtgaggtccacgtagcaaagaacatatggaagatttctaccaccccctaactaagcctttagatcagaccgcaaccccagccaacaaggtagctacaaactcttgagaagccttgagacagaggtactcaatagagccattcctatgagaaacgtaagtatctgctgttttacaccgctaaggttttagctaatgtattatgccataatagataagttatatacaacctttatcaaataataaaagtaaccatcatcagtaatgagacaaatcaaaaaccatggcccacccaacagaacataatgaggagagtacagaattgcttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgagaaaactctgcttttagggcatagatagaagtggatgataattcacctgttcctctgctactaattgagctgctctctgtttccatggctggctcatg

SEQ ID NO: 1770 - DNA, 3581 bp, Homo sapiens
gttgaatttagctcacagagtttagcttgctgcccctgcaggaggcctttggagtaaaagcttcctgagaggaggactttttgtcttttttgctcaagttctagctccagtacctaaaatagtgcctgtcaacgtaggtattgatgaatattggaacctgttgaacatacacctaaaataaaacatttggcaagatacagtactacacaatttggagaacacttggctcccatagaaatcaaagccttcctgagtaattaattatttggcctgatgatgaattactgtgcctgagatgatagagctaatttatttttcaattcactcaggggacacacgttattttcactgtgaatttggttaaaatgaaaagatttcctgctctaagtcctggatagacctttatgtaatagcatactcttcactctttttgaatcgcatgcagttgtcagactggatgatttccagacagaggttccaagtctttcatcatgtttgggttaaagacctcattaacatactagtcctgccatttgagtctgttctcttcacggaatattttcacctgaatcagtgggtataattcatcagtgtctggttgcttcaagttatttttcttaatgctgatgttaatgcatgcccatctttatgcctcaacacattgcacaatgaaaaacaaaaattattttggaagacacagctgacatctatatgaaatattcagtatcagtgattgaacttcagcaagctcctgtggccagcagggttttacggaggtgcaactgctctcccacgatcacttatcataaagccagagacaattgggccaatgtagcctcttgcctgcttttgtgtacaaaatataaatagaatagagcaaataaggaaaaatagtcccgcagctggaaggcaactttaaagaaaaatgatgttcatagctgtcttgccagtagctggcaaagcagtttttataagacatatttaatgtttacaaccacttggaggctggggaaggagtaatactttgaaaatatgtttaatgttgtgaaccactctgtggccgagaagcaactccggctaaaatatatttaatgcttagagtcatttggcggtttcgaaaaaaagaaacttcttgttaatttttaacatttattgctgatcagtggctgctaaagtaactatcagtacagcatgatttatatttagggacacgctgtgctgctactaaaacaattcatactcttctctcaaggctacacaaaaagtgtcaatagcattacctttgcaattgcaccactaataaaaacataggaatcaaacagacgaataaaatgctccctgcccacacagccataacatcctatggccctgaaaatagttctgccaagctgcgtgcagtggacacttcacggctggcacaggagagatcacaaggccttgctcaatttcatcaaaagtgttaaagcgactcagcagattgtgaagcacaagtggaagctgataattggtgtttcttacaaatcaacggcttgtctccacacatcaaggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggtgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacggtaagaacacatggacacagggtggagaacaatacacactggggcttgatggggggtggaggggagggatggggagcattagaaaaaataactaatgcatgctgggcttaatacctatgtgatgggttgataggtgcagcaaaccaccctggcacatgtttatcaatgtaacaaacctgcacatcctgcacaggtactccaaaactaaaagtaaaaaaatctaaaagaaaaaaaaaaaagaattaaacccaaaatcacttccccatctggacttgatttagatgaaaagcttctggactttgagctgatgctatagtgggttgaaaattttggggtcctcagaaggggatgaggatatattgcatgagagagcaacatgaatcattgagagccagagtatagagagtggtaggtagactgtaggagagccctcaatgatcccggctttcttgtattcgcgttgcacttacttgtataatatggcagatgggatgtgatgtcactttcaagattaggttataaatagactatggcttcaatcagagggttttctctctgtctagctctcttttgggtagttcattctgaggaaagccagctgccacgttatgatgtaggcctgtgaggtccacgtagcaaagaacatatggaagatttctaccaccccctaactaagcctttagatcagaccgcaaccccagccaacaaggtagctacaaactcttgagaagccttgagacagaggtactcaatagagccattcctatgagaaacgtaagtatctgctgttttacaccgctaaggttttagctaatgtattatgccataatagataagttatatacaacctttatcaaataataaaagtaaccatcatcagtaatgagacaaatcaaaaaccatggcccacccaacagaacataatgaggagagtacagaattgcttctgggatatttctgacaaagatgtatatgcttcattcatacatgaggaaacatcacacatactcaagatgggagagccattctaaaaaataactaggcagaaatcttcaaaaatattaaagtcacggaaaccaagaaaaaatatgaacctgtttcagattaaaggaaactaaacagacctaacattttaatacaatgtttgattttgaacttgaactttttgttatataagacactattgagacaagtgctaatgcttgaatagggctgaaggattagattataataatacattaatgcaaatttcctgattttaaacattgtagtttgattgcacaaggagaatgtctttatgtgtggaaaataaatagtcaacattctgtcttcaagcttctgagaaaactctgcttttagggcatagatagaagtggatgataattcacctgttcctctgctactaattgagctgctctctgtttccatggctggctcatg

SEQ ID NO: 1771 - DNA, 1157 bp, Homo sapiens
ttaagttgagtctaaaatttttgtttcaattttgtttttatttaaagacttgctataattctgtgagagagctataaaagtctgctcagaaacattataatgtaaaatggacagagaaggacaatgagatatttaatttgccacggcaaagccattgctgtgaagaatggataatatatgtcaatggtaatatatgaagaaataacacaggtgaatagcagaggcaataaatctgtttttaccacaggacttgtcttacacttttctcttagtaataaataaaataattttcgaccagatggagctggcttgaaatcctcttgtttatggcagtacatatcggttatgattcaaaaaatatagcccatttccaaaaacctgcaacaaagagatactttctcaggtgtcagtttcttggtcgggaatgaaaatagtgccaacctgtgataccttcactctaattttactttctgaggaagttttctgtaatagttatttggtgataattattaatactggtgagaaaatcaatgtaaaagaggagaaataacccacacaaccacatacaactaggaaatgatagatggatctgaaaaaaaggatatgcactcttaacaagttcaacacccaagtactattgcaagtaccagctgtatttcatggaaaaaaaaaaaagaataactcaaaaggcagaacgaagagcctagaggtcagagatgagaggcatgaataattattcacaggcgttgaatataatcaaatgacttgcaacatttaccactgggattttaaaatgtggtggaccaatcattcttttagtctgtgcattttcccatttttttcaacaggaatgtctagagacattattcctgttttgccactgtatttttggtgaatgtgtagtaagtaactggcctctttagtatcacaaagctggatgaagaaaatgtggtacatatacaccatgaaatactatgccgccacaaaaaggaaatgagatcatgtcctctgcagggacatggatgaagctggaagccattatccttagcaaagtaacgcaggaacagaaaaccaaacaccacatgttgtctcttagaagtgggagctgaacggtaagaacacatggacacagggtggagaacaatacacactggggc

SEQ ID NO: 1772 - DNA, 1157 bp, Homo sapiens; identical to SEQ ID NO: 1771

SEQ ID NO: 1773 - DNA, 597 bp, Homo sapiens
cgtggaagctaagctgggtaagtatggaaaggaggccacatgggattgaggacagtgagaacacctggatcaatggattgttggtctgtggcattatctggaaaggaatgtgggaactatggcttttagctttccagctctacagttttgaagacatcctagaaggaggatagagcagaggaggatggagcagaaggtaagagagccaatccacacaatattctcccccaaatattctacacatctttaaccatgtgcatgcacaacctcacttctaaacaaatgagatcacactatacctctgttctgcatttcaggttttccacgtattgtgtattagtggttgatccatctcagtacagacagctctacatcattcttttttatgctggcctcctatattactatacagctgtgccataatcagtttaaccagtcccctattcatgggaatttaggtagttttcagtcttttgcagtcacaagcaattctgcattgagcaagcttttgcctaagtttgtgtgtgttttgaggagtatgctagaataaatcaacatggattattctgaccccagagaacaagactttgttttccc

SEQ ID NO: 1774 - DNA, 1320 bp, Homo sapiens
atcctcagtagtggtcactgatggccactcacccagattcagcagcaaaacacagaagaggggacaacaacactgcctggtccttggttctggcacatcagctgttaccacccagcacaccctggagcctgcttcttcctgtccggccccccgcagtcactgtcccccaagatcatgtgtggcaagcgcccacggagcctagctaaggccatcaccagtggctgatgttgtgttactgtcaatgataaaagctgtgaaagctctggagggtttgaataattttatctagccttgaccactcttttaagtgtatatatcctattctcaatccactttcttatcaccgcctattctctgactttcttttctcccctgtagaaattgcttatcatgaagtaaacataaataaggttttttgactagctgcaaaactccagtggtgaacagtacacacagcatttctgatgtaatccctacttatataaaccaggatgttcctgagagatttaagccacagttgactttcttctctcctgtcaatgtcctgagcgtccttggcctactctggacatacaatttcttaagcgaggtgaaaactgagcaggacctggaaggatggatgggtttcaagaggaagagacagaagaaaagaaaggaaggaggaaaagctgtccagcagagtgaagtcccaggaagacgattcaaggtgcactactgaactggctttttgtcggaagataactccctcactctgataagaactcctgctccatctttcggctgcaaatggggctggatggtcagtgacccagggtggattatccaactgcggctcacgcagcacctccattgctctgggttctaagcagctgggtccgccgctgccccggcacctctgtcacggtgtgccaggggaatggaagcagatgggcgtacaacccagcgttagtgaaagttttggtgggggagaaagttaaagccactggctgatactgagagtgggcgatttatttcatcaagcctttatcaaagacaatgagggaggtcactgcttcttgtcaacccacttggaagtttcttcttgactttatttctaaaatatatcttgcctcggcctcttctctctgctcccattgtcaatggcactggtctagaccaaggctcatcttaacttctgtgatcacatcctaacaggtctccaggcagatttgtctcctaatctcttgtccattcagcagccagtgttttaagacataaataagatcatgccacacccatgattaaaagcttccagtgctttccatcatatttggaataaca

SEQ ID NO: 1775 - DNA, 1054 bp, Homo sapiens
attttcctcttgtgccagaggagattaattcacatggactcaaaagagccttggggacaggtttttggaaaaccagaccctggcattccggatgctaaaatgctgtcagtaatactaagagtgcttaggtctcctgcctcctcagccctctggaaagagccccagggttattcgagttgggatcaaataaagggggtcattatgataaaaagtgggtgacacccccattcctcacctagagaacttacttagccttcccatacaccttcttcagtaaaaatctcccttcaacttagatttcaatgtgaagattttggttccaccttgactgaatactggaatagtttttgttgcagactgggagccaacagtttaccttcagagtgagaatatgtatgggttccttaaaaacatgcagtatggccgggcaccatggctcatgcctgtaatctcaggactttgagaggccaaggtgggcggatcacttgaggtaagaagcttgagaccagacgccaacatggtgaaacctggtttctattaaaaatacaaaaattagcctggcgcagtggcgggtgcctgtaatcccagctactcggggggctgaggcaggagaataacttgaacctgggaggcagaggttgcagtgagctgagatcgagccactgcactccagcctgggcaacagagcaagactccgtctcaaaaaaaaaaaacaacaacatacaaaaatgcctttgggattcagcgtaatctgcaggttataaaagcaactgcaaggatgataggagcttttttcaccacagcctaggatgcctttgagaaaaccgacaaatttgaaaacatgataaaggtaacatctctctacttccccctggattcagcccctctactctgccaacattgctctcaccagggtacccagtgacctccaagttgcccactgtgggagcactcctgagtcctcatcttactggaacgctcctcacgaccatcagggaatcttctgctgcccatgaaaggaagcccaactcgaattgctgcaagcagaactgtg

SEQ ID NO: 1776 - DNA, 3611 bp, Homo sapiens
gttttcacagttttttaagtgtatgattcagcaacattaagcacattcacaacgttgtgtaaccatcaccacgtatccctttccagaacttttcatcatcccaaatagaaactctgtacccatttaataatagctccctattccttctaccctctccaccctccccacctgcccctgcagcctgtggcaacctctgttctactttatccctttataaattggcctattcaaggtacctcatataagtggaatcatataatatttgttttgtttgtgtctggcttgtttcacttagcataatactttcaagatccatgttgtggcatatatcagaatttcattacttttcaaggctgaataattttccattgtgtggatatatgatactttattaattcatctgttgatggatacttgggtcgattcccctgtttggttcttgtgactgttgctgttatgaacatttgtgtacaatttatctgagttcttgctttctagcatttttgtggatatttacctaggagtagaattgctggattttatgagaattctatgtttaactttttgaggaactgcaaaaggattgggtttgaattaggtaaacctaaaagagttgtagaacaatgtggtagctcactaggaaatcagtcttggggttagtgtctggttaatacacctgtatgtaattaattggcctctgagtcatgccttttatcacttcttttctaaaacatttattaagcacgtactttgtcgcaggccccattttggaatacaaactatagagagaagctcgcagttcattgcagaacacagttactttgcagtgcacaagttatatgacaaaggagaacactagcacagggcagtccagagggaagagagcttggctctttcccagaggaggtgacatctgcctgaggcttggtggaggagcaggagctggctagttgaagaagaggtaaaagacagttgcagagagtgtgctgtgcaaaggctcagaagagtgaagaaaatattgggacatacagaaagttagaatggatcgatacagcccgaagcataggatgttagggaaggacgtggcaaatgatggggatggagaagtagccaaaggccagagcaggaaggactttgtaagtcattttaaaagatttccatttcacactgaacgtaacggagaaatattgaggatttttttttttttgcaaagaaatgatgtaatcagaaatatattttatatagctattatgtacctacaaaaattaaaaattataacaaataggccgggcacagtggctcacgcctgtaattgcagcactttgggaggccgaggtgggcagatcacttgaggtcaggagttgaggccagcctggccaacatggtgaaaccctgcctctactgaaaaatacaaaaattagctgggcatggtagtgggcccctgtaatcccagctactcgggaggtcgaagcaggaggatcgcttgagcccgggaggcagaggttgcagtgagccaagatcatgccaccgcactccagcctgggcggcacagtgagacttcatctcaaaagaaaaaaaaattataaaaaataatatggtttataaatcaggcagctatgtaaatcacaatccctgttgagaggctgcattatggcagtagcggtgggaatggattcagagtctataggtggtagaaccggtaggacttcttgactaatttagatggcaaggaaaagaggaatgcaggatgcttctagatctcgtggacaaccagatgaataatctcatttccccagagagtgaattcagaagggcagaaactcagttttgtgagttctgttttgcattttacatgcctatcgaatatccaagtggaactgtgggtctagatggagctcgagagataactatgagctggagataaatatttgggagttgccactttatgtagtggtaattgagagcataagaaatggagagaatgcagggtgaaaatgtcatcttggggcagatgcaggacaagagcttgtgaaaggaatggccaagaggaataggtggacaaccagaggagtgggagctcacaggagccttgagtggagtttcagaaacccagatttcacacagaaacatcaacaaatcaacttcgcgtctcgaggtgatggtatttaaactgtgttctattgagacccttcattaatatttggttttgaaatatattttaacataagttaaaaatagcaaactcaaatatggtgtttctaacattttaaaactgaaatccagcaaacatcagtgccacgttaactgtttttttgtgcaggtgccagaataaggccatttctggtaaattgaagagcttcctggtatttcaagcaatccaggtaagagacacagaaaactgtaaatgatgcaaaaacagctgaactgaatatgagagatgttcaagagagagagcctctctgttatttagggtgacataaatagcgtctggaagcaggacctgaagtaggatcagttttggacagagctggcaattcttggtaccagtatgcagcacttacaggagccctttgagctctccactttcacggctcgcctcttctgccctggtgccaggatctatttttgtcatcaccagccaggaaggatacaaggcctcttccaagatgaagacgaaactattgacagatattttgtcaagaccaaattttccctaagggccctgtcatagattgttccctgggcaggatgcagcctccttcagagagtgaagaacacaccaaaagatcctctactaaattaatcataagccacatgaggcaggctggaatacagttaccaatctgctttaattctcccacttagatggcctgaagccgcctgaactgaaagttggatgaagctcggctttgagtttcatcgcggggcatcgtgtggcctaagtccttagccaatgcctgccaaatattagcttgagtcgcaataaagagaaaaggtccaaattctccccttgactaatgatttattcatcaaaccaacatgtctcaaacctgtaattctagttttgttttctgaaaagatgtcattctatttgaaagagaaacagctgtagggaaggagaataagaactttcatggaacacacagcatgtgtcgcgcactcagcatgtaaagtcacgtggcccttactacagccctggggaggtgagcagtggctctgcttcacatacaagcaccctgacactccaggaaatcggtcgtcacccagcaccctctaactagggaaggatggaatccgatttgaactcaggtgtgctttttttctccaggaagcatacttttctttgccatcttcagtgatgagagtaacagagacagaaagataaaaggagttgactgctcacgaggctgttgctggactttttaggacagtcactggaagattctagtgtgtcttctgaattgctgaccataattcattctcttccctcttttgcctggtttgttatttgatcccaagactgtgctataagttttgggttgataaaagagagctaagagtccatgaagcgctcacacctcccgtcgaatacctgattcctacaatgcctg

SEQ ID NO: 1777 - DNA, 457 bp, Homo sapiens
aaaaagtttccttattgtgaaattttgcaggagcttaagacatataagcaatagtttaaagcattaaaaggtcatttgcaattcacattgaagcctatatttctcttgcaggcattttaaaaggttgtgtgcatcagagtagaaaaagaaattgccttaatccaaataaatacagttttgctacaaccgtctgggacaaaaatatgaaataggattctcttatattaggttcataggcagaagggacttgccttgtctcagataagactttgaactgtggactttagagttaatgatgaaataagttaagacttgggacaccgttaaagaggggtgattgtattttacaagatgagaagaacgtgatatttgagaagggccagaataatatggcttacatttgtgttcccacccaaatctcatgccttcagttataatctccaatttttaaggaggg

SEQ ID NO: 1778 - DNA, 745 bp, Homo sapiens
cacagagatggacatatttttatatctcaactgtaataattgtattttctttcatctttgattttttttcctaaaaaatattacttcattgaactgatctgtcaaatgcgactttcacactcaactgttatcacgtgagctaattacaatgctaattagcccagtttacggggactgctgtgcatttgtacacgagggttctttgtttgatctgctacatcataagcttaccagcacggagggatagcatgtatcgttgaacgtggaagaacacaccttcatttgtgttaatgaagaaaactactgaaaaccaacagactaattaagggtaacgatgaacaattttgatcagcaattattttttaatatcgaagttcgctcctggaaagagtagaatggggaagttcatcttccagctttctacccagaaaagtagtgagagagagatcctgcttcatttccaattcttctcccacaaactgttttaacatataatttaatcgatgcctttatttcaaaagaaaaaaataattatagagcttgttgggatcattttctgaagagaggacattatgcgtgcatgaattccatcggtgatctgaggaggagcaggctgcttggaccattacccatcattgtcgaacagcagagtaattaattgggcaaatacgtctagatctggtgaattcacatgcacagtaactgggcagcagcaacacacactcttttactgtgaataaaatag

SEQ ID NO: 1779 - DNA, 210 bp, Homo sapiens
aaacactgtcgaaactttctggctgtctttagaagataccctctactagtcacttgacgggcaggaggtgcaacgcggaaggaaacatcacggattgggggtactggaaacttttaaaaggttcataggcagaagggacttgccttatctcagatgagactttggacttggacttttgagttaatgctgggatgagttaagactttgcgg

SEQ ID NO: 1780 - DNA, 4342 bp, Homo sapiens
ctcagatacagtacctctcttcaacacacacaaataaaacaaaatgtcagaagtttgatgtgtaatagaaaaaagaaaaattgggacatgttgcaccaagggcagtggaacagcaaaaaataaaatgaaaataataacattgaaatgtatttttattgatcgataagttatgtaacattagtatgatacaaagcaagtttgatatgacaatggcaaacacataattataatattgtttattttccttagatgttatatttaacatatttacataaaagaccaagatgtaggcaaaagcttcagtaatttgacttcattgagtgctttcagtaaacaataggtttctccagcaaacatcttattgccttaattgaacctccttgaaaaagaaaaccacacactttgtaatgtaaatgttaattgtagtagacaatggttctaggtaaatagcacccctggacatgaagtaaatgaaaggaatacaggcacttaacaatgaaaggttgtttgcacaaacagtgcttcaaatgtaaataaacaagggtcttctcaacggtcactacagtagtaaaactctggcacgtgtacagcagccaaattgagaatttatgtataaagtctctcagactttctaactgaaactaacagtggtttaacaggcttctccagtctgaagtcatataaggaattgaagctacaaaggaaattgtactacttttaaagaaaaattgtatatttgggattgtcaataatctaggccacgtggaagataacaggctattttggatattttctaattgcaatggttatatttctgtgtaaatgcctatacaaatgtttgcttggtgacatatggaaaacttaaggacttttatgaaaaggcgacaatggggacctccaaagcgccaaagtttctgctaggcatagtgttatttttagattacattaaaatggctatttagacccatctagctgagactattccaaaacaaactttttatcatattgttatcataatcaactttctacaggctaatgactttatagttttacttctagtgtatatctactagcacaattagaccaagttcctagatgtatcatgttaagaggtaaaaagcctcatgaaattataataacgactgttatatagagatatgtattttatctctatacacatttgcccacccaaaacaaaagcaaaaatgtggtcacaaggccataatctcatggactgagattttgacattaggggcaggcagtcatgggactttcttggaattgctttctactagcttgccttgaattctgaaaatctcaaacaacgaagaaagccaaacttaattatggccagattaaacagtggttaaaaaattaacagaagcagactatgtagcagctacagaccagttggtgctgccatttgggaagctgcagatggctgtgggtgggaaatgcctttactttcttaagcgatggagatgagtatggtgtgtgcacttgatgtttttttcatacccccaccccccaacagggctgtctgtcataggctgcccggccccgctttatcacttgcccccgagcgtgggaatcggagcgtcctgccgttcacatctcctgcattccgtttagcggaatcaattaggcaagacagaccctcagattccccaccccctttccatttttgtcaggtctatatacgtcctaattatttcagtttgggatgccagagctgtttcctggatagacctgatcatccttaaacaaaaagagaggaggcgcacacgtgggttgtggcgtaaatgtcactttcatttccaatgctaggcgcagagtaagacagaacatttttttaacactttgacaagaggggaggcgatctcgtctccatcatgtctttctgcttcagtagcttcctcaaggaaaccctcttggaacagagaagcatctgtccttgtattttgaatagaagaataaaaatcagcccttgcttttttttttttttttttcattttgcctgctagctctaagtcctcagtagatacaaattattaaccttccagtataaacttttctgaaagtctaatttcgtacaaattgacatacagcccaaatacatgtaaagtaatttccaagcacaatcttcaaattttgagagggaggtgcctcccaaaggaactgcccaagtctacatattatggaatcatttttaaactaggtaccagacatctctgcaacacctttctaagaaaaaaatccctgatataacttttgccttaaaatagaacaaactgcacatgcatctttactcattatcactatacacttctcctttgcagctgcaacaacccctctcaagacatatctggaaccttgatattttagcatgtgtgtgtcatttaattttctctcatcccacctttaatcataaggaaaaaaacaaaacaaaaacaaagttagattcaataagtattcctgacctttctggtttttactgtctctcggctgtagtctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctccttttatgtaaatatgacctggtttctgtttgtgtgtgtgcgcggctaaaacatccaaacgagatctgttgccttcagagtttattccgaacttttctttttcctttcagcaagtaatctccggcagcgttagccaacaattcatctattaatatcagaaaataaaaccagctattaaggtgcagcaagctgttacgagtgagcagcagcatccgtcccttcacaggcctctatttgcattgtaaattgcttctttctcacgcaagactctttagcctctctctatagagatgtataaagccaacggcaatttccagcgcaggttaaggaggaaggaaaaaaaaatcccattctatagaagtgacagctgattcaaggatctgttcctgatcctttttggttaggcaccatggctttttaccaagcggtggcagcttgattgcacatatcttgtgtgtatgtgttttagggggaagatcctcgatttcacagggcttctaggctgggaaggagaagatgccgtcttgctggcctgctgctgcccccggtctgaaagaaggagaaaagggccatcattggaggggctttcactgccaaattgtggaccagcccggcaaggtcaaaggttcgagaccgcgggagaccaagcttggaaggaagagggactcttaaaaaaacattagggacttgaaccttgtaacctgccatacaaaagaggagagtccttccatgtaaggattttaagtctggaacaaagtcttattttctaaatgtttaaggaactgaatttccaggcctttcgaacaatggcaatccctggataaatatctactccattagaaagatgcaaatagtttactgtaaggccacagcaccgtgagatgtgcattcatatctatggctcctgattggctctttcctccagtaaatcaatgaataatgtaaaacctgattgctgtaaagtggtggatttttgaaaatttcccttcccccattccctctcgatccaacattcaggaattcaatactccccaaaataggttgtttttcttttatgattttttaatgcttattgttattttggactggaggggtggggctattggttttgcaaaatgaaagtattgccctggtttaattatgctgactgtgggagctcgcttcctgagacagcgccctaattaccggtgccaaggtggagaaaggagggtggtagacagaggtggacaccaagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagctccgtttggataccagaagcgtcttaagctgaaccgctccaagtaccaataact

SEQ ID NO: 1781 - DNA, 245 bp, Homo sapiens
tgacatatcatatgagcactttggtgtaggcttggaaaaactacagccagaggtaaggctggaaattccataagagttaagggtgctgaaaatggatgctggatagtccagcatgaaagatggcataccgctttaggtttgaaatagggggaaatacatgtgaatatttatacatgaaggccattggggagggctgagtcttggcctgagtatctgtgcaggagcgagagcaagaagaggaggag

SEQ ID NO: 1782 - DNA, 287 bp, Homo sapiens
atgttatgatatctcaaactaatatttgagactccttggcttgataactatgattccattgaagatgactattgagttgaatggctctgttttccatcaacgatgacagcttttaatcacagatctcaagcccattatgaacattaattaatgtctgacatcgcttaatgagaaactctacccagtaagagtcggagaggaacaaagtgaacattagttatcaaaatgcattgacttaccttttgctcttaagacaccacacacagtcgttcccaagaaaacacttg

SEQ ID NO: 1783 - DNA, 497 bp, Homo sapiens
aaaatctaagcaagaatgctcaaggaggcattttgaggcccctgtggagtggaggtgccccctttgaccttttcatcagtcttttcattcctcaccaggaagattccacaaagacaatttgagaatcttatgtgaagcagaactaagctcttgcagttagttatatgtgatgacagaaacagaattacatggtttgaacagcatgggtacagttatatgtggattttcttctggctctgccatccgtgaaacagcaagaccaacccctctcttcctcatcctcctcagcccaccccgcttgaagacattgacattgaagaattttatgatgatccactttcactgggatcccactagaaatcggactgttcaactcacctggcagccactcccagagcccctggaactctggcccaaggctctctgactgactccttcccagatcttctcggcttagcggctgaagactgacgctgcccgatcgcctcagaagcccc

SEQ ID NO: 1784 - DNA, 3406 bp, Homo sapiens
aaaatgtccatggtgtctctcttgaattgtggtaacatttgaaatcacagaatgcaaagttttggtggtttcttaaatgatttattatcgtattctacatgccaactgctttacatttcccagcagcaagatataggcttctttgggcatgttctgacatgtctgtctgagtgaacttacaccaagtaacattggccctcaggtcaaatttctacaattagtcttccaacacccattttttataatgtcacgtactcttcaagttcctagaaaacaccccccaaccccccccaaaatttacatatttaattactgaattgggttatccaacctgaatccaagaagaagccacagctctcatgtggtctgcctcaggctttgggcagctgagacagcccatgactgttgtgtcccatctgtaagaagtagaaactcactggtcagtcaccaccattgaagaatactgtagctctacaacagcaaatgggcatgattttgatgaattctctacaaacattttctgtatgtacatttatgcccaggccagacttaatacatttacctaaaaatattgtaatatatctttgtattaagtagtcaatagcaccatattgtcaggttttaaaaatgaagtgttcacagctccattttcagtgctcttcaaattagaagttgggaaggtagcctataatcttggttgtgtaaacttaaaatatttatactttgtcctccaaatcttacatgctcttgtgtttggctactgacttgcagcctaaactattggagatgtagctttcctgtatgcagtgctgttccattaatctaatcctctatgctgctattgagctgcttatatccttttagtccagaaagctttcagcaacccaggaataaaaatttctcctttaggaaagactagaaaacacatccagataatgtcacataagcctgaaaagcccaagtaggaagttttcctttctcaatgtctgctaacttacgatttttgtaacctcacagtaattctacttctcttccatcattcaaatgacagtcaatcttgctccctatcttccttcatttgtcttcaggaataatgccgccattcactaatcacaggcattatctgaaataaagaggcaagacaactaaaagtacacatactaaatgtctaaatgtctcccaagtttcttgaagatggatgtaaaaatactgcctgcaataaatgatatcaaaaggaacttacaaaacagtatgtaaagggacaaaagggagagatgaaaaaggacttgacaggagcaggttgatgtttggagaaacaagttctgatggttttaaattttgttgcctgagacttagcttcctacaggttgtcttttaaaatctaaactttcaggtagaattcaatcagaaatcctgggggattgcctattcaggtcaaataactgaaaaggttgaaaaaatgaggtcagcaataaccttgattcggtcctccactggcaacattttaggaagtacgtgattttttggagtcatgagacatttttcagaaattggagtcttggaaaacttgaaattatctgtcatactatcatttactctgttttgtcagtggagacctggccaattcagtttttgctttcagtgactgaggctttgctttaacctggtgactcccaaaaatatcttcgatgtgtttgatgatttttatttggcttagaagcacagcagatgagccaagtatgtcaggctagatgctctgaggaaaggctgcacatggacctacccagagtaaggaaggagtaaggaagtctaattcaattttgcacgagatgagattctgttgcacactggcaacacttccctgtgtatttcagcctttcacatttagtattcttccttcacctctgcctttcatttttccactctatgatcaggccggttctcagccagacatgccccctacttcttccctacctgcaaagattcacccatctttcacatacagcctgtgtttccataaagctttccttcatcattcctggcaaaagggagcttttccctctttccattcctagggcttatcatctgcctaaatgcagcataggttatatatgtacaggttgtatctataaggttggcttttctctccaactacaaagctcactcctggaggatagcattggatttaattcatctttgactcctccatggcatataatagtttctcagtgaaagttcacagggaaaattgttcctggagggggctgctcctgggaagcttcaaaattagaaaatcacttccttacaatgtgattagaatgtaggcctaatatcccctaaactatgttgtttagtttctgggagaaacattagctattgacttcattcatttctaaagtatttgtccatcaatgatcgtcttcaaactgagcaatcaagaagatgggcaggggagaatgtggaatcctaatctacattttgttatctttcccctcactcattccagtaaagtctctgctacacataatgatgcggactggcagaagattgatatcttttgttctgagttctacagcgagtgtatcctagtggctatattatattattgattgctgtaataatagagcaataatattgctgtatattatttagagttataattttaggtactcctaataaattgatattgcactttctactaaatatttcatttgtgaccttttggttacagatgttgaaagtcaaacggaaacacaaaggtcatgaatgcctatgtttttctccatatctcggtcactagcttcccttaaggtggatattttggaatgaacaatttctctgtgacagaaatagactaagacaagggcccttcttggatttctaaatatgtaaggaaagcaaacgaaagcatttactcaaggccctctcttttcaaagaaataaaatacgtaacactcaggaaagcgtggggattagaaaatggctttcttacataaaagagctggctgtttgcgtattccctgagctattgttgagaaagtcattgtcatataatgccacaaaataaaacataatatttcctaaaatgattaatgaaaattcaattgatataaattacttcagaatattatgagagattcagaaccatagggatcttcttatttcttagcttagtaagtaacagctgtagattgacttaaattgctagaaatctttttaattctactctcaaccaactcaattcatactctaaatttcttttcttcaggagtgatgcaattttgcgtttttagttctgtaggaaaatttcactaagttgtatctatctccagcacaattattgttgtgagagcatctgcaacataaaacaaaattttcctaactttctcagaagcaaatgggaata

SEQ ID NO: 1785 - DNA, 7698 bp, Homo sapiens
cccttcaaacaaataccaatttcagtaacagtttacatacagcaataatttattctgaaatgttcatttagtttctgttgagacacaattcatgtctcattaataaaagagcagccatctcacctcaaataccagaatatacaacaaattacagcatagcaaaaattctacctactttcagataaaatctagttcaggtaaaatagtttcattcaatgttttacagttacacagatttttgttttgtttggagcacaaaatagtgtaaattattacactgtagctatctctatgcacatcatgtgaccacataactgttaatcattacttctgaaattgaaccatcagtttcattcatgcagtaaagcaaagcaggctgggtaaacttgttcatcgggaaccatattactgtgaatttcacagccacatgattaattatgatgttagatggactcacaaggacaaaaacatttttttttgcataaataccaatttttccctgatgtaagtttagtcagtttataatctagaaatgattgataacagcaatatatcatattttctatctgtagtgttcattattttaagacaagcaataattaaaggaagttgggatgggatgctactttaaatacatgtaaaacatactgtacaaacatacttggctttactatttttttcctaaccatcaagagtgcctcccaaaataagaccagtgaagacaaagtatactatcaaatatggcttccagaacaaaaaccctctaacaagaatcaaacctatttacaaaatttttcagtcttttaaagtttcatttgaaacaaaatgtctatatagcagttgtaattaacatagaattttcttagtttcattcttcctctcttttaaacagatgtcacaaggtaagacccagaatggcgcttaggactttgggttccactggattctgtgctgtcagttttggaatctcgcttctttgtgttgttattcactggagttgggatctgagatggccgagctgaagtgctatctgcgctgcttttcctagggcttgggttgtaattaaaaggagtcactctggcagcaacagtcccactaggtgaactgtgtttgcttgagctgctagaactgaatggggtacgttccactatagaactttcattagtctctgatacagggacaggattattttgtcctggttttatctcagttcctttttggtcaggggcatccacctgaataaaggagttcaggcgattttccaaacccacggtacgcatgggaacactgccattacccacattttgttttgcctgattatcttttgaatctttaatgtttggatttgccttttctgaaacactgtcaatcaccgggggagtattacctgtgggagatcttccagatctaggattgttaatgggacagtcctcaattctcacccaaacatcctctgttttagaaacagcaggtgccatttgataaattagagtctttgattcagcaccatttgtagcacctgaggaaacggtctgagaagtactatttgtgggagaaaattcattttcttttatttttctccatgttccttttgcggatacttggttttctttactttgtttggttcctgaaatagagttcacatgtttttcatcctcactttttgctttttcactggattctgatgaagcagaaagaattgaagatgaacttccagttcttctccaagtgcttactcgaggaagggatgatgaatgtttgctgtgctcacgtttccaggttcctgacctattgattggaagtctagaaggactttcagaatgagaccgtgcaatatcatggcgctttgctggtcttccatcattatactctatagtgggactgagattaggtgggagttttcgccatccaccagcctgaacagacgaatgtgtggatagagacatatcaggaagggaaggacttaaaactggagtttgtgcctgggacctagtgggagaagctggtctagatgatggagaaagagattcaaatgaagcagattcctccaattttcttcttaaggttgggcttggagcttctttgatgaaagttgactggcgtactaatacaggtctttctgatctatcagattcacttccacttgatttagttgaagacattctagaaagttctacctttttattggctccattaccattattcatctgatttagtcctttggaggcagactcacttcttggaatactactggcattcttggataaacctgtttgtttggtaaggttctgttggctcatctgtctacctggagatgtatatgacatttttccagaacctgaggacttagttgaagcagtactaggggatgatgtccttggaagttgagataatttgttaggaggacttattccatttctaccaggggaaattgagtttcggccaggagactgtataggtctacttaatggttgctgggcaggtcttgaaggggtcgaatctctagatcctgatctagaaggtgctttacttgacccacctatttgggatgtctgcctggcaacagggcttaattctgatttcacagatggcttggctcctctaggagaagtggtggctgtttgaccttcactagggcttttggaggctggagtcttaaggggtgggccttttttagaaacaggacttgtacttgaggagctatttcgaactcctggaatatgaatcattgtcctgcctcgagagattgaaggcatgtttgcttgaaggggctgtttcatttggcctgaaatttctgaattagatcgaacttttccagtaatcaaacttttataaactttttttcctcctttgattcctttactttcagattctatctttttagtttccaatgtacttttctcccctggttttagaattcgtgggcctttattacttgtaaagggtttttcttcttgatcaggtgtaagatgaaatggtgatcccagagagattcctgatttcagggaaaggatggaatctgaatcagacgaagcttgtctagataaacatgcagcagcagcagcttgatgtaaactacttactatggaatttgcaccttcctgaatagctttccaatcaaaattttctgaatcaggggatagaccatgttctgaatctggtctctgtatatctttcaaatcaagtgtcagatcttcacctaatatgccacccatatttctgggactatgtttttcattatcacccttgagtcttgaaggctttttcttttttggcattgcggagcttatacattcctgcaacaggtcatcttcagagtcaatactaagagaactgagagaactgtttcttgagaaacaaactggggtatcttcaacatgaaatgatttaggagcatagcctgatgcttgaggtttacttggttctccctgtgagtcagggggctcagtctctttgataggttcattttctttattgttgttttcttggtcaatgtcactgagagaactcagagaggaattatgagaaaagcaaaccggagtattttcaatagcaaaattctgtaacttttcatcagttgctgcccctctgtctggtatgtctttggatgactggggaaaagtggattgtttctgaagtatgggtttaggctgacctcgatttattggctgctttgcaatagcttgtgtcttattagctgattgttggttggaggttagttctgtgtggctggtaactttagcctctgattccttattttcttttgcctttcttaattcagccttttccctggaaaggtcaacatcatcatcatcaaaatctagagaactcaaagaatcatttcgtgaaaaacagtaaggagttccttcaataggcgtgtaatgatgaggtgaatcaaaagcaaaacttcctctgactctatcttcattatttgggagcttatcattgaagaccttggaattatttttcaaattctgtttctttgaatctttgttgtctgagaaaactctctcagcatttaaattattttttgagtctgcattttttcttacacgtgtcctatattcagtattttgtggtataggttttactggtgaagttggtttctttttcttaccatctaactgatttttgttgggtgcagaagaagacgcagatgcttgctggacctggtccattatctttttcacacggaaaggcttgtgacttttccctttgggcatagcagaattaatgcattctgcaagaatatcaccttcctctgctttattgtcatccaattcaggtatggttacagatgaggtttttcctccttgagcctcatctgtacttctgccttctgtaggaatggtatctcgtttttcaaattcacctgactgtgcccctcctctaactccttctccagcagctaactcatttggaggggattcgattgttagatcacttagagatgtagctgtggaaaagtttataggtgtcccttcaacacaatacacccgtggcatatcatcccccggtgtaaaactaacatgcttttggggttgcaacctgttttgtgatggtagaagtttgtacacaggcagctgacttggtttccttgccacaggtggaggtaattttgaagcagtctgggctggcttttttgctttacgtgatgactttgttggcatggcagaaataatacattcttctagtatttcaatatcatcatcatctgaatcatctaataggtccttttcagaatcaatagttttttctgcctctttctcttggttttcatttgattctttaggctgctctgattctgtttcattcccattgtcattttcctgaactggaggcattattcttaattccacatctttctgtataaatggctcatcgaggctcagagcactcaggctggatgaacaagaaaatccatctggagtactttccgtggcaaaatgtaataaagtatcagcatctggaagaacctggaccctctgaactgcagcatttactgcagcttgcttaggtccactctctctcttttcagcagtaggtgctttatttttaggtacttctcgcttggtttgagctgtttgaggaggtggtggaggtgttttacttctgcttggtggcatggtttgtccagggctatctggaagatcactggggcttataatgccacttaccattccactgcatggttcactctgaacggagctggcaatcgaacgactctcaaaactatcaagtgaactgacagaagtacatctgctaaacatgagtggggtctcctgaacatagtgttcaggtggacttttgggtgtctgagcaccacttttggagggagatttcgctcctgaagaaaattcaacagctttgtgcctggctgattctgaagataaactagaaccctgcagtctgctggatttggttctagggtgctgtgacactgctggaacttcgctcacaggatcttcagctgacctagttccaatcttttcttttatttctgctatttgcagggtattagcagaatctgcttcctgtgtcgtctgattacatcctatttcatcttcagctgatgacaaagatgataatgaactacatcttgaaaaacatattggagtatcttctacacaataagtctgtattgtttcttggttaatagaagaaactttgcaagtggcagccttttgaggctgaccacttctactctgtgcagaacttggatggagctgattctgcctcttggcattagatgaaggtgtggacgtattctcactgcttgaagacatatgttcggttttactgctttgtccagatgaactctttgagaatgaaaatgactgtttctgtgatgaaggaatatctgtggcatattttaaactataatcaataggctgatccacatgacgtttctcttcattatattttatgctataatttgttggtctctcttcttcttcatgctgttcttcttcagagtaacgttcactataattggtaggcttatcatcttcatagtcatcttcttgacacaaagactggcttacattttgattaattccatgattagaacccactcgatttgtttctgaaccattggctccccgtgacctgtatggagaaacacattcctgctgtccaaaatgtggttggaacttgaggtgtttatcatcagtgctctcagtataaacaggataagttgtactttgattccttgattgtctttgctcactttgttttatttcatcttctattatgtgtttgggtcttgcccatctttcattctgtgaaggactttgccttccagagttcaactgctcatctgaatatttaagactataatttattggtgtatctagttctccatcattatcatccatatgatttgcactatgtattttatgggctaggtcggctgggtattgaccataactgcaaaacttactttcatcatcttcagaataggattcaatcgagggtttcatttgacctcttttaccataaccatcactactactgacactatttaaactatcatttgaagatctcttgtattctaatttggcataaggcatagaacatgtcctatttgaattttccgacttagtgaaattgtaagtgtttgaatgtgtatgggcagcagagcttcttctaagtgcatttctctcatctgtcacacaatgtaattcagtggtagacccagaacttctgtcttcctgagaggtatgaatggctgacacttcttccatgactttggcaatctgggctgcagtggtggagatctgcaaacctcgctttgaagaagttcctggattttctgttgctggatggtagttgcctagaccaattccgcgttctctctccaaacttctatctttttcagaacgagaactatctaagcttcctcttgatgaagaggagctgggtaacactgtagtattcaaatatggtgaaaggacagtcatgttgccagtattaaaattgtctgacctattatcatcatgtcgattggtgtcaaaaacataatcaccatagagactttgcttgtgtctctgcttactacgatgagatgccttgggacttaaattgtctatattgtcaaaagtttctgataagtgctgagcatctaattctgcttctagggctttttgtttcctaacatgaagagatggcaagcttgagccaggagacataatattggcatccttgtacttcgcaggcctatttgccatgagattccttaaagctgcagcacttcccatagcaatcattttgtgctttgaatgaatgaggttcttgagcatgctaactgcccccatgtcccataatgcttcctggtctttaggatttcttgctgagagattccacaaagttccacatgcattactgactattgtcaaactatgagattttaagactcggatttcacgcctgcctctcttgtcatcaggctgtgagtgaatgatgttgtggagtgctgcactggccctggcccgagcctctttactgccccgggaatttcccaacaatacagagtctttgtcattgccatgtaaaagctggatgaggagaggaagacatccagactgtcgcatggatatacagctgtcttgggagctagacatagctagcaaagttcgcgacatatcatccttatcatgagtaccaagcattgacaacaatgaatacaccatttccacc

SEQ ID NO: 1786 - DNA, 1097 bp, Homo sapiens
cataaaatgagttagggaggattccctctttttctattgattggaatagtttcagaaggaatggtactagatcctccttttacctctggtagaattcggctgtgaatccatctggtcctggactttttttggtcagtaagctattaattattgcctcaacttcagagcctgttatcggtctattcagagattcaacttcttcctggtttagtcttgggagggtgtatgtgtcgaggaatttatccatttcttctagattttctagtttatttgcatagaggtgtttatattattctctgatggtagtttgtatttctgtgggatcagtgttgatatcccctttgtcattttttattgtgtctatttgattcttctctcttttcttctttattagtcttgctagcggcctatcaattttgttgaccttttcaaaaaacaagctcctgaattcattgattttttgaaggtttttttgtgtctttatctccttcagttctgctctgattttagttatttcttgccttctgttagcttttgaatgtgtttgctcttgctttactagttatttttattgtgatgttagggtgtcaattttagatctttcctgctttctcttgtgggcatttagtgctataaatttccctctacacactgctttgaatgtgtcccagagattctggtatgttgtgtctttgtcctcattggtttcaaaaaacatctttatttctgccttcatttcattatgtacccagtagtcattcaggagcaggttgttcagtttccatgtagttgagtggttttgagtgagtttcttaatcctgagtcctaatttgattgcactgtggtctgagagacagtttgttatgatttctgttcttttacatttgttgaggagtgctttacttccaactaggtggtcaattttggaataggtgtggtgtggtgctgaaaagaatgtatattctgttgatttggggtggagagttctgttgatgtctattaggtccgcttggtgcagagctgagttctattcctgggtatcctttttaactttctgtcttgttgatctgtctaatgttgacagtggggtgttttag

SEQ ID NO: 1787 - DNA, 338 bp, Homo sapiens
gctttatctcattctgtaaaactctgcataggttcggaattggccatggcgaagtgttaactgtgctgctgtctaatgtggaatgtagtggcagatgaacctgggaagaggagaaacaagaaaagggctgaaagggggaagagatggtagaagaaaaaaaatacgttggatacagtggaaccaccaggtggcgccacgctacaatatgactcttggaagtctccttttaaagagagagcaagggaccacaagagaaacctaccagaaaatacaaatggtccaactctgaatgggaatgaaaaacatacctgtacaaaatatgcactaaaaaaaaaaaa

SEQ ID NO: 1788 - DNA, 452 bp, Homo sapiens
gtctgggacctgtgttggtgtgaaggccttattttttaactatccagaaaaattggagtggtccatttgttgttggttatgtcaaatctgtgaaacaccatagctattgtttaggtttaaaaaattgtgtttgatggcataccaagttaacagtggcttaaactcaattggggcttgtctttttgttattgttgtctgtttctttttcttcttacagtagaaaagtctacagacaaaactgtccggggctgatactgtaactcctccacgatgctgtcaaggatggcaaaagtaggggtgaaaaggataggcttagcaactctaggaaacaaatgcaagttactatatatgtctgatgtcagaaatccagtccctgcagttaaggatgtgttggtccagaaatacacttcctttaacttcttccacccccaagaagcacttgatagacgaag

SEQ ID NO: 1789 - DNA, 2439 bp, Homo sapiens
tcatttcaatttaaaaacagaataaaagcatcaaattacaaaaccaccacatatcttaaagctgacaacctaacatctttcaacatttaaagagacccttgctctagctctgtcttgggattgtgtagctgcagaggcatcaggtgaaggctttcaggggccagaccagctgctgccccttaacctttgaccctggatttcaagttccctctagagttcaggcctgtctcctggagttctttataggaagctctcactgatttctcaaatcccatctctggagatgggtcatgcttcagaaagaagctggaggtgcaggcccatctgggtaaaacaggctgccctggacaaagctggaaacagaatgaggctccaggcgttgattgggctgcagtcttgggcgggtttggactgcgacgagcaggccacgatagatcaaccaggtggtagccccagggaccttcaggttgttggaggcaaactgggcactagaccagctaaaggccccggagtaggtcgacgagagatttctgagaaggctggcagaccaccgcggatctttgtctttttacgtggagccatgggcgaggcgctcaagaacttgctgaaggagctcgacttcttcaagcctcgggccaggtcctggagcatgaggtcgtcagccaggacgcccagaaatgcactggtggtggaactgaggatggtggcggccacctgtacggggcgcctggcagcaagactgccacttccaccaccggtcgcatctggctccgtggtgcctcgcaggcctggatcgccaagaaggcggcgcagcgcgtacgaggagccgggccgcaggtactggtaggcgcgacgcccgctgtgatcacgcacgtgcacctgggcacccagacgcaccaccagcagcacggcagcgtcctcgtggccgtgcagtgcagccaggtgcagcggcgtgtagccgccgtgggagcgtgcgttcacgtcgactggtgcgccactgcgccgcgcgacctccaccagctgcagcgccatctcgccgtcgccgctcttggcggcccaatgcagggccgtgaagccagacatgaagtcgcgcttggccgccaagccgcggtcgcgcagcagcagcccgtgcagctggtgggtccagcggcccccggcagtccgcacgagccactcgtgctcggacggctccaggggcaccgcggacggcggcggcgcggcgggcaactcctcggcgtcagggctcagcagacgcgggccggcgcgcgacaggcgcctcaggtgcggggagcggcccgggcccaggccgaggcccagaccggactcttccaccgagagccgcctcagcagcagaggggagctccgcgggctcggctcctccgacagctgccggcgcaggccgggctcctccgcccggaggcggagcgtggcgggggccgggacgcagcgcaccggcagcatacagggcttctgctgcggcggccctttcgctgccccgggcccgggctccgcgtctggcggatcagagcagggcgatgccgcctcagaaggggccctaggcggtggggccgcgtctgcggagggtctctcggtggcctgggctagctcaagggctggaagcggtgggtcggcggaccgctccccgggcggctgagcgggctcggaggccggcccccccggggtgtcctgtggctctgttggcagacccaggtcccctggcggctccactggccgcggcacccggaccaagggcggagctcccggggcagaggcgctccgcggcaagaccgtcgaagtgggtttcgacggctgggccgctgcccccggggggccgaagggtgcgggctcgggctccgggggccggggcttcttcctcagcaccacgaacttgacgccgtcgagctccttcaccaccgccacgttgttgacgaactgcttgaagcggtccctgcgggcggcgcggccccgcgggtcgccggcatcgagcagcggcttgaagcggctcagcagctcggagttgcgcaccttcccgccgtgctcctgcaggaagcccagcaccgccgcctggctcaccccggcagccgcagcggcggcggcggcggccagcgccatggtgacagctgcccccgcgatgcagagggaaccggagcagaaattcccgccgccccccgcccgccccagaattaaaggcgcagcgctccagctctggtctcggttgctaggaaaacggcttcatgagatttacagcaaaaccaattcactctgcgcggcaatgcacgttactctaggtttagagagacgttttcaaaagcaattttctcatggtaagagaatacattttcacgtagaatttggggtataaaaccacaggaaacataaacataacaggaaaacatagaggaaaacataaagaaggaaaaaaaatcacttgaaatcacc

SEQ ID NO: 1790 - DNA, 279 bp, Homo sapiens
aaatgccacttatagagaacccacagttcagttttattcagagcaaagaaaaaagaaactttccatcatactagaagaaacttggccgtaaggtttgggatctgtgctcaaactacacatgcaatgaggacaatattctgctaatacaattgacttgctgctgcatttgtctactgttttgcaactagtatttggaacaatccttacagtgttacagtgtcaggcacaacatttcacttctcttcacaccactggttctctttgcgtacctaaaagaga

SEQ ID NO: 1791 - DNA, 1078 bp, Homo sapiens
gctgggaagtggagagggctagttttagggctaataggagctttttcctcgtgacaggtacaggtggtgcttacagaaatgcttggagccacggggggaaatctgtttcctcttctcagatgtcctgcatcttgaaccagttcttctacctggggctgtaagggcatctcctagtctggcccttatccccattcgtctgtcagctcccagggttctcaggaatgagaacgagtgagaggaagttgacttataccctgaggagccggagctgaaaggaaagcctgccagtcctcggatgaatacatcccattacgtttgtcagcctaggacctttgaatccagcagcccttcgcttctgaaccctctttggccggggagcagtagcgctggctgtgagtcaggctgactgcctctatacctcccctacaaagcttgaggggtgataaggaaaactggggcttccttccagtcatctttcctctgtccatggtcttttattttgcttacctccattgtgggaaattgtgttgtctgcactgtagtggcccatataggtcctttgacaagcaaacaactgtttactatgtctctgaaagaacttggagagccctcggccctgcttttttttctctctctctttttgccctgcttttacatcaagatctgtatcaacttcctggcaaggagggagaaagcaccagattctaggctgtgtgtaaacagggaaactgaggctgggaggatgaagtaattgtggatgaagtggggataatagacaagtgcttgtctctgacaaccagcctgatttttggccgtaaactcatgcttctttttacacgtttgagaattagacaacaaagaagcaacagggtatattcagtatggttgaactctctgaagtttttcaggtctgacttataaagaagaagtggacattgtacacatgaataggactttacaaccacgtgggggaaaattagtagaggcttctaagagagaactgaagcagaacagattctgtgggctctgagagctgagggagacagcattgcagagcacagcaggagggtgttgggag

SEQ ID NO: 1792 - DNA, 1562 bp, Homo sapiens
cttgccaggtccatgaaccagccaccttggcagtgaacccccagccctagtcaagcctccagatgattgcatccctggatgacatcctgattgcactttcataagaaaccctgagacagaactacccagcttccctcctaaagccagcgagaccacaaacccactgggaggaacaaacaactccagatatgccagctttaagagctgtaacactcactgggaaggtctgcagcttcactcctgaagtcagcaagaccacgaacccattgagaggaatgaacaactccggacgtgctacctttaagagctgtaacactcactgcgagggtccgtgtcttcactcctgaagtcagcaagatcatgaacccaccagaaggaagaaactccggacatatctgaacatctgaaggaacaaactctggacacaccatctttaagaactgtaacactcaccgtgagggtctgcggcttcattcttgaagtcagtgagaccaagaacccaccagaaggaaccaattccagacacattttgtctacccagatgggactatcgcctatcgccaagtgttaaggtggcaggagtggaatcttggattcaccacacccgagttaaattttggacatcccctgaggaacctgcgggaccatcagctcaggagtcccaagatcacccagaccagccttgatacctgtgaaccattggaggacttgcatctcctattttggaaggaatcatcccagactaaaaaggctcctaccactgatcctgaagaaaaaccccttcctccttaaaaaagataagtgaaaacctacataatctttaacacctctccttgcccctttaatggaaaccttttactatttcatcatgttattaagcagcatactaaccatactctttgcaataggactatatactgtagctcctgctgggatgaaaataaaatagaacacagggagccactcactttgctcccaacatccctttccagccactcaccggagctaccttggcaagtactctagaagtatgaaaaaatgaaaacaacaaactcgcacacctttttaacatacacaaccagttttgtctacccagccgaggtatattcttcttatgtggaacaccgacctatatctgcctccccactaactggacaggcacctgcaccttagtctttctaagccccaacattaacattgccccaggaaatcagaccctatcagtacccctcaaagctcaagtccatcagcgcagaggcatacaactaatacccctacttatagggttaggaatggctacgctacaggaactggaatagccagtttatctacttcattatcctactaccacacactctcaaaggatttctcagacagtttgcaagagataatgaaaactatccttactctacaatcccaaatagactctttggcagcagtgagtctccagaactgctgaggcctagacctcctcattgctaagaaaggaggactctgcaccttcttaggggaagagtgttgtttttacactaaccagtcaggtatagtacgagatgccaccc

SEQ ID NO: 1793 - DNA, 1106 bp, Homo sapiens
caggcaacggtgcaggttttcaagaatgcattggtaagggccactaaatccgaccttcctcagtcctccttgtggtctaggaggaaaactagtgtttctgctactgcattgttaaggtggcaggagtggaatcttggattcaccacacccgagttaaattttggacatcccctgaggaacctgcgggaccatcagctcaggagtcccaagatcacccagaccagccttgatacctgtgaaccattggaggacttgcatctcctattttggaaggaatcatcccagactaaaaaggctcctaccactgatcctgaagaaaaaccccttcctccttaaaaaagataagtgaaaacctacataatctttaacacctctccttgcccctttaatggaaaccttttactatttcatcatgttattaagcagcatactaaccatactctttgcaataggactatatactgtagctcctgctgggatgaaaataaaatagaacacagggagccactcactttgctcccaacatccctttccagccactcaccggagctaccttggcaagtactctagaagtatgaaaaaatgaaaacaacaaactcgcacacctttttaacatacacaaccagttttgtctacccagccgaggtatattcttcttatgtggaacaccgacctatatctgcctccccactaactggacaggcacctgcaccttagtctttctaagccccaacattaacattgccccaggaaatcagaccctatcagtacccctcaaagctcaagtccatcagcgcagaggcatacaactaatacccctacttatagggttaggaatggctacgctacaggaactggaatagccagtttatctacttcattatcctactaccacacactctcaaaggatttctcagacagtttgcaagagataatgaaaactatccttactctacaatcccaaatagactctttggcagcagtgagtctccagaactgctgaggcctagacctcctcattgctaagaaaggaggactctgcaccttcttaggggaagagtgttgtttttacactaaccagtcaggtatagtacgagatgccaccc

SEQ ID NO: 1794 - DNA, 2409 bp, Homo sapiens
aagccctcaccacagtgttaattttcttagagtttttccatgaacatcagtgccacagaacctaacctaaagataatgtcttcaattgcaatggcattcattaatcatttctacttagtgatatacagaatcagctgcttcttgtcgttgtgcatggtgtccaggaacgtggaacattttgaagtcctccctggtgggaatgtgtgagaaacagataacacatactcatcttacaagagagacacagaagctctgagaggttgtcatttgggcaaagtttcacggtaagttaatgtttggctctcaaatcccaaaacagtcttgaatgacctgcctctccatcatggtagaaatgaccaaacagggacaatttcctttatgatagaccgttaaaatcattatttcccaaattatacttgaaaaaagtgcatttccagaaagatctcaaaaacctaaaatgaaagtacaatatataaagaatttagataaagggaagaatagatataaggttagtacgcccatctttgttgaagcagagtgaggcaggaattctggatttcaggtggcaaaaaccacccaaacttagatcttagactttaaagggagaacttagaagttcatgtcaccaaacgaaagggagaggtgtgggagtagccagaaccagagacttaactccaacagaattatctccatctttgtttctgagatgatggcatccatgaggaaatggactggtctcatttttattataggactgtgattgatggttaatggagtaatggaatcccctatagcttttaagcaactctgtattttcttgaaaagatatttgtttctgaaatacaatggaagtgactccagcaagcaagggagtggttacaggtcattagccagctcacccagatccttattgctgcataaaagcaatttatattcccacaaataaaaatctttgcaacaccttttccctaaatatatgcctaaagattagtagcagattctttcctttataaacaactgctatgtgccttggcattagttatctgtgagaccttggaaaaatcatttaacttttccatgctccaagattctcatctgtaaaatgatgaagttgatccggtcccttctggcaccaacattgtgtaaagagtattgttctttcaggtggagccaaagtaaattctgccatcaaaaaataaataaaggaatctctcagtgcacagtctgctttcaggcaaagctattttggaaaccatagtcactcttttaggccaacagaaatcacactcatttatccttcagtctaggtagaactaggaaaaactttgaaggcattcacgcttgatccaaatgatcgcaagtttctctgtcaggagctttttatactttctaccccttctaccccctccttagctgccacgacattcacagctactggtactcattttattcctcaggggatcaggatcctctctctactcttattctaatgtcctctttggaaacgatctgatgaactgagaagtcacattaaagcagagattcccagattcccagcacccacaaactgccttcatattctctccctatctttgtacccccatatgttactattatgtacttagtgttaagtattttaatattaacattaagtagatcattatctacttactattttctttttcattgacacattatttttacctcctaccaactttagcctcattagaaatcatgcacttaatatactacatatgttttcttataagtcctattaaaaatacataactattaaaattatatgttcacccatgaatcacttaaaatcatctcacatacacttccttcaatggtactcattttacacctgggaaatgctgtattaaagcatgaatcacaaattctccttactaaggagattagatttagattgaatgaaaatccctaacatcttttaaactacttgctatttccttataacaatgtgtatttcagaggtgtcaagagatcaatgatgaaggtaaaaaaacaaatttttataggacattagtcttaaagaatggaaagattccttaattgtgactcaatccattctggagtcagggagctgtctccatgccccttaaataatcatatagtaatagggatgtaataataacaagaatgaccactgcatattacgtgttgactacaggttggggttcagagagccgccctacttcatcttatttgtattcctgcctccaccgctggctgccatctcatacggaggacctgggagaccttttccatgcctgtgctatttcatctctaaaaacaaacagtagagggtgaatagccaaaccaggctacatgcaccatgtctctcaggcttcagcacaaaaccccatttcatgcttcagagccttg

SEQ ID NO: 1795 - DNA, 223 bp, Homo sapiens
ttcagaaggaatggtatcagttcctcctagtacctctggtagaattcggctgtgaatccatctggtcctggactctttttgttgccaatgcccactgtgatcaaactcaataggaagctagatgggaagggagcttgctgatgccatccacacggatcatccttggaggtgcagggcagggtgaagaagtgtggaaggaggtctggagatgctcagagctgtg

SEQ ID NO: 1796 - DNA, 926 bp, Homo sapiens
ctgcaaaactttctgaacaaagcagaggaaacacaagagtcaaagaagatgcagctgagtgctatggttaaggaagcagacactgaagtcagctcagcctggtttgaaataagcttggccattcattatctacaagaccatagaggttgtttaacctttctaaacctcactttcctatctgtaaaataggaagaacagccatctgacaagatgattccaattattaaataaaaataatgtaagcaaagagcttggcattgttcctggcacatagaaaatgctcaataaatggtctctgcagagtctggcacactcggtgatttcctaccaatacacttacatttgtttaaccgtgggtgaagcctgagtcatttcaggccagttagaaggttgataaagaatgtaagcagattcaaggttttagaaactgacaaagattctttgcctggccaaactttcatcagggtcctaagtccatctgtgtatgtccttgtaaaattcaggtttagcaaagaagctgctaagtcagtttggcaaaaagcctccaccctcaacatctgatcaccctcaatatatgattaggttcctcatcctccactgcctcccatgtgatatcggatcatcttgccctattttttttttttgttattgtttttttgaggtggagtctcgctctgtcgccaggctggagtgcagtggtgcaatcttggctcactgcaacttccacctcccgggttcaagtgattctcctgcctcagcctccctagtagctgggactagaggcacacgccaccatgtctggctaatttttgtgtttttagtagagacagggtttcactatgttggccaggctggtcttgaactcctgacctcatgagccgccggcctcagcctcccaaagtgctgggattacaggcgtgagccac

SEQ ID NO: 1797 - DNA, 562 bp, Homo sapiens
atgggtttgattccagagcaggttgcacattggtcctgggtggctcgcaggctcaggtcgtgcttgggcgtcctcctcctaatcgtttccgaagtagcagcagcagcaccaccaccagcagcagcagcagcagcagcagcagcagcagcagcagcagccgccgcggcaacatcgagctcagcggcacagcaggcagaactgtgcagaagcgagcaccgtttggggagtccggggggcgggtaagagggaggagggggaaagcctgtcttggtctttgggattattttttttccccttctttccctctctctctctttcttgagggtgtgtgttgccccctcgaagtgaaggaattttgctccaaagcgagctgggaccgaagactctaggctaagttatctatgtagatggtgtcagggagcgaagctactgaccgagctgctgttacatccagctttttaattgcctaagcggtctggggcttgcttcgtcatttggctttgctgtggagcactcctgtaaagccagctgaattgtacatcgaagatccacccttttggtg

SEQ ID NO: 1798 - DNA, 317 bp, Homo sapiens
attataccactggctttcctgggtctccagcttacagacagcaagtcgtggaactgcgtagcttctgtaatcaggagagtcaataccctataatgagaaccctggagactagcacctgtttgctgagcaatgaatgcccccactgccttcagatgcttccttccacaaacagcttcttgattaatctcttctgatgttaccaccacctctcatccaaaggaatgaataggaggatgcactgagaaatcaggaggccaacgagcctggcaagacatccaggaccaactatgtaatttgcagagcccagtgcaacatga

SEQ ID NO: 1799 - DNA, 1830 bp, Homo sapiens
gggagggtgaagaagagagtgtgtgtgtttgcatatgtgtgagagagactttctattcatttgtgtgtggggtgtgctagtgcgtgggctgtgtccaggtgtggcctgtgtgtgtgtgtgtgcctgggagcatgtgtatccccgcatgtgtgtgtacatgtccaggtgtgtgtgtgtgtatatgtgtgtgcacgcacgtatgaccctgggtgtgtttgcgtgtgtgaatgtgtgtgtgttcatgttgggtgtggggtgtgtgtgtgtccagatgtgacttgtgtgtgcgtgtatgcattcagtctgggtgtgggatgtgtatatctgtgtgtgcatttctgggtgtagggtgtgtgtatgtgcgttcagtccaggtgtggggtgcatgtatatgtgtgtgtgcatgtctgggtgtggggtgtgtgtgggactgtgtgaatgccttggtgtggagtatgtgtatttgtgtgtgcatgcacgtctgggtgtagggtgtgtgtgtatgtgttcagtccaggtgtggggtgcatgtatatgtgtgagtgcatgtctgggtgtggggtgtgtgtgtgtatgccttggtgtggaatatgtgtatgtgtatgtgtgtgtctgggtgtggggtgtgtgtgtatgtgactgtgtgaatgccttggtgtggagtgtatttgtgtgtgcatgtctggatgtgggctgcatgtatatgtgtgtgtgttggctgtgtttctgtgtgtgtgcacatccaggtgtgggctgtgtatatgtgtgtgtgtgtggcctgtgtttgtgtgtgtgcacatccaggtgtgggctgtgtgtttctgtgtgtgtgcacatccagatgtgggttgtgtatatgtgtgtgtgtgttgcctgtgtttgtgtgtgtgcacatccaggtgtgggctgtgtgtatgtgtgtgtgcacatccaggtgtgggctgtgtgtgtgtgtgtgtgtgtgtgtgttgcctgtgtttctgtgtgtgcacatccaggtgtgggctgtgtatatgtgtgtgtgttgcctgtgtttgtgtgtgtgcacatccaggtgtgggctgtgtgtatgtgtgtgtgtgttgcctgtgtttgtgtgtgtgcacatccaggtgtgggctgtgtatatgtgtgtgtttgttgcctgtgtttgtgtgtgtgcacatccaggtgtgggctgtgtgtttctgtgtgtgcacatccaggtgtgggctgtgtatatgtgtgtgtgttgcctgtgtttgtgtgtgtgcacatccaggtgtgggctgtgtgtatgtgtgtgtgcacatccaggtgtgggctgtgtgtgtgtgtgtgtgtgtgttgcctgtgtttctgtgtgtgcacatccaggtgtgggctgtgtatatgtgtgtgtgttgcctgtgtttctgtgtgtgcacatccaggtgtgggctgtgtgtttctgtgtgtgtgcacatccagatgtgggctgtgtatatgtgtgtgtgtgtgttgtctgtgtttgtgtgtgtgcacatccaggtgtgggctgtgtatatgtgtgtgtgttgcctgtgtttctgtgtgtgcacatccaggtgtgggctgtgtgtttctgtgtgtgtgcacatccagatgtgggctgtgtatatgtgtgtgtttgtgttgcctgtgtttgtgtgtgtgcacatccaggtgtgggctgtgtgtgtgtgtgttgcctgtgtttctgtgtgtgcacatccaggtgtggagtattcgttgtgctcttgtgcttctcaggccctttgagtagtaagaggtgcttctcagcctgttttctaccatcgcccccgtaaggagcctttgtagactttccatccc

SEQ ID NO: 1800 - DNA, 402 bp, Homo sapiens
gtgaaaaggtgacacggagctgccgcggctcaggagccagtggttgggggtctgagaagaactcaccaccttgaagaagttcttcggctttgggagccgcaggggccggcggtccggggctccctaggccacgtctacaggggttcggggtaccgaatcggaagatccacagggcgctgtcaagggcgaagccgcggaagtggagcgctgcctggcgcgcaggagcagagacctggaagccggggacaggcagcacaggcagtggggaggtgcctaatgagagaactcattcctctatcaaaaaataccgtgagtcggccgggcgcggtggctcaggcctgtaatcccagcactttgggaggccgaggcgggcggatcaccaggtcaagagatcgagaccat

SEQ ID NO: 1801 - DNA, 1196 bp, Homo sapiens
aacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtggttgaggtcccgtaggtgggggtggtcagcttcagggtgcggaagcagatgtcatacagggcctcgttgtcaatgcagtaggtttcatctgtgttttccaccagctggtggaccgagagggtggcgttgtagggctccaccaccgtgtctgacaccttgggtgagggcatgacgctgaaggagttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccgctctg

SEQ ID NO: 1802 - DNA, 1157 bp, Homo sapiens
aacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtgcggaagcagatgtcatacagggcctcgttatcaatggagtaggtttcatctgtgttttccaccagctggtggaccgagagggtggcgttgtagggctccaccaccgtgtctgacaccttgggtgagggcatgacgctgaaggagttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccgctctg

SEQ ID NO: 1803 - DNA, 1186 bp, Homo sapiens
aacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtgcggaagcagatgtcatacagggcctcgttatcaatggagtaggtttcatctgtgttttccaccagctggtggaccgagagggtggcgttgtagggctccaccaccgtgtctgacaccttgggtgagggcatgacgctgaaggtgttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccactctggcctgccagagggaaagagaaatcttaag

SEQ ID NO: 1804 - DNA, 3150 bp, Homo sapiens
ctgggattctaactggcttgacagtttcacgtgtgtaggtaggtgctaggataccagcagccacatgagaaagaggtccagaactgtgcctggtagctcttctgtcttcctctccctttctgacacctagggacagaatggtgcatatattgtagggcacacacacgctaaaggatacatactaaatacaggatacatgctgaagacagcatgaggcttatttgcaagagaaagatcatggaacagagcaggaaagaggcacaaaaggcagcttctcaaaccctgagcttttatccactgaaagaaggcaaaggctccttccactttctgcttctacttgggatgtgggctgacaagcacctgacccctggaactcctgcactcaccatagtgtacatcccacattagtgcatctgatacagtattcaacatacacagcagcacaggaaaagtctgccttccaacatgccaaaatgtgcttgaaaagctctttgaagcatttgttatgtgcttgaaacacacagaacactgggaaggcagtcctttatttagatcttttttgtctgtgaaaatcaatatgtcctttctaggctttactgtataagaaaatgtgtgtctaattattgttcccaggtttcccctctcagtctggcccagtaactgcaacgtgtcatcaagcatcacccaaaacatgccacacacatgagggctgtctgtgaccctctcgaatgctaatttagaaaaactgcccagctctccaatatgcctccatagtctgcttttaagaactatttttgttctctcctcccaccgtgcatggctgagtgtgaatagctgtttcctgggtcctcactgccaaggtaatggcactctatcccatctcatcactttcaagttcacctctactttgaccccaggacacagcgctcttcacacatactcactttgatccattattctccctctgctctagaaagacacttgaaatacttaacaatgttgccaaatcctcagtctgtcagacatacacagtgatttaaatagtcattgttcttaatttttctttgctgctaaaccaacaaagaaatattgccctccgtgaagggaaaacagtcacagaaacacctttagaaagcagggggtaggaggtgggtgggatcaaggtgaacccagctagaaggaccttccccattaccttgcagggcagcaggggcagctcagtcagacagttcccacaggacagagcatttctggccaggttggtacaagattaaaacaatgattatgatgatgtaagagtttatcttacacatccatgagctacaactgttaaccaatgcacacggggggaggaggttacatgcacattgactatttaaaactgtccaatttcatacatttcgacaaagcatttaaaactctgccagaacagcccagaatgggtagcgggtggggtggaggagagtctgtatttactttaaaatgtgaattaattagtttagacacaaggagcaaaactacaaatgtcttgatatctcttatatgttaagaataaaattacagctgtctaggggcattgagtgtccaccattgcccactctgtgtttaggccttcacacttgtctcacaactcccttctgctacatttcacaccacgcaatacctctgcaagggagctttagctacaggactcagaggacaaggtgcatgtttcagctaaagcacacccccgttctcagtgcctcagcccaaagcagctgctgtgtaagagcggtgacggccggggaacacccaaatgacatattctccgcgtccttcctatactgtagtgatgtttactgaagtgctgagaaaacatgggaggagacactggggtagcaaagcctaaagtcagatatctttggggaggactaagcatcggctgcgggttggggatttgcaggagtctttgcttctctggctctccagttctttagtaggctttacctgtgtcaaaatcaagtgcgagatggaagactattgctttgtgggagacccagggacaactagccgggcagaacagggctgtggtcccgactcccccagcagaccttgaacgacgccagtccgactcctccagagggggctggtgacaggtcagctgcctcgccccgagggtgggggaagggcgcgctttccatccgcgtactgggacaggagtttgggtgcaaactagtaaaggctatggtgctccctttacacccaagtaaaggcatgtggtttgggggacggaaggagattaagccaatgcggaatgccctacacacactctagcaccaccactttggggacttcggttctcccgctggctcgggcttggacctcggtctgcagggagagggttggagggactgggcggctgcggcccttaccttgctgaccacgttctggacgaggccggcgcggatgccgtagtcccatgcgcggcagtcacagttggaggcgttgtcccccttgtccggaggggatggcaggggtggtgtgtcgcctccgtccgcgccgctgctgttgctccggttgcccgcagcctcccagggggcagtggcgaagggggtggtggggaggctggtccagttgcccatgtccccgccccggcctgtggtggtgacccctgccagctcggtgcctttgccggccccgcggcaccagaagttgggctggtccaggaggaacgagtccgagaactggctgaagccgatgaacagcgccgggatccaggtaccctacgcgaaggaaggatcattgcaccattacggagacgaggatacaaactgtcaggcctctgagcccaagctaagccatcacatctcctgtgacctgcacatatacatccagatgacctgaagcaaatgaagaaccacaaaaaataacattccaccattgtgatctgttcctacccaccctaactgatcaattgaccttatgacaataccccctccccgcccttgcaataatatactttgtcatactcccccgcccttaagaaggtactttgtaatattctccccgcccttgagaatgtactttgtgagatccaccccctgcctataaaaaattgctcctaactccaccgcctatcccaaacctataagaactaatgataatcccagc

SEQ ID NO: 1805 - DNA, 1375 bp, Homo sapiens
actgaaatggagtaggtcggtgagcgccgatctgctggagaatctcattatcccatcggcgctctgcctgctcctggcctccaagcctctgaagcccctcgggtttcagctgccggctaccctcgagcccgtggtgcccacgagagaggcgactttacgtcagcggccctgggctgagatttgagaacgcgaccaagtggagaatgttggagccagattttaaaatccttgtcttccttctgcgtgctacttgatctaaatgagatacggcaaagtcacagaacctgtttttatgtttttgcctgattcatacgggcttctccggtgaagatgggcctgaagtaacgcttgggttgcttctgacgttataactcatcctgtagctgcagcaaccgtggtccttgcaacctcataaaaatgttgccagcattgtttcgatagtgctgcttaattcttggaaggttcttcggacttcacacattccagcagtagctctctcagctcctgtcctgcacagctttgaagtgctggtgatgtcattgaactcttaagtgcaagatgaaacaagtctttctggggttctaagtaggtaagtgatctgtccatttcttaactagctaaatgaattgctttattaagatactgaaggtatgtcaggcctatcaagatccagtatctggaatcactaatcaactctctatgaacattatttttttgaagacttttctttcggcacactaaacaaaaataaactcaacctgggggaagatgcttggagctaatgtgaggaggaaggaatgatatcaaagaccttgctttctcaaagttccctaagatgcgaaagaatcagtactgcagttttaaaataggctggggttggacagaggagcaacaaattgtaatttaggagtgccattgctttctcagacataacggcattattgtctgggggaaagagttctattgtataaatactgttgagaggatagtggaatttagatctccagcctcttccttgattttggcaaggttgaatgtagaggaaaccacagtcgttcaggaagaacgttatgtgaacaatgtcatgttttattggtggaatgagtaaaccaggcagtacaggctgtaaaaacgtatcagttggtgttatggcaggaaacagatggctcattccaatagagtaattcaaagaatatccaataaaggggctacttacaaaggtgtagatgggaaacaggtgagccatgagatagagtgtatccaaggctagtaacacagggtctatttctaaccctatgcttgaaggggtgaattaccgggaaagagaggctcctaaggaggggccaccttgagaagagccacagtcgtcgcggag

SEQ ID NO: 1806 - DNA, 1971 bp, Homo sapiens
gacatgagccactgcgcccagccagagggtgtttttttaatgtggcatttgaaaataaaaagttggaatatacatttgtttttgggagtattcaatacttttaaggaagattaatatgtttgtgaaatacaggggaaagcttttagtacaagttaagtatagataaatcttagtttttaaaacataggcagattttattagatgtgttaagtagtaagtagaacatgtgttagacacagaaaggaatagaaagtccaggatacctaacattcctagctaccaagtatacatgagacacctgagcatgaaatatttgatacattaaatgtccaagaggcactaaatacagtgcataaaatatacataagcatgaaatagtcatgctattcacttctgtccccaagtgtcctctgtccaagaaacacagtaaaacccatggttgctccacaggccaacaggcaaagctcagctctttgctaggcttgcttgtacctgcatctcggacagagcaagtttgtgtcattggcgtggggcaccttgcctctttgagtctccttgctcaaacctgtcgtcttcagcaccacgatccacaggaaagtcaatatcacagagaggggtggaggttggggcaggtgggggatggtggcccctgaacattgtatgaggtaggctttaggtagcaggcatcttccaccagatttgcaccgtctcttgacagcgtttacttatcccatctctttcctcttgcttttcactgtctctttaaattgatttaaataaactaagagattcaagcattttaatttgatctgtgagcttttctgctcactgatctctgaggtagtatacctggaggccatcgcatttcccacatgataacaattcatatcaaaatacggaatccatttggggaagtcaggtagattgcttcccttttcttcctgagaatggatagtctgcatatagtcttagccgtccatgtgttgaatgatcaacttttctatttatgtagaacaggttttaatcacacatacactccttcctgatacaattccccatgtgtaagcatccatctccaccttccttgctccattgtttatccgacagccatgaagtgagtgctcaccatgtgtgccaggtgctatcctagattctgagggctaaaaggaaaaacacaacccttctgaaagacacagctttggtaaataaattaacatattgaatgcaatggcctggggcagtcatgggcagcttgactgattagtgaaatgttgagtttttgaatgacacagggcccatgatgtcaactcaatttttcatttttcttttcttttttttggaaatggagtctccctctgtcacccaggctggagtgcagtagagtgatctcggcttactacaacctctgcctcctaggttcaagcgattcttccatctcagcctcctgagtagctgggattacaggcgtgcaccatcacacccggctatttttttttttttgtattgttagtagagacagcgtttcaccatgttggccaggctagtctcgaactcctgacctcaggtgatccatgtgcctcagcctcccaaagtgatgggattacaggcgtgagccaccgctcacagcctatttcagattttaaaagactcttcactgcaagaaacaaatgcaactctggatgtcctaagcttcaacagaggacgtgggggggatgaaggagagggagaagtcaacgatgacagcaaattttagtgtagagcaactgagcgaatggtggtgcaggaaacacagaagaggagcggctcggaagtgggaatggagataacatcatactgtggacattcggaatccacagagctgcgtggaaatcagatttaacttgctctctctccccatttaagatgcttctcaagtagcctcactccctaaaacaaacggatatttggcattgcgccacattattctgcagc

SEQ ID NO: 1807 - DNA, 861 bp, Homo sapiens
tggccaggctggtctcgaattcctgacctcaggtgatccgcccacctcggcctcccaaagtgctgggattacaggtgtgagccactgtgcccagccctagctggattcttagaactgaaatttctatgtttgcctaaaaggtacacagggaagtgtgttacagatccatcttttgctggcaatcctgtctcaaccttttctcttgtttgccatgccccatcttcccaaacaagcttctgggaaatggagactgtgtcttgcttcaggagacttagatgtgaaaagcaaatcttcctcagttaaacagtggcccactcgtgtttagaaagttataaatgaccatgcccacaaaaacacaaaagaaaaagatcatcttctccctcactggattaaagatgtatctgtgtagatacaggacgatttaaaaatggattatcttttagattaaattgaattgaaacatttcctttttatttggatttagaggagaaaatgctatttgcaggcacatgataaactccccactgtctgtccagatctttctcccaagctccagattcatatacccaggcgcccattagatggatcaattcagatgtttaacaggcatcccgcactcagctctccattctctacttccacaatcttctcctcttctaatcttccctttctcagctaaagtcaccaccgttcacccagttcccaagtcaaaacctcagatgctgccactaattctttccaccaatctacccacaagtcctattggttccagtaccaaaacatgtctaggttttgcccacttgtacctctgccacttccactctggaaccagccatttacattaccccaccccatccggac

SEQ ID NO: 1808 - DNA, 561 bp, Homo sapiens
aagactacttctgaagagggaagctgctggtgcatcgggcgcccagcagagggagctgaggagggccgaggaggacgccgacaccagctgacgccccgtgcaggagtgtaatgtacttgtgctctctgaggcctggagccagaagccagatgtttttctgggatgacgaggaggcggttctagaactctgaagcctgtcttgctacagtttggtggagggtcaagaaagatgattcagaagtatgtcttttaagagtcttggtgacacgcacagagcccagtgactttagtctgggtgtggtgagctgacctcagagtctattgtgtgagtgtttttcacttttgagtttgttttacttttgtggtctccccagccttatttgtgagtgcaatctaaggaaagtatatttgttttgcaagcacactatggtttgctcagatttttaaatgacatatgtaggattacaccctctttattctgtcagtgtttccattaaaaattcaaactttctgggatttattacacagccataacaaattgctccaggcagaaacttggca

SEQ ID NO: 1809 - DNA, 1681 bp, Homo sapiens
ctgaaaagtaaaaagtatgtggattgggtcccagtggcctatatgcatatgaaactctgaaagaatggaccttcctctcagatggatggaactagaatttcaagagggtgagggagagcccctgctgttgtctctctctatcctcccactgcttggttctggatatgggatatgcaggaattacatggcagaatgggcaaataaagtccagctttctaccagaagattaaaaaaaggaatctcagagaattggaatgtatcacggagatagcagagagggaaaagttcaggaaagtaaactcataaaagtatttctgaactcctagtcttatgacctgtacaaatacaggttgacctcaaccagcatcctataaactttgagaattgaactataggacagattattggccaggtctcagaatggccactggatggtgcaaacctgggtctgatctgaataccactacaaagctttgaaaatggaatagacattgaaactacagaaggctgtttgaaacttgtggcgtcaatccaaacatgctgttcatccagtaaaacaaaaacttcaaaattcttcatagatttgaataagacccagcatcttaaaacataatccaaaatgtccatgataaaataaaaaattactcagcaaatgaagaaccagtaaaatctcaaattgcatggaaaaggcagttaacaaatgccaatgctgagatgatatagatgttgaaattatctgacaaagactttacaacagctattataaacacgctccaagaagtaagagtaaatatttttgaaatgagtggaaagatagaaagtctcataaaaattgaaattataaagaatgacataaaaatgttagagccaaaaagtagaataacaactcattagatgagctcaatataatagaaatgtcaaaggcaagagttagtagactgaagatagatcaatagaaattatccaacctgagcaactgagagaaaagaatactgaaaaaaacaaacaaacaaacaaacaaaaaaacatgaatagagtctcagggacctgtgtgataatcacaaaatgtgtaatatttatatcagtggagtctcggaaagagaagagaaaatgaagtgcattttccaaaaaacgttagaaaataaatggctgaaaagtttaagttttgtgaaagacataaacttgcatattccagaagctaaggaaactccaaacagaaaaagacaaacaaataaacaactcccccacccacaaaaaacccaagcccagatacataataatgaaactgctgaaaactaaagacaaagtattaaaaacagccaaagaaaaaaatagcacatgacttatggggagcaatgtttcagctgactgtagatctgtcataagaagccatgaagacagaacaaagtggtgtgacgttttaaaagtcactataaatttctcatgaaaaactatgaagccagaaagaagtggcatgacattttttaagtgctgaaagcaaaggaatattaacccacaactctatattcaggaaaatatgcatgacaaatgaaggagaaataaagatattctcagaagaaggaaaactaagagaattcttaaccagcagacctccttgagaagaacttctaaacatttcttctaaacagacagaagggctctaacccgagcttcaagcccc

SEQ ID NO: 1810 - DNA, 553 bp, Homo sapiens
aggcaggattgagctttcagctgctctgtagattctcatcagaggtgcagactcttctttgtggatcatacctacattttatttttcctgaaaatatagtatgtattcagggcacacaggcatcttctattcacttcatcatcaacacttgtcaaacaaaaactgctattcatgctacagactcatgcagctccctgcattttgaaagaattgcctccctcttctgagcctggctcaaggagtgagaagtgtcagcatcatcaactccaaagacagctttatacaagattagcatcttcaacaagaatgtcagaggcatgaaaatgaggaaaatgtaatcacaatcactcactatgaatttcctgggacaaaattaaacttaaatggcaacaaaaggtaagtgactcccatgcagtgattgccaaatgggctttcttcccaggtcctctgaaagaatctggaggaaatgatgatgctcaggagacaattcatgatcactcggaatttctgacaaccatgattctctcttctacgtggattttgaaaacagggc

SEQ ID NO: 1811 - DNA, 1054 bp, Homo sapiens
aggcaggattgagctttcagctgctctgtagattctcatcagaggtgcagactcttctttgtggatcatacctacattttatttttcctgaaaatatagtatgtattcagggcacacaggcatcttctattcacttcatcatcaacacttgtcaaacaaaaactgctattcatgctacagactcatgcagctccctgcattttgaaagaattgcctccctcttctgagcctggctcaaggagtgagaagtgtcagcatcatcaactccaaagacagctttatacaagattagcatcttcaacaagaatgtcagaggcatgaaaatgaggaaaatgtaatcacaatcactcactatgaatttcctgggacaaaattaaacttaaatggcaacaaaaggtcctctgaaagaatctggaggaaatgatgatgctcaggagacaattcatgatcactcggaatttctgacaaccatggcaatgaccttggaagccaagtgctaaagataatggagctatgacaataaagagcttgagtcttgaatcattacatggcagaccatccactcagcactctcatcgaacagttatgtaaacgtttctggagaaaataacagaagacatggcaggagaaatgattgagagcttttccagtttggcatggaaacaaagcaaagcaatttcagtgtggtaacaagactaaggaggagacagatgctgtgcgggcaacagtaccagagctaagggatgagaaacttctccataagatgtccctttattgctccagcagctattatgggctgcgtctccccaagcatggcagctcaccactgtggaaccctaaatagaatgacactcagtgttgaatggcaaggcctctggtcataaataagataagccgaaagacatttgatggttatcacagaaatggactttccttacttggaattttcctgcctaaacatccacagggaaaagctacatgttgggacttcataattcatttcaagcattttgtttgcaaatctcaaagcttgattttttttctaagtttgcag

SEQ ID NO: 1812 - DNA, 865 bp, Homo sapiens
gaatttatgaatttctcatcacatcagtagtaattctgagatggatttaggagtgagaagtgtcagcatcatcaactccaaagacagctttatacaagattagcatcttcaacaagaatgtcagaggcatgaaaatgaggaaaatgtaatcacaatcactcactatgaatttcctgggacaaaattaaacttaaatggcaacaaaaggtcctctgaaagaatctggaggaaatgatgatgctcaggagacaattcatgatcactcggaatttctgacaaccatgtgaccttggaagccaagtgctaaagataatggagctatgacaataaagagcttgagtcttgaatcattacatggcagaccatccactcagcactctcatcgaacagttatgtatagaaacgtttctggagaaaataacagaagacatggcaggagaaatgattgagagcttttccagtttggcatggaaacaaagcaaagcaatttcagtgtggtaacaagactaaggaggagacagatgctgtgcgggcaacagtaccagagctaagggatgagaaacttctccataagatgtccctttattgctccagcagctattatgggctgcgtctccccaagcatggcagctcaccactgtggaaccctaaatagaatgacactcagtgttgaatggcaaggcctctggtcataaataagataagccgaaagacatttgatggttatcacagaaatggactttccttacttggaattttcctgcctaaacatccacagggaaaagctacatgttgggacttcataattcatttcaagcattttgtttgcaaatctcaaagcttgattttttttctaagtttgcag

SEQ ID NO: 1813 - DNA, 911 bp, Homo sapiens
gaatttatgaatttctcatcacatcagtagtaattctgagatggatttaggagtgagaagtgtcagcatcatcaactccaaagacagctttatacaagattagcatcttcaacaagaatgtcagaggcatgaaaatgaggaaaatgtaatcacaatcactcactatgaatttcctgggacaaaattaaacttaaatggcaacaaaaggtaagtgactcccatgcagtgattgccaaatgggctttcttcccaggtcctctgaaagaatctggaggaaatgatgatgctcaggagacaattcatgatcactcggaatttctgacaaccatgtgaccttggaagccaagtgctaaagataatggagctatgacaataaagagcttgagtcttgaatcattacatggcagaccatccactcagcactctcatcgaacagttatgtatagaaacgtttctggagaaaataacagaagacatggcaggagaaatgattgagagcttttccagtttggcatggaaacaaagcaaagcaatttcagtgtggtaacaagactaaggaggagacagatgctgtgcgggcaacagtaccagagctaagggatgagaaacttctccataagatgtccctttattgctccagcagctattatgggctgcgtctccccaagcatggcagctcaccactgtggaaccctaaatagaatgacactcagtgttgaatggcaaggcctctggtcataaataagataagccgaaagacatttgatggttatcacagaaatggactttccttacttggaattttcctgcctaaacatccacagggaaaagctacatgttgggacttcataattcatttcaagcattttgtttgcaaatctcaaagcttgattttttttctaagtttgcag

SEQ ID NO: 1814 - DNA, 788 bp, Homo sapiens
gaatttatgaatttctcatcacatcagtagtaattctgagatggatttaggagtgagaagtgtcagcatcatcaactccaaagacagctttatacaagattagcatcttcaacaagaatgtcagaggcatgaaaatgaggaaaatgtaatcacaatcactcactatgaatttcctgggacaaaattaaacttaaatggcaacaaaagtgaccttggaagccaagtgctaaagataatggagctatgacaataaagagcttgagtcttgaatcattacatggcagaccatccactcagcactctcatcgaacagttatgtatagaaacgtttctggagaaaataacagaagacatggcaggagaaatgattgagagcttttccagtttggcatggaaacaaagcaaagcaatttcagtgtggtaacaagactaaggaggagacagatgctgtgcgggcaacagtaccagagctaagggatgagaaacttctccataagatgtccctttattgctccagcagctattatgggctgcgtctccccaagcatggcagctcaccactgtggaaccctaaatagaatgacactcagtgttgaatggcaaggcctctggtcataaataagataagccgaaagacatttgatggttatcacagaaatggactttccttacttggaattttcctgcctaaacatccacagggaaaagctacatgttgggacttcataattcatttcaagcattttgtttgcaaatctcaaagcttgattttttttctaagtttgcag

SEQ ID NO: 1815 - DNA, 1372 bp, Homo sapiens
cctcaaactcctgacctcgtgatccaccctcctcggcctcccaaagtgctgggattacaggcgtgacccactgtgcccggttgagatttctatgcctctttaccctctctgccctgaaactttttgtagtacaaatcatacaaagtcataagtggggatgtcacaatttaccccgtcagggaaagcagacatttacaagtacttaaaataaaatgagaatgttataagggaagaaactcatgtgaggggacttggttgcttaaagatcaggaatgtctctgaagtaatgacatctaagctgggaactgaaggatcaccaggaattagaccaatgggaatgtgggtgggtattccaggcagaaagtaggatacatttgaaagtacagaggtgaggccctcagggaaagtcgtggagctaagagagatttggaccatatgtggagaggaagagaggaaggacatgaagttagagggtctagggacttctctgcagggtggattaagggatcaagggacacacagagccagggatactaatgatgttagtagacagcaagagatcttggaaggaacctgggaaggggcagtcagaaatgcagaataaaaaccagaaatgagtaatgacatacaagacaactagtgagggaaaattcactttgtgaaaagggccaacaatgtgtcaactacagcaaggaagtcaaggctgaaaaggctaaaaagtggctgtgggatcaattaatgaaggcagcgttgaggccttggtgagcacagttgtgagagaagaggtagaaaccaaatcgtagcagtggaaaaacaaatgaagcttgaagaacagaaggtgttttaaagaaagctgtctgttgggaagtgaaggaaggtgacgttcctacaaaaagagaagtacaccataacgttggtatgagtgaaatcattcatttttcactgaacgcttacttcatgctgggacctaagcaacaactgtggcgacaatggacttattggtaatttactatgtgcagacactctcctcactttttgacagagaacgttgattagatgaccaaaagtgcccggccctttgccaagtgtgatagaaaacagggagaaggtatcatcatcgtttcacagatgcctacattccaaaggatctcatcagagcataagagctcttccagctgttgtttatccatgaattattattgcaatgcttaaccggagatagaaactcaccatgagcgtatcaacctttcctcttcagaagtttcacttcagtttgaaagaaaacgcaactggtgaaacaattgctgtgtgtcataaattataggtatctgacattcattacaaggaaagcaacagtcaaatatcatgggac

SEQ ID NO: 1816 - DNA, 841 bp, Homo sapiens
cagcactttgggaggctgaggctggaggattgcttgagcccaggagtttgagaccagcctggacaacatgaaaatccacggctattgttgccagtaagaggccacatcaagtgactgatcttgaaacaagagattaaggattaccaaccaatgggtaaaggagttacagcagcttttaaggcccactgcctgaggaggagcagctttgctcaggttattactgcaacaaaggaagacacggagaagacgctgatgcaattctgaaaggattacatctacgactccatcaggacccttgcttgggcttggggtgatgttaccaaggaacgtataaatgacatctggaagaagacactcaagaggttcatccgtgatttcaaaggatttgccaaggacaaggaggttgcaaaaaccaacaaggctgtggttgagatggcaaacaattttaacctgggggtggaagaagaagacattgaggagctcctacaggtggttcctgaggaactgactaatgaggagttgttggaactggaacaggaacacatacctcaagaagaggcaaggaagaaaaaactgcagaagaaaaagaatccccatgaaaattcacagtgaagagctgagaagtttttgcagacctcagtaagcgccttaaaaattctgaaaacatgggcccctcaacaccaaaagggtttcattaacagagaggaatgttctttatgcactgtctgcttacaagcaaatctatgatgaaaaaggaaagcaagcaaaccaccatggacatatttctgatgcatgacatctcctaagaacctcaggtaggtcttgttatcctagctccacg

SEQ ID NO: 1817 - DNA, 1598 bp, Homo sapiens
tggaacctcaagtaatgggaggggcacagggaggaatccaaggtatcctgagaaaccagcccacccacccacaggaattggggggtggggtggacagtcctatttctgtaggggttgtggggcagaggaggagagcaggtggtgatagccagagaccagaaaaagaaccattggccttatatgtatggggtgctttgaagaaaaatttctggattaggggtgtcagaagcaatctggactgggcaagatggtggatgaccaagatggtggaccaccttctctaggcagtttaaagaagggtagaggcacccttcttcttgggagtgagtgaggaaagaagggtcaaggagatgctggggtccccttccagggaggagtgacgagaggtggtggaagcagagatttttgagaggcacctaaccttcagggatctgttgtttgaatgtatgaaaaaggaagagggaaaatggctggaatatgaggaatcgaggatagacattgttataggctgaactgtgccctcccccactccacacacacacacaaagataggttgaagtcctccaaacctcagaatgttaccttgttttgaaacaggatctttacataggtaatcaagttaaaatgaaggtcattagggtgggctctaatccagattgctgacttacaaaaagaggaaatttggacacagagacaaatgcatacaaaagaaaatgtgcagacctatcacccaaagaacatgtgaggctaccagaggctaggagacaggcatggaacagattctgtctcatggccgtcagaaggaaccaacactgctgacaccttgatttcagacttctacctcctgaactttgagataaatgtctgttgtttcagccacctactttgcggtgcttcattagagcagtactaggaaactaatgcagacatcaaaaaggacctgatcactttttagggctaaaaggaagaaaatctaacacagactttcattcaattcccttccctcccttcttctttccttacctgtcagtctatgaagcatttttttgaccactggataatcttcagggagatcatcctctgaattagatgacttggatgttgggacttcaaatctacacagatgaggggaagggtcaggaaatcagccctctgatcctaatgcccccacgcataccccactcacatctctggaggaagaagggatgagactataccccagaaaacctgcctattaatgggaacaaaggtgtgggcccagtgagaacgtgatggctatggcagctggtgagaaaaggagggaacagaaaagtggaactcaccgtctccatgtcttcctcatatcctaggatgggcagaaacaaacatggatgtgagctctgggcttcattccctggggcatccttccctatctctcccctcctcaggtgcagtgacgggggaagagtgagggaggattctgttgacagattgaaggacaagtgggaatcatttcaggaagtcttccaggaggaggtgacctgtaaaagaagtgaaggttgtgttgactggaagagaagtgaaaaggcctgaacaaagaatgtgaagcatctctgggg

SEQ ID NO: 1818 - DNA, 2514 bp, Homo sapiens
cccagcctttgtagtgttttcgccaagcaaaaaaaaaaaaaaaaaaaaaaaacaaacaaactcgtacagaaggtggcagtgttgattcatttaaagggaacgaaacacccttacagtatcaacattaaatgcaaagaattctaatgaacatatcggttgtactacaaaaataatgaagccagctaattaccatcaggttacaactttacaaagaagtgaagcagcaaagagctgaagcagaaatgacataggaaaacagcagcaaagtccttgagtcccaacagtccacctcaaagacaaacatactaaagaacaaaggcccctaatccacctcctcaatggtagggcctgacccagaccctcccttgggaccctgagccccgaagccgccaggcccgggaccaccggcaccctggtacagtccgctgatgatggggttacacacctgctccagctccttcctcttgtgctcaaactcgtccttctcggccaaggtgttggcgtccagccacgagatgacctcttgacacttgtccagaaccttcttcttgtccgcctcgctgatcttgcccttgagcccctcatcctccacggcgctcttcatgttgaaggcgtaggactccagggcgttcttggctgacaccctctcgcgctgcacctcgtcctccgctttgtacttctccgcctcctgcaccatgcgctcgatctcctccttgctcaggcggcccttgtcgttggtgatggtgatcttgttggccttgccggtgctcttgtccgtggccgtgacgttcaggatgccgttggcatcgatgtcgaaggtcacctcgatctggggcacgcccctgggggccggagggatgccgctcagctcgaagcgccccaacagattgttgtctttcgtcatggccctctcgccctcgtacacctggatcagcaccccgggttggttgtcggagtaggtggtgaagatctgcgtctgcttggtggggatggtggtgaagatctgcgtctgcttggtggggatggtggagttgcgcttgatcagggcagtcatcacgcctccggccgtctccagccccagcgacaggggagccacgtccagcagcagcaggtcctgcacgttctcggacttgtcccccatcaggatggccgcctgcaccgccgccccgtaggccacagcctcgtcggggttgatgctcttgttcaggtcgcgcccgttgaagaagtcctgcagcagcttctgcaccttggggatgcgggtggagcccccgaccaggaccaggtcgtgaatctgggccttgtccagcttggcgtcgcgcagagccttctccacgggctccagggtgcttcggaacaggtcggagcacagctcctcgaacctcgccctggtgatggacgtgtagaagtcgatgccctcaaacagggagtcgatctccaggctggcctgggtgctggacgacagggtcctcttggccctctcgcaggcggtgcgcagccgcctcacggctcgcttgttctggctgatgtccttcttgtgttttctcttgaactcctccacgaagtggttcaccagcctgttgtcaaagtcctccccacccaggtgggtgtccccggccgtggccttcacctcgaagatgccgtcgtcgatcgtcaggatggacacgtcgaaggtgcccccgcccaggtcaaagatgagcacgttgcgctcccccttgcccgttctgtccaggccgtaggcgatggcggcggccgtgggctcgttgatgatccgcagcacgttgagccccgcgatcacacccgcatccttggtggcctggcgctgcgagtcgttgaagtaggccggcacggtgatcaccgcgttggtcaccgggtagcccaggtacgcctcggcgatctccttcatcttggtcagcaccatggacgagatctcctcggggtagaatgccttggtctcccccttgtagctcacctgcaccttgggcttgtctccgtcgttgatcacctggaaaggccagtgcttcatgtccgactgcaccaccgggtcgccgaacttgcggccaatcagccgcttcgcgtcaaacacggtgttctgcgggttcagcgccacctggttcttggccgcatccccgatgagccgctcggtgtccgtgaaggccacgtagctgggggtggtgcggttgccctggtcgttggcgatgatctccaccttgccgtgttggaacacccccacgcaggagtaggtggtgcccaggtcgatgccgatcgccgcggctttggccatgccggttccctgctctctgtcggctccgctctgagattgggggctggaaacggaacactggatccgcgagaagagctcggtccttccggacgccggaaactcgacgcgccggtgcctgcagccgcacaggttcgctctgggaagccttgggacaacgggagtcactctcgaaaaaggtagtggactgtcgcagcagctcctcaggctagccgttatccggaccgcttgcccct

SEQ ID NO: 1819 - DNA, 294 bp, Homo sapiens
caaatcatatcatttatcttccatagcatcttctttcttaatttctgtgccactggtccactaattatctgtagtaatgaatcacaaccagagccattttattcccatttaatgccccaactaactcatttctctcagtctcccactcccaacaatactagcaggcatcaaatttccagccttggccagaggtagaactcttggttttgtagtcaattcccctcagaaagggagaaaccaagaaaatgacattctcatacagacagtttgcaaaaatgagcaggtccccagact

SEQ ID NO: 1820 - DNA, 375 bp, Homo sapiens
cacagggggagtacagatgcatgggaggccgtagggttaggtaaaggggagcactaaagttgaagatgaggcactgccatcaatgctgggacttcaggccaagggcaggagctgaggaagccacaaggatggacattttctgcagagttgctgaaccggtagcaaccagggcctgagaaagtcctctcttgtggaagaataagagccaagcaggaaagcttttcatcatgcaaagctggggcagaaggttcttccttgaatgtggtcatgtgcacttcagctcaggagtccagcgcaggagtcctgcagagacagaggaaattgttttcagacctggctttactaaaagcttcttttccctgctttcaacgactc

SEQ ID NO: 1821 - DNA, 270 bp, Homo sapiens
ctcgccgctgcactgtgaagctctcaccaaccccgtagttgtgtctgcagtaggtgtccaccgcggcccgcgcctgctccaggatgtccttctggctgttccagtactcagcgtcaggccgccccagctccgtcaccgcccggaactcccccacgtcgctgtcgaagcgcacggactcctcctggttatagaagtatctgtccaggaaccgcacccgctccgtcccattgaagaaatgacactccctcttaggctgccacaggaaacgtg

SEQ ID NO: 1822 - DNA, 450 bp, Homo sapiens
gggtttaccccgcctgactcgctgcgctatgcgttccctcacgcctgccggatgccaggcggcgatgtgccaggctctgaggggccgcgagctcaccccagacgccggccccgggaatcctctgctcctccactttcccttcccgctactggtttcttgcccacccactcccaggtgtcactcttgggacatccagatgttctgacatttgacctgactccagcctcagcgcgaggacgggagaagggccaaggaacccaaatcctcagagctgatcgagaagcgcgtgttgttgcagaagtcactgaggggcagacctggaatgtgagccgtggggcgaagggacagctctggagactcgtgattccggaacccggatgatccagaacagacggtgaagagacaaaacagcgtgaaagggagcggcgatacctaaactgacctccggag

SEQ ID NO: 1823 - DNA, 564 bp, Homo sapiens
cttgggcaggtaagggggacagacaagaaaccaacaagagcataatgtcagggataagtgctatgaagatgataaagtagaatcaggagatgggggacaacgagggctgtttttgataaggtggtctgggaggcctctctgagggggtgatgtgggtggagatgtgaacatcatgagccatgtaggcctttggggaagagaattccaggcatagggaataggagtgcaaaggccctggggcagggtgtttgatgggtccaagaaatgacctggggatcagtgaggctaggatgtatgagagaaggtctgaggtattgggcagccggatcacatggggtcttgcaggcaattatagggctttttttttttttttttttttctgagacagagtcttgctctgtcacccaggctggatgcagtggtatgatctcagctcactgcaacctctgcctcccaggtttgagggattctcctgcctcaggctcctgagtagctgggactacaggcttgcgccaccacgcccagccaattttgtatttttagtagagatggggtttctccatg

SEQ ID NO: 1824 - DNA, 1044 bp, Homo sapiens
agagatactgtactttaatcaatcttcaatgctgcttaaataataagtgttaagagatggatggagcctggccaacatggcaaaacaccacctccactaaaaatacaaaaattagctgggcattccaggtgcttaggaggctgagacataagaattgcttgaacccggaagatggaggttgcagtgaaccgagagtgttccactgcactccagcctgggtgacagaggaagaccctgtctccctgtctaaaaaaagagagatggatgggaataatactaccttcacaccaagccagttgagatgctgctgttacagagccacggctgctgatgggcatgtgttatcttaaagtgtgttgagatgggtaattggaaattaatgggctagataatcttcaaggccttttccagttctaaaatcccattatcatttttatctcaacaaatacctgctaatctagacactaaacagagtcaaagaggaattgtcttgtaaaatgaaggagtgatagctgacgttaattcagcattgaccatgtgccaaggaccttgctcagttactcaacaatagattgaagtgaaatctaaaggaaagagcattcaaggataattcctgggttttcacctaagcgtaaatagcagtgccattactgaggtggagaagagataaggtgggactcgggaaggaaatcagtaatttggttttggccttgctaagtttgcaatctgagtatagatgtccagtaggcagttgaatacatgcatctggagttcctgggagaggtccaggctgaagatacaaatttggaacctgccagcctgtaaatggtgtgtaatggcatgggaatgaatgagatcatctagggagcaagtgtgggtaaacaaaggaagagtactaaagacaagcctggaaagctcccagcttttagagatttggttaaaagcaagaggtgctagcaaagaaaatgagcaatgagtgaggctggagtgaaatcagaggagtgtgggtccttgaaatgtagagtggagaaagaacttagtttg

SEQ ID NO: 1825 - DNA, 1016 bp, Homo sapiens
ctccatagattgatatgatcatatatttttctttagcttgttggagctttttaataatgaattcaatttatttattgtgtgtaaggctattcagattgtttcatcttggttgaggtttagtagcttgtggttttcaagtttaagttgttgaatttatgagcatggatagcctctatttcatttctgatattgtgattgtggctgtttttttgtcagtcttgctatataggtttatcaatattactaattttttaaagtagtagatttttgttttattaattttctctactgtttttctaatttcaatttcattggtttctattgttatgtttattattttcttccttttgcttcctttaacttgctcttcttttctagtcccttgaggtatgaactaaggttgttgatttaagacctttcctcattttatgtaagccgttagtgctataaacttccctctcagtactgctttcgattcaaatcttatattttgatattatatattgtgttttcattaaattctatgtagttttaaatttttcctttgagactttccttttgacccaggaattatttttaaatatgttgtttagttcccatgggtttagagattttcctgttatctttcagttgttgatttctagtttgactcccctgtggtcagaaaacacaattggtatgatttcaattctgttaaatttgttgagggttgtttatgacccaggatatagtgaatggacctatggtggtgaatattttatgagtgcttgagaaaaatgtttatcctagtgtgtatttttgtcagttatgctgttgtttgatcgagtactctctatatgttgttggttgtgttgtagagatcttctatattctttctgattctctgtctagatattctagaagttattgagaggagggtgttgaatcccaattaaattgttatttatctgtttttcctttcagtcctatcagtcttttttcttcatatattttaagattctgctgtttaggattta

SEQ ID NO: 1826 - DNA, 2606 bp, Homo sapiens
caaggcgtggtgaagagatataaattacacaagaaactacaagctatgtcaatgtctacctctctagctgacaagggaagcaggggaaatttctcttccaactgtctgctctgaaggtcatccaaacataattatcgggtggggtgggtgaactcttttattcttttaatcatccaacaaatatttctcaagcgcataccttgttaagagactgttttgggtacagtaattcacagtgaataaaacacagatattctcacctttgtgatactacgtcatagttgcaaggagtggggagaaacagacaggaagcaaagaagaaaaacaagaagtcatgtgatgatatctactgggagggactcattaggcagtaaaggactcagcagtgtggaggtgacacattcagttttcagtagaagagtcagggaagttgtcactttgaagctatcatttagcttccctttctttcaatcttctttctttacatgggaaataaggattgtgggatatttttgggtggatcacagcacctagagatggatctgatcaataagaactgctcagtaagcattagctactgcttcggttgccttccccctgtggagtgctggcctcttggattgagcttgcatcataggtgttcagtaggagcttgcttagtggatttataggttgaggttagaacccactggaattctcttcctggaaagaacaggcttctctttaaggtttcatacagaccctgggtgaggaaagagctctaaattgcttgaaaaattgaatgctctatgggcaaagcaagaagccctcctatggaagggcattatttgggcctatatcagggtctcagtaaaaacatgagtgctcaggaagtcaagatggttaagcagagaatctgaccagaatgttcatggtgcaaagaaataatcttgttgggggtaggattacaacaactggggaattagaatacaggctaaatgagattcaaaaataatacaacaagaatcaggcacaaatcctttactactacattcttttgtacaaatccattttgcctagaaaatcgtaccttactatacatccctattgtgtttctccaccatctattttactttttaaactttatttcatttttatcatcacagaagtttgttgctacaaaataaatgagcaaatcaaccaatggcaacaaaactgcactgatatctctccttagaccttcagaacattttccttaaaggtgaacaatactccacgttcaaggactttttcagcactatgtgctagaaactatactgactgtttattaatttttatgtaagttggtcgatatagtttctcagcttccccaagtattattaccacagtattatagatgacactgaagctcagagcagttaaaccattttcctcagatcacataactttaaagagggaaaccagatatgggaagcagatttctttctaaatgaaaaaatcatgagctcttgctttcacttagcacatagtctcatcatctgttttcttcacaccagctcactcatgtaacattcattcatttaccaaatacagataaataagtggatttattcttgcattcatcagatactaattcaaaatcgcttctgtgtctgctacactgtgctcaagacttcccagtgcctttgtctcctctccctcaaatctctccacccaatgtcttgacaaatactgtagattcttcctgcataacctctccagaatcttttccttctgttatccatgctacagtgtttatggaggatgttttcttcacctatgaagtgtgatgggggctgaagctgcagaaagactcatgctgttcacctcaggagctgacacagtaaatgtggataaacctcaatcctttaatatctttatgacttctttcccagttaccccagcaaatttacagattgaggttaaaaccacaacaggactatcttcctggaaagaataggcttccctttaaggtttcacatagatactgggtgaggaaggagccctaaattgcttgaaaaattgaatggtctttgggcaaagcaggaagccttgctatggaagagcatcatttgaacataaatcagagtctcagtacaaacagagtgctcaggacatcaagatggttaaccagagagcctgaccagaatatctgtggtggagagaaacgatcttgttgggagaaggatgacaataattggggactgtagagtaaaggctaaaaatgattcaaagagaatgcaaaaagaatcaggcacacatcctttactatactctgttgtgcaaatctcaccttactatgtgtttgtattctattcctccacaatctttattttattttatttttatgttcacagagatttgttggtgccaactaaatgagcctaacagccagtgacaacagaactgcactaaaaaaagtccctcatcagctcttgagagcaggttccttaaagagaatgagtagccactgctgtttgccctggcccatcaatgagaagatctgctcttagagccctgctttcctgctgaaggccccgaaatcacctgtgttccaggccacccgctaacaataaataatgctcccc

SEQ ID NO: 1827 - DNA, 367 bp, Homo sapiens
tgaagggatattttggagcacattggggcccatgctgaaaaagaaaatatcttgagatgaaaaccagaagaaaaaaacaaacaatcccatcaaaaagtgggcgaagaatatgaacagacacttctcaaaagaagacatttatgcagccaaaaaacacatgaaaaatgctcatcatcactggccatcagagaaatgcaaatcaaaaccacaatgagatatcatctcacaccagttagaatggtgatcattaaaaagtcaggaaacaaccagtgctggagaggatgtggagaaataggaacacttttacactgttggtgggactgtaaactagttcaaccattgtggaagtcagtgtggtgattcctca

SEQ ID NO: 1828 - DNA, 497 bp, Homo sapiens
gtttctgagaaactgctttgtgatgtgtgcactcatctcacagaggtaaatctttcttttgattcagcattttggaaacactgtttttgtcttttctgcaaatggatatttcagagctcattgatgtgaatggagaaaaagtgagtattccaagataaaaactagaaggaagctatctgagaaactgctttgtgatgtgtgcattcatctcacagagttaaacctttcttttcattcagctttttggaaacactgttttggtagaatctgtgaagggatatttgggagtgcattgaggtctaaggtgaaaaagaaaataccttcagataaaaagtagaaagaagctttctgaaaaactgctttgcgatgtgtgcattcatcacacagaggtaaacatttctttagactcagcagtttggaaacactttttttgtccattctgtgaatggacatatgggagctcattgagaccaatggagaaaaagtgaatatcacag

SEQ ID NO: 1829 - DNA, 905 bp, Homo sapiens
tgcgtacatcacaaagtggtttctcagacagcttccttctagtgtttatcctgggatatttgatttttcgccattggcctcagtgagctcccaaatgtccactcacagaatcaacaaaaacagtgtttccaaaatgctgaatcaaaagaaagttttaactctatatcaatgcacacatcacaaagtagtttctcagaaagcttctttgtacttttaatctgaagctattttctttttcatacgaggcctcattgtgctcccaaataaccctttgtagatcttacaaaaactgtgtttccaagctcctgaatgaaaagtaagttttaactctgcgagatgaatgcacacatcataaagccatttttcagataccttccttctagtttttatcctgggatatttgcttttgtaccattggcctcaatgagcacccaaatgtccattcacagaatggacagaaacagtttttttattctgttgaatcaaaagaaagttttaattctgaatttattttgtttttcatcatagaccacaatgtgctcccaatgtcccatgccagattctaggaaaacagtgtttccaaactgctgaatggaaaggaaattttaactctgagatgaatgcacacaccacaaagtggtttctcagatagcttccttgaagtttttattgtgggatattgagggcagtggcaaaaaagtgaatatcccaagataaaaactagaaggaagctatctaagaaaactctttgtcatgtgagcattcatctcacagagttaaacctttctttcattcagcaaatggaaacactgtttctgtagaatctgtgaagggaaatttgggagagccttgaggcctacagagaaaaagaaatatcttcagataaacactagaaaggagctttc

SEQ ID NO: 1830 - DNA, 4831 bp, Homo sapiens
cttgcactgatggtgcaaaactataatgaataaaactgttaacacctcagcataaataaagctgttggcaacaaactttattggtagtcattgaatttttcaccactatgcactctcagtaaagcaaaaaaaaaaaaaaaaaaaaaaaaaaaaaatctcaatttcacttacggatgtccttgataaatcagtaactattattaattttattaaatattgaccctttagtacatgccttttgaatattctgtatgagaaaatggaggtgaggaaggcttaaagcacttgtaccagacaccaaagttcccagaacatcttgaagaaaaacactgtgctgtaagctgaattaggttcttttttggctaaactccatattttcctgaaagaaaaactgacaaactatggtttttgagacttgggtatttggtaggcattttctcaagaagaatgaagtgagcctatcacttcaaagaagacaacttagaatgtctttgccaatgaatgtatttgaattttggagtaaaaattagaattgtgaaaaacttgtatttgtcaccataagcttgacttctttcccattcttattgattttttggtgagatccagagtgattaaaaaaatgtgatttttctagcatggacattggcacccccgccgccacccctgcactgccattgccaccagtgtgaatgcacgcatggccaccagtagctctgccccctgcccgatgctgctatcatcgctggtgttaatgcacacacaaaggtggccagcaccatgcccctgcactgccaccactgcaggagtgaatgcgcatggaccccagtagctctgtctccctcctccatcctgcaccttggttgctgccactgccaatgcccacatggatgcaggcagccctaggcccaccagtggccccaggtgacaagaactcatcctgtaatgctgccactgcagctggcatgtgcaaacgagcatgaaccccactgccactgcccaatgaattgctttggctaacactgtcctttagagtgttgtggcgagtgatccaggaaaaccttggcctctccagcacagcaggttcccaacctcagtgggccagagaagaaagctgggggccagataacaggcccccaagttaaagcatatagcccaggagtgttgatctgagccttgccctccaaaaaacaatctaccagaagtgaagccagtcaactgaacccaccttatgcgacaatcaaacccctaagggcatcaaagaagatacaagcaagcgaaacaaacaaatgtccaaaggacagcaacttcgagagttgaaggagcatcagcctatacagatgtaaaagaatcagtgcaagaactctggcaactcaaaaggcaagagtgtctccttacctctaaatgaccacacaagttccccaacaatttttcttaatcaggctgaaatagctaaaatgacagaaatagaattcagaagatagaaaggaatgaagatcatcaacaattaagagaaagttgaaatccaatccatggattctaaagaatacaataaatgatacagaagatgaaagatgaaatggtcattttcagaaaaaaacaaactgaactgacaaagatgaaaaacttacttcaagaatttcagaatacggttgcaagtattaacagcagaattgaccaagctgaggaaagcatctcagagctccaaacctgttttctgaaataacacagtgaagatcaaataaagaaaaaaaataataaagttgaatgaacaaaacttctgaataatataggattatttaaagagacccaatttatgactcattggcattcctgaaagacaggaagagaaagaaaacaacttggaaaacatatttcaggttattattcatgaaaatttccccaaccttactaaataggccaacattcaaattcaggaagtgcaaaaaaaacccctgtgaaacaagaagaccacctccaggacacatagtcatcagattctccaaggtgaaaatgaaataaaaaatgttaaaagcagctagagagaaggggcaggtcacctacaaagggaaccccatcaggctaacagtgggccttacagcagaaatcctataagccagaaggggttaggagcctacatccagcattcttaaagagaagaatttctgaccaagaattttgtatccagccaaagtaagcttcataagtgaagaagaaataaaatgtttttcaggcaagtaaatgctatcggattttgctgtcacgagatttgccttacaagaggtcctgaagggagggctaaacatggaaaggaaagacagttacaagccacgacaaaaacacacaagtacataggtcaatgacaatataaagaaaccacacaaaaatatctgcataataacccactaacaaaatgataacaggaagaaatttgcacatgtcaatactaaccttgaatgtaaatgggctaaatatcccttaaaattgaaaggtgtagattgacaagttagataaaggagcaagactaaatggtttgttgtcttcaagagacccatctcacatgtggtgacaccaaaagactcaaaataaaggaatggggaaaaatttaccaagcaaatgagaaaccgaaaaaaaaacaggggttgctcttctaatttcagataaaacagactttaaaccaacaaagattttaaaaaaatgaaacaaggaagtgcattacttaatggttaagggctcaattcaacaagaagacctaactatcctaaattatatgtactgaacacaggagcacccagattcataaagcaagttctagtgacctatgaagagatttagataactatgcaataatattggaagactttaacaccccaatagcaatataagacgatcattgaggcagaaagctaacataaatatacaagacatgaactcaatgcttgacaaaatagacctaagagacatctacaaaacattccacccacagacaagagaatatacattctttgcatcagcacatggcacacactctaaaagtgaccagacaattggaaataaaacaatctccaaacaaacacttaaaaacttgaaatcatactaaccacactcttggatcacagtgcaataaaaataggaatcagtactaagaaagtccctggaaacctataattacacagaaattaaacaacttgacccagaataactttttggtaaataatgaaatcaaggcagaaatcaagaaattctttgaaactaatgagaacaaagatataacataccagaatctgggacacagctaaggtgacaagagggaaatttatagcactaaacatcaacataaaaaagttggaaaaatttcaaagcagcaacctaacatcacaaatagaagaactagagaaacaagagcaaaccaaccccaaagctagttgaagacaagaaataaccaaaatcaaagcagaactgaaggaaaaatgagacataaaactcatgcaaatgatgaatgaatccaggagttgttggttttctgaagaaataaataggatagacagactacttgctagactaataatgaaaaaagagggcagataagaataaagtcaatcagaaatgacaaacgggatgttaccacttaccccataacaacaaaaaaactctcagagactactacaaatacctctatacacacaaatgaaaaaatgtaggataaatggatagattcctggacacatacaacctcccaagagtaaaccaggaataaattgaatccctgaacaaatcataagttcaaaatttgaatttgaatcagtaataaaaagcctactatccaaaaaagcccagaaccagatgaactcacagttgaattcaaccacttgtataaagaagagcaagtattattcctatggaagctattccaaacattgaggagagggagtcctccctaagtcattctatgaggccaccatcatcctgataccaaaaccctggcagagacacaataacaacaacaataacaggtcaggccagtacccttgatgaacatagatgcaaaaatcttcagtaaaatattagcaaaccaaattgagcagcacatcaaaaagctaatccaccatgaccaagtaggctttatatctgggatgcaaggttgtttcaacacatgcaaatgaacaaatgtgattcattacataaacagaattgaaaacaaaaaccacatgattattttgttacatgcagaaaaggcttttgataaaattcaacatccctttatgttaaaaatcctcaaaaaactaggcattggaggaatctgcctcaaaataataagacatatatataacaaatgcacagccaacattatactgaatggggagcagttgaaagcattctccttgcaaatcagaaaaagacaagatgcccattttcaccactcctagtcaacatagtactggaaaacctggcaagagaaagaaataaaacacatccaagtagtaagagaggaagtcaaactatccctgttttcagacaatacgattctatacctagaaaatcccatagtctccacccaaaagctccttgagctgataaataacttcagcaaagttttagtatacaaaatcaatgtacaaaaatcagtagcattcccatgcaccaacagcatccaagttggcagccaaatcaaaaatgcaatcccattcacaataaccataaaaagaataacaccaaggaatacagttatccagggaattgaaagatctctacaattagaattacaaaacactactcaaagaaatcagggatgacacaaacaaatagaaaaatatgccatgctcatgtacaggag

SEQ ID NO: 1831 - DNA, 491 bp, Homo sapiens
tgatgagattatctatttcaaataagacaaaaaataagcttacctccatccttcttagcaaatcacatcggttattcaattatgtgttctttgtttgtgggtacttgtcttcagggctccagggctcctgaaatccctatgtttcccccatttccatctgttgaaatgctactgattcctcaaggtcattttacataatatcatctttagaaatcttttcctgcttctaacaaccatatattaacccttagttccccgaattccaatagcatgttttctctcattgttcttaaaatacctaaacatatactatatttctttttctataattttctctctttttagaatttaagtttctgaaaagcaaggactatatcatagtttatcacctttttgatgtattgtagtacttagcatagtttatcccatagaatagtcatttaacaaatatatattgaattgtttaattagccaaaggagactactcttat

SEQ ID NO: 1832 - DNA, 668 bp, Homo sapiens
caggaaatgtatcagccatgccttccttttaaaaaatcttttatatgcatattttgtctcctttgacatagtactatcgtgcatggctttaatgtcttttttgatggtattgtttttaagttgagcatatactatatttagattttgcaaactttaattccaacaaatctgttgctattttattagaatatctagggcttctaaattcatacgcatacacttgcagtgacaatagaacataaaagcatcaaatgtttacatatttaaatactaggtgacacaaacactatcatacattacttaatagactattaggaattcattctgcaaacaaacagcctgccaatcttacctgattgggcttttaagtgttgtgcagcataaaataggataccatctgcagcgagaggctgaaactgcaattgaatatgtgtcttttttcgaacatgaaaggaagcaaaagacatccaggataactcattgcttctgaaagatggatcacttatggataaagctgagggaaggagagaaagagaactctgggagttatctgctggattaaaaaacattgctcataaatacaataaactgcttatgtaattttgtaatttcaggatttatcgcccaagagttgcttgtagagatgaggattttgctatgttgcccag

SEQ ID NO: 1833 - DNA, 1574 bp, Homo sapiens
agcattcataattgcttgtcttttggataaaagccactttaactagagaagttcttaaaggacctaatggagctgaaaaccatggcacgagaactacgtgacaaatgcacaagcttcagtagctgatttgatcaactggaagaaagggtatcagtgattgaagatcaaatgaatgaaatgaagtgaaaagagaagtttagagaaaaaagaataaaaagaaatgaacaaagcttccaagaaatatggggctatgtgaaaagaccaaatctacgtctgattggtgtacctgaaagtgtcagggagaatgaaaccaagttggaaaacactctgcagtatattatccaggagaacttcccgaacctagcaaggcaggccagcattcaaattcaggaaacacagagaacgccacaaagatactcctcgagaagagcaactccaagacacataattgtcagattcacctaagttgaaatgaaggaaaaaatgttaagggcagccagagagaaaggtcgggttgctcacaaagtgaagcccatcagactaacagctgatctctcagcagaaactctacaagccagaagagagtgggtgccaatattcaacattcttgaaaagaattttcaacccagaatttcatatccagccaaactaagcttcataagtgaaagaaaaataaaatactttacagacaagcaaatgctgagagattttgtcaccaccaggcctgccctaaaagagctcctgaaggaagcactaaatatggaaaggaacaaccggtaccagccactgcaaaaacacgccaagttgctaggaagaaactgcatcaactaatgagcaaaataaccagctaacctcaaaatgacaggatcaaattcacacataacactattaaccttaaatgtaaatgggttaaatgttccaattaaaagacacagactgccaaattggataaagagtcaagacccatcagtgtgctgtattcagaaaacccatctgacgtgcagagacacacataggctcaaaataaaaggatggaggaagatctgccaagcaaatggaaaacaaaaaaaaggcagggggtgcaatcctagtctctgataaaccagactttaaaccaacaaagatcaaaagagacaaagaaggccattacatagtggtaaagggatcaatttagcaagaagaactaactatcctgaatatatatgcacccaatacaggagcacccagattcataaagcaagtgcttagatacctacaaggagacttagactaccacacaataatgatgggagactttaacatcccactgtcaacattaaacagatcaacgagacagaaagttaacaaggatatccaggaattgaaatcagttctgcaccaagcagacctaatagacatctacagaactctccaccccaaatcaacagaatatacattcttctcagcaccacattgcagttattccaaaattgaccacatagttggaagtcaagcactccttagcaaatgtaagatgcaaattattctcacttatggaaaagaaaatatatgatacaatttctcatttaggccag

SEQ ID NO: 1834 - DNA, 238 bp, Homo sapiens
gctaattctgaatgttatccactttcttatcccctaagaaagtctgtggaagaagaaagaagaagaatcaaatatgaaactcatgaaatacatccttaataaagcccttaaattccattactctaaacgtctggaattgacttgaagtactgacaactgtagagcaccatctagttttggcctctagaactgcaaccaagtcttctgattctcaatggaccatggaaaacacctgtgc

SEQ ID NO: 1835 - DNA, 302 bp, Homo sapiens
agaaggtgccaggagtcaaggaatgtgtgtggcctctggaagctggaaaaagcaagaaaatcagttctcctcaagagtctccagaaaggaaaactgacactttgactttagcccaatcagaaagatggagtctcactctgtcacccaggctggagtgcaatggcgggatcttggctcactgcaacctccgcctcccaggttcaagcggttttcctccctcagcctcctgagtagctgggactacaggctagttttgaagtcctgggctcagtgatccacctgccttggcctctcaaagtgct

SEQ ID NO: 1836 - DNA, 301 bp, Homo sapiens
tcttattccattttgaatggtatgagccttgcaagaagacatacatattttgctgattgccaaggggataatgcattgggtataagaagaaggaaagtagaggaaccaattaagaaatatttactacaattaagaagagatgataataacttcgaccaaggtggaggctatgaagatggagcaatgcgaatacatggagacatgtttttgatgtagactcagcaagaaattctaatatattagattttatgttttgggagaaaaagagacatctccaagattatggcttgaatagattggg

SEQ ID NO: 1837 - DNA, 1161 bp, Homo sapiens
gcagattttaattttcttattttgtattttctgatttatctacaatgaatttgtattaatttgctaacaaaacatcactattaaaataaattttttttgaattataagaaaaggctaacatcataacaataaggttgtatagaataaactgacaacacagaagttattttggccctgtgttccacagtgactcaccaaatataccctgcactgtttattttatttttttctatttcactattgaaatgaacagatgcatttcacgtcacatggatctcgtggaaacatgccaaacattttcttagcaaccaaactcctgtcttctgcactgtgcatgattaactaaaacagcctgttgacggcttaaaataaacctgccttttccatttagcattttatcaaatgaatataatttcatttgctgatgaatttagttcagcttcaagagaatttttcttttcttcatggggaggctgaagaatcagaactgtcataccaaagaatgaaaagcaagcctagggagaacaagacagtctgatgtttacatggggttaacttatttgatcagtgaaatcagaaaaggatcattctgcattcgtggactactctcattgacacactcgcttacccatctgaaaacagcaacacagtctgggttcctgatttgtatctgttacccttcatggaaatggctggtgaagcaaaactatgtgtgtaaaactgcatctgccacaggctgcttgtccacaaaagcagcaaagcatctctatggaatacctccgtatggatctgtaaagaagagtcccacttcagtcaaagacagtagattatgaggtaagataacacgtgtagtttttaagattccatactgacaagcttctgttgttttaaaaaaaagttttgggtgttgatacagaaattaatgctaaatagataatgatctccctctaatgacatgcttcatcatgttacttattctcttctctcaaaaatacacgatgtcatttaatcttcacaataatcttgtaagataggatcagctctatttcacttctggaagatgttaagaaaagttaattatttgacaaaagttgtaattagcaattggcaaacactccaacccaacttctgactccaaagtcagtgtttttactattctac

SEQ ID NO: 1838 - DNA, 3219 bp, Homo sapiens
gcagattttaattttcttattttgtattttctgatttatctacaatgaatttgtattaatttgctaacaaaacatcactattaaaataaattttttttgaattataagaaaaggctaacatcataacaataaggttgtatagaataaactgacaacacagaagttattttggccctgtgttccacagtgactcaccaaatataccctgcactgtttattttatttttttctatttcactattgaaatgaacagatgcatttcacgtcacatggatctcgtggaaacatgccaaacattttcttagcaaccaaactcctgtcttctgcactgtgcatgattaactaaaacagcctgttgacggcttaaaataaacctgccttttccatttagcattttatcaaatgaatataatttcatttgctgatgaatttagttcagcttcaagagaatttttcttttcttcatggggaggctgaagaatcagaactgtcataccaaagaatgaaaagcaagcctagggagaacaagacagtctgatgtttacatggggttaacttatttgatcagtgaaatcagaaaaggatcattctgcattcgtggactactctcattgacacactcgcttacccatctgaaaacagcaacacagtctgggttcctgatttgtatctgttacccttcatggaaatggctggtgaagcaaaactatgtgtgtaaaactgcatctgccacaggctgcttgtccacaaaagcagcaaagcatctctatggaatacctccgtatggatctgtaaagaagagtcccacttcagtcaaagacagtagattatgagggggtgggagaaggggcatgccagatgaaggaatgatgtgggttcaaggctaccaactgtaacaactgcaatattatcaaatgtaaagtttctctgaaaatgagacccagcagtggacaaagtaagtactattattcgaacctccagatccaaccacacattattaagctttctggttttgagacaaaagtaatttccttattttgcttaagcttgtttgatttgggtttctgttaccacttaaagagtctaggctgggcacagtggctcatgcctgtaatcccagtactttgggaggccgaggcaggtggatcacctgaggtcaggagacggagaccagcctggccaacatggtgaaaccctgtctctactaaaaacacacaaaaaaattagctgggcgtggtggcaggtgcctgtaatcctagctacttgggaggctgaggcaggacaatcgctcgaacccgggaggcagaggttgcagtgagccgagaccgtgccatcacacgccagcctgggggacaagagcgagatttcatctcaaaaaaaaaaaaaagtactaaaacaaaactctttctaaaatatttctttagatttctcatattgaggctactgaatgtaatctactacctgtgtaatctcatgggtaacctataacatatatcacaatctattagctgtaactgaaaatgggaataacagtacttatttggaaaaactttgtgaggaataaagcacataaaaatgccaactgccatgtctggcattcagcaaaaataattgctctccacaattattgtctttccaaaacaacaatagcagctaacgtccgagtgcttctggttctaagcagtttttcttgtattaatttcgagttaattaggttagattactgtgaggtaggcactctaattagccctgttttataaagaagaaaacaaaggtgcagagaggtgttgtcacttatccaaggatacacacagacattaagggacagctgaggtatgaattacctatcacattatgcaacccaaaagttccgtgggtttgaaagtttctggattttgttctctctttgctgtgaagctgttaactcccctctccttcttatgtcactgaacccgtctttagaaaatcctttcaaagtttagtttttttactcttctgtgggttaggaaacaaactcatcattcttactgcaaatttattgatttattattacttttaagttccaggatacatgtgaagaatgtgaagatttgttacataggtatatgtgtgttatggtggtttgctgcacccacctactgacttatcttctaagctccttctcctcatccccgacccctcaacaggcccgtgtgtgttgttcccctcccaaatttaatactgaataaagtaaggagagttctaagtgcagataaaaaagacataatgtatttagtacagaggttttaagataatttggaggtttaaaagctttttctgcttatgtcttgtgcaaagtatagcattaatgtattacacattcatacctgtattctatttgttcattcttttttccctacaagaaactcatagttagccatggtaatagcagctaatgtttaccgagtgcttataatgtgccaggcacctgccaagcataaacctaagtatttcatttactcataaccaccataagaagtactattaaagaccaataacagctgagcaagctgtggtccaaggacacacagggaacagtgggagggcagggatggaacctcatgcagtctggctcactgtgctcttcatccactttgtgaagacaggggcctgtctggtttactctccacgctctcctgccatctaacacagtctagggcatccagaaagtactagtggttaattttttaaaattctcctgaatagactcgcttgaacctgggaggcagaggttgcagtgagccaagattgcgccactgcactccagcctgggcgacggagtgagactgtctcaaaaacaaaaaaaaaaaaaaaaaaaaaaaaacaacacccaaaaaacaaaagaaacaaacaaacaaaaaactcctaaataaaaggagagcaatttcaagtgatataaaaggagactttaacataagaaagttttgtgtagaaggggaaaaactttttaaggcagattcgttgcaatttatggtaacttctttaatcctaaaaaaatccgtattatcccataatacaaatttcccttccccttttcatcaggcagatttacatgctctatccaactaacaactagtcggggataccagaagccgagtatctcagaaaatgaggtggaagaggataatcagaaaaatggcaagtcagccatggaataaatttgtgtttatttcacaattc

SEQ ID NO: 1839 - DNA, 1360 bp, Homo sapiens
gtaaatggttatacatatcagacatacaaatctattaagaaaactttttaatatagtttagcacttttgagagattctgttcccaataaatgaaaggaacacaatttagaagatgacaggtggtacatcttttaattggagacctaaccaggtaagtcttgacaaatagtcatgcaatgaaattcaataatatgcatttataagaactcagaataacacagtaactccttcccctcatcagtatatatgactggcgtcagaaatcatactacgagcaaatgctagtaaattcttgaaaaaaacagctcactttagaataagtgccaatctaaattttttattcttcccaacacactatttccaccactcttcattttaacaatgttttctccttgggctggtggtatattactgctttttaaagaccaatcatacccagcatgatccaaggtcatcaacttctctataagctgaagtgaattacaaacagccaaaagaccaatgcatttaaacagaaaactatccactctagtcaacaaggcagaagtcctatgtctgaaacacttctattcaaagttgctttaaaactaatcctgtaagtccaatagtattacactattgttgtctccttggtttgaggacaagttcaaatcttaaaagcattaacattgccaaattatattactctggacataattgaactgaagatctttctataatatattgggataaagtttttctattctttgcagttggtatgtatttccactattccttgcatttggcatgaaatcttacacccagtcactgagatacaaagagtgtaggagaacaaggagaggaattacactgtagccaagcttctgcgggctatgacagagagcaactaactgtccttgcaaacagagaaatgtcttccgaactcaacataatattctaacagaattgtagtaatggaatcctttgagttttagcaggacagagagctgcttagctggagactacatttgctaccctcccttgcagctagaaagaactaatggaaggtgaagaactgaccagcgatgatcggccagaagactgtggcgtttcaaaatcagataagtaagaataatggtgtttgcctgcctttctttcttgatcagtacctggacttcctgctctttcccccattgttttgaaaaatggtctctattcacataatttcacagattattttctccagaggagactatgacaatactgaaaaacattttcacagtcttcagatcctgataatattcatttctgtgcaatctattttctccacaatgtatttgtagaccacaattcacattggcatccagaagataaacttttt

SEQ ID NO: 1840 - DNA, 1805 bp, Homo sapiens
gtttagcacttttgagagattctgttcccaataaatgaaaggaacacaatttagaagatgacaggtggtacatcttttaattggagacctaaccaggtaagtcttgacaaatagtcatgcaatgaaattcaataatatgcatttataagaactcagaataacacagtaactccttcccctcatcagtatatatgactggcgtcagaaatcatactacgagcaaatgctagtaaattcttgaaaaaaacagctcactttagaataagtgccaatctaaattttttattcttcccaacacactatttccaccactcttcattttaacaatgttttctccttgggctggtggtatattactgctttttaaagaccaatcatacccagcatgatccaaggtcatcaacttctctataagctgaagtgaattacaaacagccaaaagaccaatgcatttaaacagaaaactatccactctagtcaacaaggcagaagtcctatgtctgaaacacttctattcaaagttgctttaaaactaatcctgtaagtccaatagtattacactattgttgtctccttggtttgaggacaagttcaaatcttaaaagcattaacattgccaaattatattactctggacataattgaactgaagatctttctataatatattgggataaagtttttctattctttgcagttggtatgtatttccactattccttgcatttggcatgaaatcttacacccagtcactgagatacaaagagtgtaggagaacaaggagaggaattacactgtagccaagcttctgcgggctatgacagagagcaactaactgtccttgcaaacagagaaatgtcttccgaactcaacataatattctaacagaattgtagtaatggaatcctttgagttttagcaggacagagagctgcttagctggagactacatttgctaccctcccttgcagctagaaagaactaatggaaggtgagtggaagtacatgtgcaacttcagatcacatttataaaaccaaatgctgcttcccctccatttccttgttgccctttcccacaggggtggaaagccagttccaaccatacacaagagggctacactctttaaaatggaatatcaacaagacagggggtgactaccatgaaacaaagctgtctaccaactgtgaactaccaactgacttcagtctattacaagagagagaaatttttatctcacttgagccactctattaagtctttttccaatagcaacttagcttgtactctaagctaccatttggtgaggccctttacagtggcaggctcagtctaaagagctttataaatgtcatgattatttccaatttcatctgactaaaaaagaaaaagaaaaaaaaatttcatgattactcattgtcacaaccctgaaaagtaatccaccctcattttatacatgagaaagctgaggctccaagaagtcacacaactaaaatgttagaatttaactaaaatgagagctaactccaaggctatatactcttatactcttttcactataccaggtttctattccttctgttgaatgtatactgtaaaaagacctatattttagtccttttaaagttaacaattactttgttattcctcactttgtgatttcaaaaagacaaatcaacatgatctagtctcaatgacagcacaaatacagaaacacaacttagcggatacaactaacttgtctgaattatcaaacaaaaataaataaacaaataaaaaactagaatatacacagaaatcaaatcag

SEQ ID NO: 1841 - DNA, 1250 bp, Homo sapiens
ccctcatcagtatatatgactggcgtcagaaatcatactacgagcaaatgctagtaaattcttgaaaaaaacagctcactttagaataagtgccaatctaaattttttattcttcccaacacactatttccaccactcttcattttaacaatgttttctccttgggctggtggtatattactgctttttaaagaccaatcatacccagcatgatccaaggtcatcaacttctctataagctgaagtgaattacaaacagccaaaagaccaatgcatttaaacagaaaactatccactctagtcaacaaggcagaagtcctatgtctgaaacacttctattcaaagttgctttaaaactaatcctgtaagtccaatagtattacactattgttgtctccttggtttgaggacaagttcaaatcttaaaagcattaacattgccaaattatattactctggacataattgaactgaagatctttctataatatattgggataaagtttttctattctttgcagttggtatgtatttccactattccttgcatttggcatgaaatcttacacccagtcactgagatacaaagagtgtaggagaacaaggagaggaattacactgtagccaagcttctgcgggctatgacagagagcaactaactgtccttgcaaacagagaaatgtcttccgaactcaacataatattctaacagaattgtagattaaagaagactgaagagatatgaaaactaaatgcaattcatgatcttgtaccagagggaagaaaattctatcaagaacaatattgtatcaactgacaaaatcataatatgaatgacagatcagataaatgtgttgtgtcaaagttaaatttcctgaagttgaaaactacattagaatacagtctaagagaatgtcctagtttggggaaatatacatacaactatttaaaggtatgggcatgacacaactcactcacaaatagttctttagctattcttgccactttaactttgaaactacttccaaatgaaaaaattaaaaattttaaaatatgtaagaacaccacaagtatagtaactttagtaagtggcatctgaattctacttcatcagaattttctgaatgcaacttgtccttattccctaaccctaaatagcaaatgacttagagtgttcaatttttttctttccttaataacattattcaaatgtgtatggctcctgataagccatcccctaccactgtatc

SEQ ID NO: 1842 - DNA, 5387 bp, Homo sapiens
ccgtcttggcccttggccctgcccctcctctctagtcttgagtctccacgggcctccggggtttttgttttgtttgttttaataacaaccacttctctagatccgcttgctccctttcttctcttctcggtcccaggaagtaaataccctttcccagctcctctcctcctaacttcccagtccccccagtgccggtcaacctcccttcctcgggaccctctcagaagccgagctctttactcattttcctaggtcttccttctcctcgcggtccctacatcctcccccatccctaatcccttcatcttccctgctttaagaaccacccgcaggcccccatccacgaacgccccttcactagctaccagacgcttcaacccagcctcacctcgcacctccacctcccccgccgtctccacgcccacttcaaagcccacctccaacccgcaggctcttcagcagagccgatgcggcgtcccgcctccttgccttccctcttaggaccaaactcccagctggggcctcggcgtctgaccgccaaagagcgggtgcctggttcctgcggaggctgccgggcgggtgccgaggttgccgagatgcgggaggtttgaacacaaggatgggacagaggcgaggatcggggctcctgggtggcagcggcggtaacctgggctccagggtaacggaggcggaggcctagactgcactacgaagagaccgcagccaatcatgatgactctacccgagctcccattggcttctgtctccagacggccctttttattggcttcagtggaactggaaggcgggacggcgagtgcgggagaaggtctccattggccgaccgctctagctgtagcggagacccccaagtagggaaattggggcaaaacgcggagcgctccaggctcctacgggctgtgcggtgccagggctcgactgctgagcgtcgtgggctccgagagggacgcgggcggagggcaaagagcgtcagatcaggattgctgaaggagagctgagaatgaaaccaccatttattcagcactcagaatgctccaggcagtgtaatctcattccatcttcattcatgactccagacaggtattgttattcattgtttatacttgagaaagcagattcagagaagttaaagtatctaccacaaggtacgaaagtagtaagtagtaatgccagagtacaagcctaggtctgcttccaaatttcgtggtttcggatttagtgccttcattgtgtttcacctacaggttaagaagttgttggtaagcaagaaaatatttaagacgctgggagaatccaaaaaattgtctagttgtgtgtaacatagtctcaggattcttacagtgtgcaattttattcaccccctcatattcaaaataacagtatcagtttgaccttgaaaaaagaccaaaaaatgtataaatttacagaagtaaaaactagtttattgaattaccattttaaaaggttaccccaaaatatgagaaagcagttttaaaagttttatgacattacatggttttatatattatttttgatagggctagaattttctaagataccatttgacattttatttcagtaccacacaggattctgcttttcagaaataaaggaaacaaagttatcaaaaccacatttatatttctgccacttgaaattatagttaacagaaatcagactcttgtttttaaagattttgtttatgaaacaaattctgcaatggtcattaagcactttggagttttatttttaatatcctgggcttcttccattgatactgcaatatctccagatttgctacattgctaactgaatgttcattttctgtaggactttgattggcttctttattgccatatggcaatgatgtagatgttataatgtaactaaaatattcctacaaatgcttactagtaggattattctcattttcctttggggaaactagtgtcgagtttgaatggttggttagaagtttcaaaaaagtaataggtagataaatagactctctaactgtagacagagaaattacaatgaccataatttgtaaagtggggggacatactatatatagtatcttggaaagcacataagtataattatccttagctaaagttcagtcatctatttcataccattctacaaaagaagaaaagcagtgtcacaattttatataatttacagaaatgtgatacataacaaaaattcaaaaattttttctctaacttcttgatctcatgttgcttggaaattttaaatttattaatagattctaggtaaatagttggttttagcatataacactaaatttgaaacagtatctaatatgctgcatgtttaagagaaatcgaatggattggttgagttgggtgtaaagaacagtataattggccgggtgctgtggctcatgcctgtaatcccagcactttgggaggccaaggtgggtggatcacgaggtcaggagatcaagaccatcctggctaacacagtaaaaccctgtctctaataaaaatacaaaaaaatgagctgggcgtggtggcgggtgcctgtagtcccagctactcgggaggctgaggcaggagaatggcatgaacccgggaggcggaggttgcagtgagccgagatcgcgccactgcactccagcctgggcaacagagcaagattccgtctcaaaaataaataaataaataaataaaataaataaatagtataatttcatacctagaaagtgggctgctctgatgaaaacaaatgtagtctaatctgattgctatgaatacttgattttgcagtacaaaaagctagtagcctttgattattgctctgtttaaaggatacagtttctgatcacttgatgaaatgtacgagtttttttttgttaatggagaaagaaaacttgagatgtttgtaaaaatgtgtatatacttacaacataatgctggtcatcgatagaatgaactactgattaacacggattaattttaaagacaatattgagcaaaagaagtcagacacaaaagaatatattctgtatacttccattaataagtgattcaaaaacaggcaaaattcatctaaactggaaaaaattagaacagttattgactgtggggatggaggtaggatcaagtggaagggactgaaagttatttttggagtgatgtgaatatgctgttttgactgacgtggtagttaaagagagtttccagccgggcatggtggctcatgcctgtaatcccagcactttggtaggccgaagtgggcagatcacttgaggtgaggagtttgagaccagtctggccaacatggtgagacccccatttctactaaaaatacaaaattagccagacgtggtggtgtgtgcctgcagtcccagcttcacgtgaggctgaggcaggagaattgcttgaacctgggaggcaaaggttgcagtgagctgagatcacaccactgcactccagcctgggcggcagagtgagactcagtctcaaaaaaaaagaagtttcctttatcaaaattcattaaaatatataaaatatgtgtgcttttcactgtatgtaaattttacctcaatttctgaatggcttaaaaaaaaagaatgcattggtttgtataacagaaaaatctagtagacctagctccacgtatggttggatccaagtgctcaatgttattaaaattttttcttctctttgtctcttggatgtacttttctacgtgttggtcttatttaaggcaggctttcccttccaggtatggccaccagtgctccagatttacattctatttacctcacaaccccagtggaaaaagaatatctctttcctgattggtccagcagaaatcttggtattaactctgactgcccacacttgaatatgaactattagtaagtactgtggccaagagtttgcttcgggaaagaatatgataaagtcaccttatctttcatgtttgctcagaatagtgaggtgattctccacaggaaaactggaatgctgttactagaagaagaaatactggacaaagctaatagatgtccccaaaagtgatgataataattttattcaaataggttcatagatcagtctggtgggcttgttttcacattttatttaagaaaaactcttgtaattacaagttccccagtctgtaaatacagatgagattaaccaaattttgttattttttgactgcctctgctttatagcacccctcccctccaaagacttccccaccaataatttctgggacttcctagagagtgtctcatacttacaaacatacctgcctctactggtcatcccactaggcaagataccaggaccactgctctgccaggcaacagtctatccctcttctctccaggacccagcaacttctgctggtggccatcatgaagtcactgagtaccaccacttacaccagtgccagagttgaactggaattgtgccagttatatgccttttgtttctcagatcctagcctgccttttctatatcctactttttttttttttccgagacagggtttcactcttgttgcccaggctggagtgcaatggtgcgatctcagctcactgcaatgcaacctctgcctcctgggttcaagcaattctgcctcagcctcctagatagttgggattacaggcatgcaccaccacacccagctaattttgtattattagtaaatatagggtttcaccaggttgatcaggctggtctcaaactcttgacctcaggtgatccacccgccttggcctcccaaagtgctgggattacaggcgtgagccaccacacctggcctctatattctactttaaggttcaggagctaggactcaacaaactgcatttcccagacacccttgctagttggcttatcggtaggttctgccaaaatggggcatttagggagaggttggaaggtgggagttagggagaagttccttctcaatgtctctgttcctgtcaggcaacaattggctctagtctaatgtgtcttttcctcactgaatataaatgagtagactgaatgaatgtgcttgttattttgtttgcaacctacactattactttatctcctccctctcctcccaccccgcaaaaccatataaacaacagcaaaagaaaaaaatcctccacaaaacttcttaccatcttacagagaacagctaacagttggtgaccacacaagaattaaaatgtgttgaagtatggtcttatatttgcctggcactctacagagtactttcatgaagatgacctcatgatcttaaacaactctgagaaatggaatatagatgaggaaactgaccctgaggataaatcagatttgtctaatagaaatagaatgtgaaccacccac

SEQ ID NO: 1843 - DNA, 5559 bp, Homo sapiens
ccgtcttggcccttggccctgcccctcctctctagtcttgagtctccacgggcctccggggtttttgttttgtttgttttaataacaaccacttctctagatccgcttgctccctttcttctcttctcggtcccaggaagtaaataccctttcccagctcctctcctcctaacttcccagtccccccagtgccggtcaacctcccttcctcgggaccctctcagaagccgagctctttactcattttcctaggtcttccttctcctcgcggtccctacatcctcccccatccctaatcccttcatcttccctgctttaagaaccacccgcaggcccccatccacgaacgccccttcactagctaccagacgcttcaacccagcctcacctcgcacctccacctcccccgccgtctccacgcccacttcaaagcccacctccaacccgcaggctcttcagcagagccgatgcggcgtcccgcctccttgccttccctcttaggaccaaactcccagctggggcctcggcgtctgaccgccaaagagcgggtgcctggttcctgcggaggctgccgggcgggtgccgaggttgccgagatgcgggaggtttgaacacaaggatgggacagaggcgaggatcggggctcctgggtggcagcggcggtaacctgggctccagggtaacggaggcggaggcctagactgcactacgaagagaccgcagccaatcatgatgactctacccgagctcccattggcttctgtctccagacggccctttttattggcttcagtggaactggaaggcgggacggcgagtgcgggagaaggtctccattggccgaccgctctagctgtagcggagacccccaagtagggaaattggggcaaaacgcggagcgctccaggctcctacgggctgtgcggtgccagggctcgactgctgagcgtcgtgggctccgagagggacgcgggcggagggcaaagtgggttcatgatatgaattgtaaaattggcgactgcgtaatgtaaaacacttaacaattgcttagatttcctttgggaaataacttgcttttaaattgtaaacaaattacaaacaaactgctagtgcttctggatcttcttaccgaaatggctgattcaggaggatgcggggagcgtcagatcaggattgctgaaggagagctgagaatgaaaccaccatttattcagcactcagaatgctccaggcagtgtaatctcattccatcttcattcatgactccagacaggtattgttattcattgtttatacttgagaaagcagattcagagaagttaaagtatctaccacaaggtacgaaagtagtaagtagtaatgccagagtacaagcctaggtctgcttccaaatttcgtggtttcggatttagtgccttcattgtgtttcacctacaggttaagaagttgttggtaagcaagaaaatatttaagacgctgggagaatccaaaaaattgtctagttgtgtgtaacatagtctcaggattcttacagtgtgcaattttattcaccccctcatattcaaaataacagtatcagtttgaccttgaaaaaagaccaaaaaatgtataaatttacagaagtaaaaactagtttattgaattaccattttaaaaggttaccccaaaatatgagaaagcagttttaaaagttttatgacattacatggttttatatattatttttgatagggctagaattttctaagataccatttgacattttatttcagtaccacacaggattctgcttttcagaaataaaggaaacaaagttatcaaaaccacatttatatttctgccacttgaaattatagttaacagaaatcagactcttgtttttaaagattttgtttatgaaacaaattctgcaatggtcattaagcactttggagttttatttttaatatcctgggcttcttccattgatactgcaatatctccagatttgctacattgctaactgaatgttcattttctgtaggactttgattggcttctttattgccatatggcaatgatgtagatgttataatgtaactaaaatattcctacaaatgcttactagtaggattattctcattttcctttggggaaactagtgtcgagtttgaatggttggttagaagtttcaaaaaagtaataggtagataaatagactctctaactgtagacagagaaattacaatgaccataatttgtaaagtggggggacatactatatatagtatcttggaaagcacataagtataattatccttagctaaagttcagtcatctatttcataccattctacaaaagaagaaaagcagtgtcacaattttatataatttacagaaatgtgatacataacaaaaattcaaaaattttttctctaacttcttgatctcatgttgcttggaaattttaaatttattaatagattctaggtaaatagttggttttagcatataacactaaatttgaaacagtatctaatatgctgcatgtttaagagaaatcgaatggattggttgagttgggtgtaaagaacagtataattggccgggtgctgtggctcatgcctgtaatcccagcactttgggaggccaaggtgggtggatcacgaggtcaggagatcaagaccatcctggctaacacagtaaaaccctgtctctaataaaaatacaaaaaaatgagctgggcgtggtggcgggtgcctgtagtcccagctactcgggaggctgaggcaggagaatggcatgaacccgggaggcggaggttgcagtgagccgagatcgcgccactgcactccagcctgggcaacagagcaagattccgtctcaaaaataaataaataaataaataaaataaataaatagtataatttcatacctagaaagtgggctgctctgatgaaaacaaatgtagtctaatctgattgctatgaatacttgattttgcagtacaaaaagctagtagcctttgattattgctctgtttaaaggatacagtttctgatcacttgatgaaatgtacgagtttttttttgttaatggagaaagaaaacttgagatgtttgtaaaaatgtgtatatacttacaacataatgctggtcatcgatagaatgaactactgattaacacggattaattttaaagacaatattgagcaaaagaagtcagacacaaaagaatatattctgtatacttccattaataagtgattcaaaaacaggcaaaattcatctaaactggaaaaaattagaacagttattgactgtggggatggaggtaggatcaagtggaagggactgaaagttatttttggagtgatgtgaatatgctgttttgactgacgtggtagttaaagagagtttccagccgggcatggtggctcatgcctgtaatcccagcactttggtaggccgaagtgggcagatcacttgaggtgaggagtttgagaccagtctggccaacatggtgagacccccatttctactaaaaatacaaaattagccagacgtggtggtgtgtgcctgcagtcccagcttcacgtgaggctgaggcaggagaattgcttgaacctgggaggcaaaggttgcagtgagctgagatcacaccactgcactccagcctgggcggcagagtgagactcagtctcaaaaaaaaagaagtttcctttatcaaaattcattaaaatatataaaatatgtgtgcttttcactgtatgtaaattttacctcaatttctgaatggcttaaaaaaaaagaatgcattggtttgtataacagaaaaatctagtagacctagctccacgtatggttggatccaagtgctcaatgttattaaaattttttcttctctttgtctcttggatgtacttttctacgtgttggtcttatttaaggcaggctttcccttccaggtatggccaccagtgctccagatttacattctatttacctcacaaccccagtggaaaaagaatatctctttcctgattggtccagcagaaatcttggtattaactctgactgcccacacttgaatatgaactattagtaagtactgtggccaagagtttgcttcgggaaagaatatgataaagtcaccttatctttcatgtttgctcagaatagtgaggtgattctccacaggaaaactggaatgctgttactagaagaagaaatactggacaaagctaatagatgtccccaaaagtgatgataataattttattcaaataggttcatagatcagtctggtgggcttgttttcacattttatttaagaaaaactcttgtaattacaagttccccagtctgtaaatacagatgagattaaccaaattttgttattttttgactgcctctgctttatagcacccctcccctccaaagacttccccaccaataatttctgggacttcctagagagtgtctcatacttacaaacatacctgcctctactggtcatcccactaggcaagataccaggaccactgctctgccaggcaacagtctatccctcttctctccaggacccagcaacttctgctggtggccatcatgaagtcactgagtaccaccacttacaccagtgccagagttgaactggaattgtgccagttatatgccttttgtttctcagatcctagcctgccttttctatatcctactttttttttttttccgagacagggtttcactcttgttgcccaggctggagtgcaatggtgcgatctcagctcactgcaatgcaacctctgcctcctgggttcaagcaattctgcctcagcctcctagatagttgggattacaggcatgcaccaccacacccagctaattttgtattattagtaaatatagggtttcaccaggttgatcaggctggtctcaaactcttgacctcaggtgatccacccgccttggcctcccaaagtgctgggattacaggcgtgagccaccacacctggcctctatattctactttaaggttcaggagctaggactcaacaaactgcatttcccagacacccttgctagttggcttatcggtaggttctgccaaaatggggcatttagggagaggttggaaggtgggagttagggagaagttccttctcaatgtctctgttcctgtcaggcaacaattggctctagtctaatgtgtcttttcctcactgaatataaatgagtagactgaatgaatgtgcttgttattttgtttgcaacctacactattactttatctcctccctctcctcccaccccgcaaaaccatataaacaacagcaaaagaaaaaaatcctccacaaaacttcttaccatcttacagagaacagctaacagttggtgaccacacaagaattaaaatgtgttgaagtatggtcttatatttgcctggcactctacagagtactttcatgaagatgacctcatgatcttaaacaactctgagaaatggaatatagatgaggaaactgaccctgaggataaatcagatttgtctaatagaaatagaatgtgaaccacccac

SEQ ID NO: 1844 - DNA, 1850 bp, Homo sapiens
ctctgttagaattaacatgtaaatgtatgggtggattacttataaaggaagttgctaggaagaatcagaaaacataccgtatttacgtggacaaatgtctgtcacaggagcgtcagatcaggattgctgaaggagagctgagaatgaaaccaccatttattcagcactcagaatgctccaggcagtgtaatctcattccatcttcattcatgactccagacaggctttcccttccaggtatggccaccagtgctccagatttacattctatttacctcacaaccccagtggaaaaagaatatctctttcctgattggtccagcagaaatcttggtattaactctgactgcccacacttgaatatgaactattagtaagtactgtggccaagagtttgcttcgggaaagaatatgataaagtcaccttatctttcatgtttgctcagaatagtgaggtgattctccacaggaaaactggaatgctgttactagaagaagaaatactggacaaagctaatagatgtccccaaaagtgatgataataattttattcaaataggttcatagatcagtctggtgggcttgttttcacattttatttaagaaaaactcttgtaattacaagttccccagtctgtaaatacagatgagattaaccaaattttgttattttttgactgcctctgctttatagcacccctcccctccaaagacttccccaccaataatttctgggacttcctagagagtgtctcatacttacaaacatacctgcctctactggtcatcccactaggcaagataccaggaccactgctctgccaggcaacagtctatccctcttctctccaggacccagcaacttctgctggtggccatcatgaagtcactgagtaccaccacttacaccagtgccagagttgaactggaattgtgccagttatatgccttttgtttctcagatcctagcctgccttttctatatcctactttttttttttttccgagacagggtttcactcttgttgcccaggctggagtgcaatggtgcgatctcagctcactgcaatgcaacctctgcctcctgggttcaagcaattctgcctcagcctcctagatagttgggattacaggcatgcaccaccacacccagctaattttgtattattagtaaatatagggtttcaccaggttgatcaggctggtctcaaactcttgacctcaggtgatccacccgccttggcctcccaaagtgctgggattacaggcgtgagccaccacacctggcctctatattctactttaaggttcaggagctaggactcaacaaactgcatttcccagacacccttgctagttggcttatcggtaggttctgccaaaatggggcatttagggagaggttggaaggtgggagttagggagaagttccttctcaatgtctctgttcctgtcaggcaacaattggctctagtctaatgtgtcttttcctcactgaatataaatgagtagactgaatgaatgtgcttgttattttgtttgcaacctacactattactttatctcctccctctcctcccaccccgcaaaaccatataaacaacagcaaaagaaaaaaatcctccacaaaacttcttaccatcttacagagaacagctaacagttggtgaccacacaagaattaaaatgtgttgaagtatggtcttatatttgcctggcactctacagagtactttcatgaagatgacctcatgatcttaaacaactctgagaaatggaatatagatgaggaaactgaccctgaggataaatcagatttgtctaatagaaatagaatgtgaaccacccac

SEQ ID NO: 1845 - DNA, 1417 bp, Homo sapiens
ctattgtttacattttactccatttgctttacatttgtgtagtatatatctattacacataaatctttttttctgaaccatctgagaggaagttgcatacataatgttcttttacccctaaatatctccatgtgtattctctaagaataagggtgttctcttacgtaactagagcatgattatcaacgtcagtacatttgtcattgatgtaacgcctttacttttccttctaattttgtcagtctgctcaatcatgtcctgtatagcatttttgtttcctccagtaaaggatctagtctaatacgaagtattgtatttaattgtcatgtctctttagtctctattcttggaggaacatttccatagtttttctttgtcttttataatattgacatctttaatagaccatttctcatttggggtttgtctaatgtttactcattattagatttgggttatccatgcctggctggaatgttgcatgagtggtgttgagtccttttccagtcatattgcgagacacaaaatatccacctgtctcaccaaccaccgtgcccagttaattacaaaaaaaaatttgcagagacggatggggtctcaccatgttgcccaggctggtctcgtactcctggatttaagcaatccatccacctcatcctcccaaagtgctgggattacaggcgtgagacattgtacctggtctatctgcaggtcttaaagcatattctcacagattccttcatagttgttaatggaaaaagtggtaactatacagtggaaaaatcagagaacacctggaatgaatgagccactgtgccggccttttcaataatttatacacattactatacttatttcagtgctcaaattgtcccagatttgaccagtgggagttcccctcagcctggcttctgtgtccttgtgacatgtcctcttctctatctccaccacctccttcttctcctcctcctgcttccttttagtgctgcttactttctggcatattcaaatgtttcaggttcattttgtgcctactctgccctagccctagaaccagccattcttcctagaagccctgattccttctgtggggaatggcatcagagaccaacatttgagcactaggtatgcttgatgttactggaatgtcttcgcccagctattttttgtatttttttttttatagagatggggtttcgccattttcttcatttctctattaatagctccccacattttttccccacattgctgatgttttttaaaaacctatactggatgctttttgctgctcaattagtttaaatttttttattttaataataatttgaaaaattcaacatcttcttcatagtcacaaattaatttttcttgtcatgagctactcaaattatcatgaattaggcaaagcaattac

SEQ ID NO: 1846 - DNA, 1100 bp, Homo sapiens
ctcatgcgtgtaatcccagcactttgggaggccgaggtgatccaccctataccagctcttttaattacagcaaaacactgagtacaacccaaacgtctgtcagctgtggaacggattcaattggctaggacggggcagacatcttattaattgttccatcaaaactgcccacaacaggggagaggacattctgcaaatagaaattgagtgctattcgagcagggaaatggctagaaagaaacaccactacaacaagactaataccctctacacatcagcttttgtttgtttttattcaattggttcagaatccagaggcaatatgggtatgattacttagtgtggagtcctaattagcgaaaatgagttaggctggtggggctgaggagaaagcaaaacaagaaagcagataagctatgtcggactttcttcacggcctaggacacatggccctcctgagcaaataactcactatcgttttgcacccatcttatcaccagacacctgcaagttagctcactgcaaccttggcactatcagtactgcacaaagctctcctcagcacaagcattattctataaaatccctagcaagtctttgtttctttgcagtcagctcctcttgtgctaattctgcccattgcaaccttgcaacatattttcttactttctctaatgaatctgcctttctttacctacaactgtcttttaaaatttttttactcccatgccactggcccagataattgccattcacccacaacatttaactccctttaactcctgaaaagcaatgcaccctattatgagcttagccgtgagcccagattcacagaaagaaagtgaagataaagcaaaatgggggcttggcagttgagtgttttccagggtacagcatgggactctgtgtggtgaaggacactctgccccttgctctgcggagaggaaaagtcacagtaggcagaaggcagatcagtctccatttgtccctcactacagtctcctgccccacagaaccaggcatggggacagaggaagccaatggaccctccattctcaatctggttcagaacctgcatttaaccaggcccccaccagctc

SEQ ID NO: 1847 - DNA, 546 bp, Homo sapiens
cttggagaacagatagggaaactagaaagaagagtaaggggtcaatactttggaagtgagtaaagcaaaacaaaattaaacaacggaaaaaacacacaaaaattataggtgaaattttgttttatacattatacacagtgctctacataaatataatccttattattgcccctgtaaatatgatcactttcattttctgatgaggagattcatgtgaaagtttaaaaagcctacctaaaataataccgacagaaaagtgctcttgatcccacctattctatgctaccaaactgctctcccaaaaggcagttagaaaaatttcaatgcaagtagtatagtgtagtagaaaaaagtaccatggaattcaattcaaaataattgaattcaaaagcagtttggtagggcagctggagactcaagcgattctgcctcagcctcccgagtagctgggattacaggcacacatcaccatgcctggctgatttttttgtatttttggtagagacgggatttctccgtgttggctgggctggtctcgaactcctg

SEQ ID NO: 1848 - DNA, 248 bp, Homo sapiens
cattcattgataggtaggcattttggttggttccacgattttgcaattgtgaattgtgctgctataaacatgtgtgtgcaagtatgacttcttttcccctgggtagatacccactagtgggattgctggatcaaatggtataagttaataacaccatcattgtagcaagcaaaaagtttgataagatctttgaaaagaagcataaatgctgcatttatgacaccatttgttagttcatttggatgcac

SEQ ID NO: 1849 - DNA, 581 bp, Homo sapiens
atttctccaggacctggtctttggctaccttactttggatcacttggttgaaacagttcccttagtcaacttgtccactggacttaagctgtgggacacagaaattttccctggaagaacagaacaatgaagatgaatagttgaaaaatgagagaatcctgcattctaaaggatctagtctggatgccaggagctgtgtataggatgagagcctggtggacctgattgaccgcctgttgttcagttcagttcagagactgaaaatcaggatttgtgctggagagtctttgaactgtgtgtgaaagtatctgaaggtccatgacaatttgaaaggtttgagcacacaatgaaatgagttgatattgactgttgggaaccagagttctcagtggatgaagagacacagaaaaataaaatgaaggaaggcaaagaagatctctgaagagatggattggaattggaagcattaccttgtggaatttgtataggaaacatcaaccatgttggcatttccaagcagactgaaatgtttgacaactttcacctcagaggattaggacagaggaagattataatggcac

SEQ ID NO: 1850 - DNA, 755 bp, Homo sapiens
tgctgttcttgcaggctatacaagcatgatgacagtacctgctcggcttctggtgagcttttactcatggcagagagcaaagtggaagcagcacttctgcaagtctcagagtctaaaggctgaaaaacctggagtctgatgtccaagggcaggaggagaggaagcaagcatctgacatggaaagaaagtgggagccagaagactcagcaagcaagactacccccatgacttcttccacctaggtcttcctcttccagtccactgacccaaatgtaaatttcctttggcaacatcctcacagacacaccccaaaacaatactttgccagccatctaggaatcctttaatccagtcaggatgacaactaatgttaaccatcacagcattttctaaagccttgtggaatttgtataggaaacatcaaccatgttggcatttccaagcagactgaaatgtttgacaactttcacctcagaggtcagttttccttgttcatgtttggatgctttgacaagtctggtaaatgttctgagtcatatgcagtactttcgagtttctttagttcttatctcagaggcaaatgaactaatttctctgagacattaacttgaataacagcacttaatctggtaaatgaacagcagagaattaagtgtggaggcaggctggtgcaggatgtggaaggtctggtcagcccaagggatcagagcagttggacagggagcaggtggaaaaacaccacagatatgggcagg

SEQ ID NO: 1851 - DNA, 773 bp, Homo sapiens
ggctatacaagcatgatgacagtacctgctcggcttctggcacttctgcaagtctcagagtctaaaggctgaaaaacctggagtctgatgtccaagggcaggaggagaggaagcaagcatctgacatggaaagaaagtgggagccagaagactcagcaagcaagactacccccatgacttcttccacctaggtcttcctcttccagtccactgacccaaatgtaaatttcctttggcaacatcctcacagacacaccccaaaacaatactttgccagccatctaggaatcctttaatccagtcaggatgacaactaatgttaaccatcacagcattttctaaagagaatcctgcattctaaaggatctagtctggatgccaggagctgtgtataggatgagagcctggtggacctgattgaccgcctgttgttcagttcagttcagagactgaaaatcaggatttgtgctggagagtctttgaactgtgtgtgaaagtatctgaaggtccatgacaatttgaaaggtttgagcacacaatgaaatgagttgatattgactgttgggaaccagagttctcagtggatgaagagacacagaaaaataaaatgaaggaaggcaaagaagatctctgaagagatggattggaattggaagcattaccttgtggaatttgtataggaaacatcaaccatgttggcatttccaagcagactgaaatgtttgacaactttcacctcagaggattaggacagaggaagattataatggcac

SEQ ID NO: 1852 - DNA, 660 bp, Homo sapiens
agagaatcctgcattctaaaggatctagtctggatgccaggagctgtgtataggatgagagcctggtggacctgattgaccgcctgttgttcagttcagttcagagactgaaaatcaggatttgtgctggagagtctttgaactgtgtgtgaaagtatctgaaggtccatgacaatttgaaagaaggcatatgaaaaaggtgcaggaatcgaaggcacgagatacacctgaaagtggtggagcaatgaatctgaacaggatgatggattgaaagtgctcaaaagaggcagctaggatcctgtattcatgtcctaccactgcagccagggaaagatcctcccacatctatcagaagactggaggattatgtctggagagattgaattctagggatgctcaggcccaaatgaaggtttgagcacacaatgaaatgagttgatattgactgttgggaaccagagttctcagtggatgaagagacacagaaaaataaaatgaaggaaggcaaagaagatctctgaagagatggattggaattggaagcattaccttgtggaatttgtataggaaacatcaaccatgttggcatttccaagcagactgaaatgtttgacaactttcacctcagaggattaggacagaggaagattataatggcac

SEQ ID NO: 1853 - DNA, 418 bp, Homo sapiens
gtggaatttgtataggaaacatcaaccatgttggcatttccaagcagactgaaatgtttgacaactttcacctcagagggtcttgttatgtcgcccaggctggctggagtgcagtagcatgatcacaactcactatagccttgaacttctgaggtcaaccagtcctaccacctcagcctttcaaagtgtcgggattacagagattgggtctcattatatttcttaagctgctcccaaactcttggactcaagtgatccgccctgaaattacaggcatgaacaaatgtgccagcacacagattctctctgtacaacatggtcactgccagaggatgatggagaggtgatgtccatgattcaagactgtgtttcctaccctcttccattgtatctttcagcaatatgaagttaaaaccag

SEQ ID NO: 1854 - DNA, 2712 bp, Homo sapiens
attaaatccgaggctccaaataaaaatttcagcaaattcccctattatctgttaacaccgaaaaatatcagctgctataaattatttgtgcattattcctggggagaaagcaagcaagccgctgtcatggcagtctctattttctttgaccctaacttatcctctatgatcctgaataaatggtaggtagtacccctgcactaaacttgggaagtacttaaataaatatagtctctttaaaagaactgatcacagatgtctaaaattaaaacgtttgatttattaataaacaaagtatctctcttaaatgggccaagaaacaattctatgacaaaagtgaaccctggaatatagatattcccagaagacaattttccaggatacccagccaaacaattttcacctagtcacaaaagtcattttcatcgaagcctacagtcattcctttttctaattctattctctcatttctttctaaacatgattttaataaagcatatacctgtcaaagacttctctttgcaaaagacataggaacagcagtcaggaagaggactctgaagcccagtcactccacagatccaaagtttatggctgtgtgcccttgtaacttagcctctctgcatctgtttccttgtctgtagtggtactaggttggcgcaaaagtaattgcgggatatttacctcataagagtgttgatggttaaatacaagagtgaataacttaagacatatagaacagtgccaagcatgtactaaatgctcaaaagagtttgagctattatcattccagctttttcatcaaaccaaatggtatcctcctaagcagcccagggattacaatgacaaacctagtcagaggtaaatcaaaggattaaatatgttcaggaatacagagatttgtgaatacagagtaaagatactataatcaatccctagttattatttttcacaatggtacctagttattattatttttatagataaaggggtcttgctatgttgcccaggctggtctcaaactcctgggctcaagcaatcctcctgccttggcctcccaaagtgctaggattactggtgtgagccactgtgcccagcccctagtttttaaaatgatttcacttatgtgtatgaacccaaacattctgaaaatactaaaaatttctatcaatatctgtcttactcattcttcagattatcctttagattttcagtagtgccacataattttataactaaattttattatagcggaataattcaaagagttgtagttttgaaataaattttgctatgattagagaaaatctattcagaaagtacaatatacattaatttatggcacttgtccaaatattaccagcatacaaattattgtttaaggttgtttcttacatatgggatctaatatgcaaagaaaactggaatttgtattcaaaacaaatagaagcaacactggctcctatatactaaaaatataagacagatttttttcttaaacactctggatacaaatactaactgtatggattgagaactttgaagttttcataatgtaagtcacaaagtatacaagtagagctctataaatatatcccctataataatcatatgcaaaaccattctatcacaaacactaccaaaaccctttgaaaaacataaactacaacacattttcaaagaaattattagttataacaactacaaaagcaataaatatcaataaagttatttggctgtcagaaatgaagggcagtataatgtaaaattcaaatactgcaaagttgttttttgaagatgtagtctcgagtttcttcttcttcttttttttaaattttagagacaggatttcaccatgttgcccaggctggtctcaatctcctggcctcaagcaatctgcccgcctcgacctcccaaagtgctgggattacaggagtgaaccaccacgcttggccaagtttcttaatacaagaacaccttgaggattgtaaccctgtgaccatctatacctgccatccattcctgctagcatctttgaaatatgtagcaacaaattgaccaggaagtttgagaagtgaatccttagtaaaggaatagtgatggagaacagagcagctaatctcactgccaagagaagggaagccaaagggagcctcaggtcatcaggtaccaggacattcagggctttaaagtcactgccttcactttgtgggccatttgaagaaatccgcacagaacttgaaaacgagttgtaatagaatcttgcccagcagaagcaagggtctgtcaggtatttttgctcattccctttttgtttttcagggttgtttcctcagcttacatttttccctttcaactcactcactccctggatggtttaattcccctctgggtataccattactcatactagctatgtagaaatgcactttccttggtgctctgctggtctcctcctggacaactgcatctacctcctctccacgtgtctaatgcacatccatcaatttgcccctcactctcttatttcccctattttgtttcatggctttaccattcactcagctgttaacccgagaaacttcagttctctttccccctttctctggagcaccttcttcacctaaacagacattcagtgaggaattaagtctggccatttctgcccacggaatgtttctggaatccttggactttgcaagagccttttat

SEQ ID NO: 1855 - DNA, 283 bp, Homo sapiens
agaacatactttgcctcaaagcttctaagagtgtccgggaggtcttagttccagagggaggaatgttgcaccaggagacacaacaacgattccattgaactggaagttgagacaactgctacctggccactttgggctccacctgcctctaagtcaagagactaagaaaggagttacagtgctggtttgggtgactgacctggactaccaagatgaaatcagactactactccacaatggaggtaaggaagagtatgtttggaatacaggagattcattaggg

SEQ ID NO: 1856 - DNA, 367 bp, Homo sapiens
aatttctgtcagcctagaggtcttagttccacagaaacaaatgcttctaccaggagacacaacaatgatttcattgtgttggatgttaagactgccacctggccattttgggttcctcatgcctttgagtcaacaggcaagaagaaagatgtggtgttggctgggattattaatcctgatgacgaaggggaaattgaactaatcctcctcaataaagggagaaacagaaataatgaaggatgaaaatttggagaggcactgtttttagtaatagtcttacatatgagtaatagccattggcagtggagcaagatggtggaacagaagcttacaacctttatctccctgtaggaacacaaaattctaa

SEQ ID NO: 1857 - DNA, 2062 bp, Homo sapiens
gagggctccaaaactggggataggttatccgtgctctgagtctgagaaggggatttgggggaggcttaaggtagaaacaaaagatctcagttttgccatccaaatcaacccatggccagatcagatttaggatttcttctgaattttgtccttggaggtgtgggaagaatgaatattgaatattcatactcaacatgaatattttggaagctgggcctgaaagttaaggttcactgaaagctaaaaatgagatgaactcagtgaaagtactgtggaaagaggcacctggctggatatttgaatcttcttaaccctgagctctgcttcagtctcatctgttgtgttcatgacatgactctctaatcactatgggcaattgggaaaatggttattttcaaaaagaaattgacttgtctcttcgtagtttaatgtagaagcaggtatagtttggttatggtgaaatctggtaagttggtctttgtgataatacataccttttggtttcagaaaacattgtatacttattttctatatgactaattttccgagcacttttcattctagataatttatcttcatcccctaaaattccagcagaaacaattcttcctatttaagatatcttagcaactggtacccaatttatctaatgtattcccttagcctctaggagaaattaaaaataatctgtggagtactgagtatagtctaatagcagaagggtaccatagcccattgtttctaactatttgcatcatttttggcaggtccaatgacggcatccacagatgaggccaaagcttgaatgcccttggagcctatactgcttttaggccctggcagaaacatggtttttaaatcacattccaaagtgcaattaccaacaatgaataaatacatcataacaatgggggaagcagaaaatgactttagaaagacagagtgatcttttgagacacagtctatataattcctaggaagccctgatagtatcttcttgggaaatctccctgctgcaggaaactgccttcctagattttacctcactgcctctagttgcagttacttcaggtaaacagacctccttttaactgtgactcttcctcagagaaccaaaatatgctttgttttttcttgggccctataggatcctggtttgggataaatctcatatgtctattttccaaagatcattttggtttctctgtatttgtaaatgcacttgattgtaatcacaaaagaaaagacagtgatgcactgtgttggctctgaagaaaaacattgaccagacagaaagtcttccccatagccaaactgagctgtaatgaccgtgcttttcatttctcccaggaaatagtaatataattggtcactgtattacagtaaacagtttgttcattctttgttcagtagaaaatgtttgggagatatgtctcacataatatgctggcttcacgataataaagactgggaatagatttgtttctaaataaatctcaataaatacattggtaaaatgaacacagtaggaagaataaacaatgcaattaggaatatcttaagtacatttacatgtgataatttgcaagtgatcattacattaagacatgtcttgggctgattttctcaagggcatttgtgtgaaaaatgaacatttctgaattagaatttttgtcatggaatagaaacaagaggtaagaacatgttttcgaatatgcagtaaaaagatcacctgctcctctgaagacctaacactgacattcatcttagtacataaaagagaaaatatgctgaggatgggcaatgtaggagtaggaactataacagcaacagctgcagaggtgactgtaattctaatggattgcttgtagtgacatcggcatgcttctgaatttggcgggaaagtaatgcacagaattaagacagcagcattagtgttgtgttttcttattagaaaacctcaacagctcattgaatgcaggaaaattttagagattctattttgcaagaagccaatgtagtggctgcaaaagtaataacaccaaaatggaatgcactaggg

SEQ ID NO: 1858 - DNA, 2145 bp, Homo sapiens
gctgagagagaaactttggtcttccatctgcacacccacactgttcattcttccgtggccctacagcggtgtggaggtgggggtggctgttgagcagcacggcacttccaagttgacggaactgagaggggtgcttcctctctctttctctatgtctctctgtctcactctctttcttgctctcagtggtggtggtggaaactattaaaacagaggcagatcaggaagtttgtgataaagaaaagccaggctctggtctgacatacaatctctctcttggcttaagtaaacttgcttcttcaaggcttgccatcaacagagtccggctcacgtttcaccactaaatctgagtcaacaatctctaatctggacactgggttcggaatccaggctcaggttgcacttggaagctgacagcagggacaagagcagagaaaaatacggcctttgtttctggtttgatcgtccccaccgagctaagctgaggtcatgcgtcgttttctgtcatcaacaagataaaagtttgcacctttctggccctgaaatgtctctcctgccatttatattaaggccaagaagctctctggcccagaatcggagggccaagtttgtggagagcttagatttggagtccttttcatctttctgacatgtgataccgtgacataggcagcccttgcggggttgctatgcagatatacaatttctgaaaagttacacccggaaaacgaaaaccctgggctggattagcatttcacaaagaacagggagaaaatgtgtagcagttaggctaaaaagctaaaaaagaaaaaaaaagtgaattaaagtttcatgaaaatgaactcttttttaaaggatcaataagtataaaagtatcttatttcattcctggccttcggtccgagccctaatccagccactgtgtgcgaaggagatactgtgaggcctgtgatggagattgggaagggaggtcttggtgtggggtgaggttcagtcatgctggggagtgtgaaattaaagggcttaggtacggtcctgctgttttataaaactcttctttttccctctctaccattgttttcattgtttttactttgtaccaagccttctcttttgtttaagtaaacctagaaagaagaataaaaacaaacacatagtctaaaggttctagctaaataagtttcagtttctaccttccttttctttaccaatgtcaaaggcatgccttccagagctcactcactcacaacctagcctttcctaaaaagtgtttttctcaagtatttccaacaccagaaatcattttacatgaaacattaaaatggaatgtgattgtttgcatgagacgtaggagactggaaataatgagaggtttttcctgttatccctgagacctagtgacttccagctgagacccttacatgccgtcctgtgagccagccatgtccacacagctggagaggcggtggcccctcgcctgctgctcaggactccaggacaccccaacagttttaactgcagaaggtctggagggaagcccagagcaggaaataggaaagggggttttgaaggacacagaggacatggagaagattcaaggaactcaactgatactgctccaacggtggatgagaggcacagcagccagggagctagacgccaaacaactccgcctgtccatgcagaaggcaaagatgccttaccctgacccttgcattcaggagctccaaggctggttagaggaaagcagaggaggggaaataagaacagtaaagggccacagagtggatctccttaggcattcttacttattagattctgaagcggcaatgtttgcacagagttctctcatagaggatgggaatttatgggaagtttgttaggttaaaaagagatgggcaattgactttttctgtaactcaagagatgagaatcactgttacgctcctctgtgtcacctccaaggttgatgctctccaagatgaactgacacgtgtgaaagtgaaatgaggtattcaataaactggctctgttctcatgtacacagcacgtagacatccatccatccacaagagaaaggcccaaatgggagtgtgcagtgaagtgtgggctccgagctcacactccccaagtatagttccaggc

SEQ ID NO: 1859 - DNA, 678 bp, Homo sapiens
gtgaggtatagagaaaggcggagtgacttgtctagtggcagttagctcgtgagtagcaggatcaagatgggaacccgggtcttcatgaactctccgaatgcttctttcagcagttactttggaattagaaccgattaaagtgtttgctgccttgatgtggggtgtgagttgtgttccacagacacagagctcggtggattaatggtgtgctggaacgtgtttaactgtgggctctctgaggggaaaaagcgtgattatccataacttctcagaaaatttctgaaaatttagaatcagctcttgtgagctgatagaagcaacctccagcgtgtcactagcagaagatcaatgggatggtgcttagcctggctttactcttctcagtgtatacccaaggccactagactgaggaggccaggacgatggctatttgggtaagaaggcatgggccgaactcatgctgagggatggggtaaatttaagaacaagaattagatcccatgtactaggtaactaaagatatttcggggtgcagtttccaaatactatagaaaatagttttaaatatcagactgtcaagaaaatggaaaggaaacaaggggagaagaagaaagagaaataagaaggagaaaacctgattaaatagtaaacgctttttactaaaaacataatttgctg

SEQ ID NO: 1860 - DNA, 232 bp, Homo sapiens
gcaaggtaagtctggaactgcctactgccagttttcctttctttggtcctaccctctggagggagttatttgaggaaaggcagaatgagatcaacacaaagagagaagcggagatgcaaactgcaggttggagcgcagtcgtgcaatcatggctcactgcagccttgaactcctaggctcaagcgatcctcttgcctcatcctctcgaggagctaggaccacaggtatgcgc

SEQ ID NO: 1861 - DNA, 668 bp, Homo sapiens
tgtggctatattcattattattattatgtatgtgttgcagggtctcctaactcagactgctgaacatgacggtactgaattacaaatttacgaagaaagagaatccaggagataccaagaagctagatgttaacctgcaggattctaaatctgaggaactgtgcttggaacagtgagggaagaggtgtgcaaacagcagaatgtgtcaggctttttcattttacttatggcatatgtcaagggcttccaatctaaaccttcttttaccttatcaagacacagcatccagaaccctaccagcaaaacttctatcccaggaattagacagaaagatttacctttggaggaaactgaatagccaaaagaaagacttacagatattcacatttggagatctccagtgaaaaacatgaccagccaccttatcaccctccagtgaagcccaccaatcaataaaactctgcttatgcactcagaacttctgattagctttttaatgccttattcttacatgtgaatggacaaccaagtatttccaaaggtaaaagacaaagacccaaaataaagacatttttaaaaggaccctggaggaagcaaagaaaaaaataagagagcagaaagggaagaacacactataatatgcttggagagaataagatattgcaccc

SEQ ID NO: 1862 - DNA, 960 bp, Homo sapiens
atttcccacatttgtgaaaaccggaccctgttttcagcaagaggaaactacgctacctaaggctgttgtggccaggcactgtggttcagaggccaagaaggaaggatcacgagaccagaagttcaagaccagcctgggcaacatagcaatagccagtctcttaaaaagaaaaaaggcagctgggagtggtggtgcaggtctgtagtcccagctactcggtaggctgatgtgggaagtttgcttgagcccaggagatggagggtgcagtgaaccatgatcacaccgctacactccagccagggtaacagagcaagaccctctcttaaaacaaagtattcacccttacaacttgtagcacagatactttaaagtcttggtccatgtcaccttgaggttggtgtctgctgtcttttcctttgagatgttaagattttcctggttttgagtatgttgactaatttaggatggcatcctggatattttgacatgttacatcattctaggtcttgatttttaaaaactttcagcagacaatctggtttggtttaggcttcaagtttttactcaatgtttctaggttgtgttatggttccagtgtcaggtttgttatgaactcctttgctatgttatttgcatctgccccacttatttgccacccaatggccaggctggccctggagaggcagtctattgtgtattctagttttcaaagcctctgatgtgctgtttagggtcagatccatgcaaaatggctaaggagtgttcatataaaactttataggtttactttcttcaaccttccataatctctctgacaatgcctgactcacataggggataggggaaggactcttcttcatccactacctataaaaatagggctttggccgggcgcagtggctcacgcctgtaatcccagcactctgggaggcaggaggatcacaaggtcaggagatcaag

SEQ ID NO: 1863 - DNA, 578 bp, Homo sapiens
cagctactcaggaggccgaggcaggagaatcccttgaacccgggaggcagaggctgtagtgagctgaaatggtgccactgcactccagcctgggtgacagagcgagaccttactagtccgctgtgtgggggtctgccttcgagtccctctttcccagagcctccatggaacatctccttgtcaactcagattttaggctttcaaacatggtccccgacatagcatcatttccagtcagtctgccccaaacactgcaactgagattctccagccaagaagactgtgctcacttcctgccattatgattatattatcctttctaaatcatgttgctggcttcctccagcaaactcagaggtcaagtttccaactctcactttcaaactctgactctgtagggttgccaacagtgtctattcttgtgtgtgtgttttcttttcccttttcttttaaacttccctattccacttctttgagctgtacatgaactcagtagtcttccctttttccttttagattctttgaaaaaaaattttttaagggacaaggtcttgctctgtcacccagcctggagtgca

SEQ ID NO: 1864 - DNA, 1028 bp, Homo sapiens
gggaaaaaaggctatttgtgggggtggttactgactgggagtgggaataaggggtcttctggagtgctggaggtattctgtatctttatcttcggggtggattcaggggcatatatgtacataaaaattcatcgggctgcacacttcagatttgttcgttttactgtatgtgtgttatagctcataaagaacaaaaaggtatccacaaaaggaagttatgcttacacacagccatgtctgtctgaacttgttaggtttaaatcaacattagtcggcactgaaagctcatgaagaaaaaactagagtctgcagaggattttcccactgcttctctcctgcttgtgcaatctctgaaggaagtgagggctggaggggctgtgaatttccagaagcaaggcttgtgacattgcctatgtcgggggtcacaggagacaggtgtggtatggacaagaagatggacagcagatccttgtggtgcctgtgtgtttggcatggatttgaaggtgtttgggaaagggaggaaagaagaaaaatgtttgaagaaggaaggacgggaccctcgatttggaaattaaagtattctaggcctggacgctgtgaggagaccagcatgagccaagaggaccacagcagcaaataccaatacccacccacccaccaaaaaccaatatctcatccctccactgggcccacaacagtctcccacctgcagagctgtcaaattcctgccagatcaaggtgtccaaaccaagctgaagaatgacatttcaagtattttctgaaggaagggaagggaaggaggaaggaagggctgtgcagtaagtgactgttctcacagctgtgatcacgagccattgtcattcaagtgcccaccttgtcttgctgtgtactcattgtcttctatcaatcgggccaatccgaagtcagcaatcttgcatatgagtccattccccactagaatgtttgctgatcgcagatctctatggatataattcatgcgctcgatgtaagccattcctgcagccacc

SEQ ID NO: 1865 - DNA, 216 bp, Homo sapiens
aattgcagaaccattttacaccacaagcagtgagtgagacctactatcatttcacatgcttgtcagcatttggtgttgattttacccattctaacagaatctcactccatacctcaggctggagtgcagtggtgtgatccctgctcactgcaaacttgacctgctaggctcaagcaatcttcccacctcagcatcttgaggagctggaactacagg

SEQ ID NO: 1866 - DNA, 838 bp, Homo sapiens
aaaaacatagagcaaggagaatgaaaagtagagaaggaaggatgaaaagaaggaaagatcatggatagcaccagggttattatggtccaaaggagccaggcatggaacagccaaatataattcaaaaaaagaaaaacatccattcatgagagttcagggatacgtgaaaatgaagcaaatgaggaaagacccattcacattcctccaaaagatctgtggctcactggaatcatgttactggctcctggtagtccctgactttacctgtttgttccaggaacttgctttatggccatttgttctaatgatcagtttggacaaccaacctttattcctccacctcagacaatattcaacatcctgtaatcatcatagcgctttctgtatgagctggcttcagggtgagtgattattcagagcaagaaaaggataaaatcgttagcatttgaatttctggggagacatttgtacatcatcaaaagccatgattctggcataaacaagaggttagtctgaatagttaggcagattgttgtgcctttgggaataaagataaatcagttgacctagggtgggagtgaagttgagagaagagaagaataaaattggttattgtgagttcctgggaaaggaaaatacacctggcttgtctttggggttgaagccctttgtgttagcggggcaatagaaatgtgaaacaagtttggggttctccaagaagagggatctataccttcctctccaggttgcaatcaggagaaattacaggtctctctgaaaaaccctcggtgtagcatggggtcaggacaggagtatggccctagttgacagagatgtg

SEQ ID NO: 1867 - DNA, 345 bp, Homo sapiens
ctcctgagtagctgagattacacacatgccaccaggcccaggtcaggagatatgtccatgaagtggagccaacaggaagaactggaaggagttatctaggccaaaagatcgggggtggaggccacatagcatcattaaagatgctgaataacaaggtgcagtatatcagatgaaaggagagataatcaaggttactggattacagcaaactaacaatgtgacagtgggtgagactggaaaggaaatcagggaccagatgatagaaggcctttcttggatgccttactaatgatattggactgtatacaaagggcaatgggaagtcattggagggatttagcaggg

SEQ ID NO: 1868 - DNA, 651 bp, Homo sapiens
ggaacaccagcaactaggcttatactactcagctagagagattgctgtattatggattggaatccaacaacctcaaaagaaaaagttcagaatatgaaaactttgagatccataactgccaagcctctatgcgatcagcctagagtaaagctttgagttgggcaagcactgtttctacaaccagaacatccaagcaaaattttagtgccactgtctcaaagatgaatggacaagtatcgctagcaatttgaggaaggttttcaacatgaaatatggatacaaacatacaaaaaactaaaacgaattcacaggcagaagaatccacagaaaaaaacaactaacaacaatctagctgggagccaaaagacactgtcgatagaaactgaagattgtagaacctgcctgcaatgagggcgtgatagggaagtggatcacgttcctacctgcctaggacaaggagctggtacagggactctgcaccccgcccccatccctcaacccccatcaggaggcctgcattattgttgtcgagttcaaaatcatctttcaaaatcaagaattgacatcagttcattacccacgggtgagtacacacatacacacacatgcacacacacaccatatttacacataggtgctgagaatctgttc

SEQ ID NO: 1869 - DNA, 1706 bp, Homo sapiens
ggttaacaggcatgagccactgcacccagcctacctctactctttattaggacacttagtctccctgtcaatgcccaggagttggaacaaataacagctttactataaactgagttagttactagatttttgagtttctatcctctctaagattctggaccctgaaagatcccagagttgatgcatgccaagaccaaatcacactgttcagggtgatcctccttactctcctgatatactttggactgggcattatttggctaaaaggagtatctgtggcagcttttataaacaacaaaagcatgaccagcaagaaaagcagttcatggaaggcagaggctgggagtgagagattcacttagctgcagtacttatattaatcattactagtatatgctaagtatctgacattgtgataagtgcattttatgtgacctttaatcttcataaccattttatgtcctaggaattattatatcaattttgtagatgaagaaatggaaattcacaaagcttaagcaacttgaggtgtttaatagtgagtaatatggaggtgggatttgaacctatatctgactgatgagatctgtgcttctgaccgttttactctactatcaatagcaattggctttcatctcctctagacagcaaattttcaggtggaagtctcactctaccactctcataaccaatgcaacaaataatcaagttctcaagctgcaaggaaaactgaggggattatttttaaggatgtaaagaacattaaacaatgaagagatagtttctcagagtaagttttttccctcctttgccaggtgcctgatatcatctttcttgtctaccttagacaccccccacactttttaatattaaaagtctcttaataacaaaagtaaacagcatgttatttatggaaactgcacaacattagctttgctaattacatggttactcactttcccagcaccagatcacctcttatttgtttccaactactgtggccaccatgtgttttaagtgtaagacagaaataataaactgcaggtttccagggtactcacgtattatttctgcagttcacacaggacatgtaccatctgggtttgaagggcacatcattccaaggcggaatggagtgagtagggctttcccagtagagccactgactctatggggaaatttcaaatggagttttggggtcagagagacctaagttcagatgcctggcacaataacttcccacttacatgaaatcttctttgccttctctgtaagtaacttctctgcctcttggcttactgtatataaattgggtatatgatgcctaatttctagtgtggctctgaatcttaaatgaggtgatacaatatggcacttgccgtaaggtaagttattactgaatgatggtcttagtttctttctactccatttctgtctcttctaaactcctaagaactaagctgagaaggcataaaagatgacacacagaccattcagctcaaaatccagaataagaagcccaaactggagtatattctgcagaagatttgctgtcttaagggagctactattagctcagctttaaccctccttcccatctctttctggttagtgaactggtgccaccacctgcccattagagaacctgagctatttgttcagtgattcacgtctctggattcagcactgagcctgcataaactccc

SEQ ID NO: 1870 - DNA, 540 bp, Homo sapiens
agggaaaagaaaccaagtctccttgaatcagtttatcccaatgtcttctggttttctatgttggctacagtcaagataacctattactaagggcctactccaatatctagagatggcagatattcagttgcagttcaaaccaatgaagtcagaatctctggaggtgggacaaagctcttaggtggcactagaagaggaccacaagcctgccagagggaggagagtattgcttcttcctgttcccattagtgtcacctcagcagtgacttttcaccctggagtggcagaggaaaagacagtgagagagcaagagcagattgagaagcagaagagtgagtcgcaaaaagagaaaatgacagaaatggagcaccctggtgagtcccaaccacatccattcttgatgataacaaccaaagctcagaaaatgatttcttacagaatgttgtatcaaaaggagcatattgtatgtgcaaagttgctgcagctttcctaagttggcttcaaactatccaactatgatgttaacatattaccttcagc

SEQ ID NO: 1871 - DNA, 673 bp, Homo sapiens
taggatctgtgcagatctctggctgattgctttatgcctggttctggagcctttgccagtgcattctaagaagaacaagggaagaccagcaagccacagcagaagaaactcagaaggaaatgtaaccttccacaggcccacacatgtgttatcagccataccttaggacagaaggaatgagtttgcagaaaggatgctcttcagaactcatgaagacataaggtgcttcaaaagaggagactttcggaacatgagcagggaaattgtcacttgatagatgacaagcattgtgagaaacaacagtttgcctttcttcattcccttcctggttatctttcctgtcacatgaagaagaaatgaaacaccagagagaatcaggttatcatcatctacaccagccactgtcactggccttcaaagttcaacctccctggaactccagaactccccactttataagatgaatggctaattggatcctagtacataaggaaacactggcaaaatagcggtatataacaaatgtttctttttatgatagatctacatctgaaacaacggtgaaaaagcatgcattaaattaaaaagcatagtcttccatttgtaagtaattttgttatgtgctgcttatgggagattgtttagttaaagctatattactgcaaaagagagg

SEQ ID NO: 1872 - DNA, 355 bp, Homo sapiens
tagagaaggttctgcctggctgttttcttctcttcccgggaaatatggccagattattgctgacctatctggaggcaacaggaacatggtaatctgttcttattctaatggatcttccataacgtttcccacaaagaattactaaccattcatgaccttcatcaaataacgccaatccgtagtgatgggagatccactgaagtcatctcatgatgtgtgttgtcgggctatttaaaggctgctgtttcacttccaaacttcactcccttctgacgtcttcagtgctgttcacttggcaaccttggctactcttcagcagataatttgtactctacataagcatttagaagaaccc

SEQ ID NO: 1873 - DNA, 393 bp, Homo sapiens
agtagagacagggtttcaccgtgatagccaggatggtctcgatctcctgaccttgtgatccgcctgcctcggcctcccaaagtgctgggattacaggcgtcagccaccacacccggccagaagactaataagtttaagcctaaaaaaatgtaagcctcaggagacctcattggtaccaaccagaaatacagatcctgagctgtgctgctggaatgggctctgatggaaacctggctggtggtggatgggtccctcatgagcatggagaaggcaatgaagcaactggaagtgcagagaactgagaaggagcgagcttttgcctgcagatttcgatgggcatttttgactgtgctacaagaagtacacacccagttcctgaaggatgcagtgcag

SEQ ID NO: 1874 - DNA, 322 bp, Homo sapiens
gctcttcagccatgtgaggacacctagatgatgtcatttatgaggaaagggccttcatcagactctggtcctgctggtgccttgatcttggacttcctactctccagaactgcacatcattaaaatatcaactttggcagagacgtggagcaagatgactgcatagaagtttctactgatcatttcccaccgcttccacgggaacaccaagtttgatatccacacaaagggagcaccttcaaaggaagcaaaaatcaggtgagcactgacagtgcctggttttgaattaatatttctgaaagaggcactgaagagggtaggc

SEQ ID NO: 1875 - DNA, 396 bp, Homo sapiens
gtggagctttttattccaccatcttgctccacctcccactctgggtccatccaatcatacaattacttttactttctgacagcatctaatccagagccatcctccactttaaatcctcatttttcaagcctcagatgaatcatctcttctgcccaagaatgctgacttggtttatgtatctatctctttcccacaccatctatgcctcagagaaatcttcacaaactcagcttcaaggatgggtcagagccttggaaactgcatctgcctggctgtcattttctgcaagtgctggtgtaatttcaagatttgcttgccaaatgcattatagcatactggacaaaaacaaggactgctgggatgaaattgagattatgaagctcttgaggtaagaac

SEQ ID NO: 1876 - DNA, 711 bp, Homo sapiens
ggcctcccaaagttctgggattacaggtatgagccacaacacccagcctttaacgtgcctttctgactcatctccttctctccgtcttgcctatcccaccacccactgcaccgtggtctcgggctcactgtgccaccaacaagtcttcctcttggcgccagcttcttctgctcctctgagcttctcctgctcctctctgcctcatctcccaaagccccttcctctttggcctcttccaggtcattctctctgactctcatctgcactgtcctctccctttctggggtcatcagccacaccaaggtcttggtcagttaactcagcgtgaccttgtctgcctctccaattatatcataaacaacctgtggaccgcaccttggggggccttcctaagtgctccccatgtctttccgcatggctcctgaaggggtccagggtctcgtgttgtcatgtgcctgtgcttctgcccactcctcgggtgctcacaagggtagggctgcctgggtgacagtacggcctcctgcagctgcgggagagggagtccagaggtggcaggagagggagtccagaggtggcaggagagggaggcagccatggagggtgacacccactgatgcatttctcagtccagtgaatgcagtcactttggatttgtgagaattgggaccagtgttactgccactatctacagaggcctcacaaggttgtctg

SEQ ID NO: 1877 - DNA, 642 bp, Homo sapiens
gtccatttaaaaataaattgataaaagaaaccctcacaaaggttcagtattagatgtgcttataccttcattaactcacataagtcttataatgccttagacatctcgtaattgcttattgagactttctctttacagaactttattgaaaaggttctttccatctcttcactctcactcccacccccccgtatgaattctttttagttggtaatagggctttttaaggaagatcatataccagtgttagaggatttatggacatttgccttcagaactgcatgaggctgtcattactaaccttgtgtgctttttcacagatccctgacatctatgagacagctttgttcatctcaggaacctttcaaaaatacatgctgtgatgaaggaccagccagcattgttatacgtacatcctgtcatcagcacagtgtaaaagcttatttcacatggacttctcttaggtctgtctggaagcaaattatttgctgattgtagcgccatcctattctgtactcaaagctacctattttaggactttgagctatctgagtaagtagactctctaagctaatacaaacattatccatttaccttaagtaaatttttagtgttttaattatctttatttaaaaaataaac

SEQ ID NO: 1878 - DNA, 616 bp, Homo sapiens
ggggaataataaattaaaatttctcaaatacagttaattaagataggcaaaggaatcagttcattattcaaacttgtcccatcatacttgaacttgctttcctctagccataaccacagtaggagttacttttcagtctagaattttaatccgtccaaatcaccaaacccactgaaaaataaagtgcaacaaacactgtgtgagccgctgcaatgtttgaaatcacacttctttctcagtcaccttctcacttagttccttctttaaactggagaatatttttgtggtttaatctgcgcaaatttttttttcttctttttgcagactttctttacccgtgcagaccatatggaaaactggccattagtgatgtatttttctccccgggctcctgagcccactggtgtcaagttgctccatctgattcttaaattaattttcatcagttgtaaaactctcaagtgtgcacaagaatgagcctgtcttcccgtgtgaatgtatactcagcttgacccaggactaaacgagaaagaaaaattaactagggttagcgagaaaaggttccagaagcaaaaagcataaattcaaagtacttaaaaatgaacatgcactgttg

SEQ ID NO: 1879 - DNA, 528 bp, Homo sapiens
cagaaagagaagcagcccagatgagagaaaaggtgctttaactttgattgctgcagattttcttggcgtttaagtgctgatgaagcaggtcagtcaaaactgaagatcagcttttgatcatgaagaggagattaggtcacagatgttcaataaggaaagaccatgtgaagacacaagaagatggtcatctgcaagccaagagaaatgtctcaaaaggaactggccctgctgacatcttgaccttgaatttccagcctcaggttcttggatgcttgatggaattaaggatttgagaacatgagaacaaacaggaatatgcaggaaatcttgaggacacaggagatgaagtcaacctgtggccaagggagagggagggacatgagaagctttgtgaaagatgtcagcgcaaacctcaggtttctgtatccagtgaaaatatcatttaaaagataaacatgaaataaacgtttccagctggactacactatgtaaaaatgaagttatttgggatgaaaaataatgacacca

SEQ ID NO: 1880 - DNA, 1642 bp, Homo sapiens
ccatcctgtgagctagggcagagacccagaaatatgacccagaaaatacaagtttattctagaaagcttagaaaatacaaataagtaaaaagaaaaacaaagcaatatactaaccaagacaaccactgttaaccttttcttcaacattctttttgacctttcctacacactccgcatcactctctctcacgcatccaccacgaccatgctcaagccactgtgatctcttgcaggatttatctggaaactctctttccatttgtgtataaatgaatctcactggctgccacagctatttcttggaggaataaaagcaaacgcttggacactgaggagtggattgcccatctgccttctatcattaaaggacacggcaacgcgaccctcgccaaatgctgttgcctggatcttggactccctggcctccgtaatggaatgctgggaaacgaggagaaacactatgcttttcacagcatcacagacggtactggacccttcctatcaatgggaccatttcagggctgccacttggccagggcatcgcagtgggctgttggatcagaccgagaggcaccaattcaaacgcccccggcaagaacctatgtcaggtggatgggatggttataaacggcagagctatgcctgctatcaaggattagaatgaaaatatctgagcagcctcagcagacagtagctggtggcacctcaggagaccggaaaagccctacctgccaggacccctagacccagcccttgcctgtcttgaaacagcaaagggagtgatcttggggacaccagaacagtctgcttgcagagattaggaacaggacagcttattccagtcaaacagcgagactaaaagtgagtctaaggctccagcctctccagattcctcctggcccacgcatgaacatggtctccgtggccatcgattcttctgagcccacctcctccacgtgagtacacacgcttgtctacctatggtctgtgaaagtgcacagactttgggtcaaacagatttgagtgtagagtctggcttagaattccagacccagctcttcttcactgtgtgatttggggcaaaataacctggcctctggaagcctgagtttttcatctgtaaaatgaaagcagcactatttttcactacgatgtgccagcacaccacccatctagaccctaaacaaggtggaccccagctggctccctggtgaccagctccaaaatgccttcctttggacttcacgttctgtgagagaacgcaaaccctgacatctggtttcatccagttccttagcttttcagtgacaggcagctgaactcaattgttaattgactgatctccattgcatagggttactgtgaagcgcatatgagatcacagctgttaaagtgccaaaccacgtgacttatttaggactcctgactttcctaatgttgcatggaggatatttaatcataaaacagttaaatctggcatagtgggctaccaagaagaaggcagggttccgcttaccatactgagagagggattgaggcagaaactccctggaactatgggcagcaacaaaggagggagggcaggtcacctgtgcagaagaacatgcacacacacaggcatgcacacatatttgtacacggg

SEQ ID NO: 1881 - DNA, 4400 bp, Homo sapiens
cagcagggtcaggctctggggagggctctctccttgggttgcagatggctgccttcttgctgtgtcctcacttggcctttccttggtgtgtgcatgtggaatgagaaacacttctcttcctcttcttgtaaggccacctatcctattggctcccggcgctattcttttgacctcatttaactttacctcctaaaagccctatctccaaacatggtcacaccgggattaggccttcaacatgtgaattctggggtgcattcagtttatagcaggccacctgggaaggttttatgagtcaggcttggaagcagtataaacgctttggcccatattccactgacggtacctcagtcccattgcacccaactgcaagggggctgagaagtgcagtccagctgtgccctgggagagtgaggtgagtttggggaacagctttgtcagctttgtcattccacagtgcctgcgagtctctggtttcaccgagagggagagggcatttacgttaaatttcagccttggcaattgtggtatctcataataggcataaggtagataaaggtggatgtcttagttatctactgatgcatgacaaatcaccccccaaattaaatggtttaatcaataaccagttatcctctaacacagtctgtaagtgtagctttgctgggtagttcgggctcagggtctcttaggacactgtcatgaagctggggctgaagtcgtctgaaggcttgaccttgaccttgacctggttggaagatctgcttctaaaatggctgaatcccatgcctggccagttggtattggctgctgggtgggggtttcagcttctcaccacaaggactctccatagtgctgcttgagtggcagctgggttcccccagagcaagtgacccaagaaagtgagcagggtacacatgctttcttatgacaagtgacacctcttcattgcttcatgttcgatttgtatgaagtgagttgtgaagcactgccacgcttaaggggaaaggaattagactgccttttgaagggaagaatatcaaagaatttgtggacatatttaaaaatcattgtgatgggtgtgtctaaacttaacccataaaacttgacccccaagccaccttataaatattacttggtgatcttaattttgttggtaggtttgtaatgcaatataacctagtcacataccagctgtgggaatttgggctaattcctgagcagttttgtcatctgttgattagggaagacttgtggcagccccactcccaaccccaggggacacctcgtgtctctagtgtgcacaaaggtctggatagtagcagaatctacctcatagcagctgggtgaagactaaaggcagtaagagaagctggcacgtagcatagcatggacttccccactgtgagctgtttttgttactaatggctgcgcctgtgcctgggatctcgctatctctgagctctgttcgttttgcaaagacccatggctgctccgctttcctccttttctccaacttcaggccttaagaatgaaaaagcggtggagtaagagttcgattaactggacttatacgccccttggagattgatggttctgccactcaaacaaaatggttctgtggaaattagcgaggatgtgcgaagttttgacatggccacagtgtggctctgcctgaattttccatctgcactttgttttcgtccttcttttgtgctggggttgctggtttggagttttctgggcagcataccctccatggaggttcagtgtctgaaggaaggaaggccaagcagcttggatgtcacctgctgagcctgaagaagaacttgagtgaaaataatcccactctcctttgttcttctctgtttgctttttgtttgcctgacagatgttcagcctggtccataggcaccgactggcttctcaaagcctcctgagtgagtctcggcttattgatttctgcacatccgtgtttttgtcattgttacttatgatgcctgagatccccagcacctccggccttcccttggaacccctcactctctcctggtacaccccaaacatggggccaacaccaggaagcttggaaagcataactgcagatagtttgggacagcccttatttggaggatctttcctcatgactttaccagatgctataatactagtgctcctatttctgatgtagaagatattatcattcttctagaggactcttctttctctgtggttcttattattctttctggtgtgctcagatgttcacattaataaaaattaggagtaaagtctgaagctagagtggaacagaaaacctggaattagagtctaggttcttgctttgttcagtctatttagcaaaacctcccaatctgtgtctcttgctttgttcagtctatttagcaaaaccccccagtcatgttgtaacttctaagaatttgcaacttaaccaaacagaattaggaactcagagtactgtattatcttaggttgagattaaaattatattgatatcatgtcaataatgatatccatcctgtgagctagggcagagacccagaaatatgacccagaaaatacaagtttattctagaaagcttagaaaatacaaataagtaaaaagaaaaacaaagcaatatactaaccaagacaaccactgttaaccttttcttcaacattctttttgacctttcctacacactccgcatcactctctctcacgcatccaccacgaccatgctcaagccactgtgatctcttgcaggatttatctggaaactctctttccatttgtgtataaatgaatctcactggctgccacagctatttcttggaggaataaaagcaaacgcttggacactgaggagtggattgcccatctgccttctatcattaaaggacacggcaacgcgaccctcgccaaatgctgttgcctggatcttggactccctggcctccgtaatggtgttgtgtggggtgctggatcgtcagggcagaggaagagcgagatgaggggaaacactcagagttccacacagctgctgtaaccagatacctcagccacaattttgtgattgataaaggatgaaagaagatgaaagaagaacctggaagaaaaggaattaccaacagtcagctttcagaaatcagtagaaagttttcagaaacaatgtttgatgcttactctggaatgctgggaaacgaggagaaacactatgcttttcacagcatcacagacggtactggacccttcctatcaatgggaccatttcagggctgccacttggccagggcatcgcagtgggctgttggatcagaccgagaggcaccaattcaaacgcccccggcaagaacctatgtcaggtggatgggatggttataaacggcagagctatgcctgctatcaaggattagaatgaaaatatctgagcagcctcagcagacagtagctggtggcacctcaggagaccggaaaagccctacctgccaggacccctagacccagcccttgcctgtcttgaaacagcaaagggagtgatcttggggacaccagaacagtctgcttgcagagattaggaacaggacagcttattccagtcaaacagcgagactaaaagtgagtctaaggctccagcctctccagattcctcctggcccacgcatgaacatggtctccgtggccatcgattcttctgagcccacctcctccacgtgagtacacacgcttgtctacctatggtctgtgaaagtgcacagactttgggtcaaacagatttgagtgtagagtctggcttagaattccagacccagctcttcttcactgtgtgatttggggcaaaataacctggcctctggaagcctgagtttttcatctgtaaaatgaaagcagcactatttttcactacgatgtgccagcacaccacccatctagaccctaaacaaggtggaccccagctggctccctggtgaccagctccaaaatgccttcctttggacttcacgttctgtgagagaacgcaaaccctgacatctggtttcatccagttccttagcttttcagtgacaggcagctgaactcaattgttaattgactgatctccattgcatagggttactgtgaagcgcatatgagatcacagctgttaaagtgccaaaccacgtgacttatttaggactcctgactttcctaatgttgcatggaggatatttaatcataaaacagttaaatctggcatagtgggctaccaagaagaaggcagggttccgcttaccatactgagagagggattgaggcagaaactccctggaactatgggcagcaacaaaggagggagggcaggtcacctgtgcagaagaacatgcacacacacaggcatgcacacatatttgtacacggg

SEQ ID NO: 1882 - DNA, 2074 bp, Homo sapiens
cttgtggcagccccactcccaaccccaggggacacctcgtgtctctagtgtgcacaaaggtctggatagtagcagaatctacctcatagcagctgggtgaagactaaaggcagtaagagaagctggcacgtagcatagcatggacttccccactgtgagctgtttttgttactaatggctgcgcctgtgcctgggatctcgctatctctgagctctgttcgttttgcaaagacccatggctgctccgctttcctccttttctccaacttcaggccttaagaatgaaaaagcggtggagtaagagttcgattaactggacttatacgccccttggagattgatggttctgccactcaaacaaaatggttctgtggaaattagcgaggatgtgcgaagttttgacatggccacagtgtggctctgcctgaattttccatctgcactttgttttcgtccttcttttgtgctggggttgctggtttggagttttctgggcagcataccctccatggaggttcagtgtctgaaggaaggaaggccaagcagcttggatgtcacctgctgagcctgaagaagaacttgagtgaaaataatcccactctcctttgttcttctctgtttgctttttgtttgcctgacagatgttcagcctggtccataggcaccgactggcttctcaaagcctcctgagtgagtctcggcttattgatttctgcacatccgtgtttttgtcattgttacttatgatgcctgagatccccagcacctccggccttcccttggaacccctcactctctcctggtacaccccaaacatggggccaacaccaggaagcttggaaagcataactgcagatagtttgggacagcccttatttggaggatctttcctcatgactttaccagatgctataatactagtgctcctatttctgatgtagaagatattatcattcttctagaggactcttctttctctgtggttcttattattctttctggtgtgctcagatgttcacattaataaaaattaggagtaaagtctgaagctagagtggaacagaaaacctggaattagagtctaggttcttgctttgttcagtctatttagcaaaacctcccaatctgtgtctcttgctttgttcagtctatttagcaaaaccccccagtcatgttgtaacttctaagaatttgcaacttaaccaaacagaattaggaactcagagtactgtattatcttaggttgagattaaaattatattgatatcatgtcaataatgatatccatcctgtgagctagggcagagacccagaaatatgacccagaaaatacaagtttattctagaaagcttagaaaatacaaataagtaaaaagaaaaacaaagcaatatactaaccaagacaaccactgttaaccttttcttcaacattctttttgacctttcctacacactccgcatcactctctctcacgcatccaccacgaccatgctcaagccactgtgatctcttgcaggatttatctggaaactctctttccatttgtgtataaatgaatctcactggctgccacagctatttcttggaggaataaaagcaaacgcttggacactgaggagtggattgcccatctgccttctatcattaaaggacacggcaacgcgaccctcgccaaatgctgttgcctggatcttggactccctggcctccgtaatggtaagaaaatgaatttctgttcattgtaaattatccagtctcagatattctgttacagcaacacaaactagactgagaaatgtagttttagccccagcattacagaacagaatatagacaatgagtcgagagactaaggtaaacagtaggcacagtcctcctactcgcttccattgatttcctttacccgtgtttgaactgccacacaaaacaactcatgcttattcccaataagacgcagccataatttgtaccaatgacattgctcagccagaaaggcgagatgacagttccattagttgctgcacccatctcagtgtgacgtaaagtcccacttgagtccaagcaaaatcccac

SEQ ID NO: 1883 - DNA, 303 bp, Homo sapiens
ctcgccgcgaggcgccttccggtggcgcggcggggtcggttgcctcctcgcgacggctgcgccgggatgttccggggcggtggggtcgcctgcccaatgtcgggtgcgcgagtgacgggtggaagctggatttgtgcgcgttcttcaatgctccaaagggaggagggagcctccgagagtccacgtggggccggtgggattcgcagggcaggagtgcagatgtgatctcggcacaccgcaacctctgcctcttggattcaagcaattctcctgcctcagcctcccaagtggctgggattacag

SEQ ID NO: 1884 - DNA, 486 bp, Homo sapiens
gtataaattaagtataaattgtgcttttatttattccagtcatctcatgatcagatatgttgccatttataggatgtttgtattcctgcttttctccaatatactaaatattgttgtgggatcacatgatcaaatgaagattatgacagaagaatctaactgtattacaaatgtgtgaaacagccttgttgaaaggagtcggggtaaagtgctgacctaattaaccttggaaataagatgtgcaagaataaggttaacagacctcaacgcaagcactgtgctgtagttgataaagctgtacatagtggcttccttttaaagagtataacgtggaaagattgaaaaagagtaactttacagtggagaaaatggacaacgatgttgcagccaggcaatccacggtaatatcagcagtgacaaggtatgctgacaggatgcactctccttggtatttaaggaaagattgttatccacccaaaagcccat

SEQ ID NO: 1885 - DNA, 635 bp, Homo sapiens
ccaggtaaatgttggtaataaacacacattaaggacagtgtttctgccctgccattgaaggtattactcagctagaatattctctgcctacatagatcaaattcataaggaattcatgggatccaggatggaatgcagactgtaataaaaaatctaatcacatcacaattaagaacacaatctccctgaagaggtgagctaaaatataagtgaggagtgtgcaaggatgctgaatgtttgggaatgagaggataaatgagtgatgcttgaaaacagaccacattgaaaatcctgccacggcagcagctgcagccaccaacagcagtggtgttagtgacctaagtaagcaccgacttcgtagaaaccagaacatcagccatcttggaaaagagaaaaacaatggagttacttatttaagaaaaacaaaaaacaaacaaacaaacaaaaaacacaactatttcttcccaggagaggctagaagtagcttttctgccttctggccggagccaattggaatgactggtttgggagaggaggaggggttgtgtcagctgtggtgctttgttgtaaaaggcagcctgacctttgctactgaggagaaagatggagccgagtctcaagcccaccttctctgt

SEQ ID NO: 1886 - DNA, 641 bp, Homo sapiens
ggtacaagctttgagctgaaaaggcaaaaaagaatgagtcacgtgctgaatcaggtagccgagggactggttaggaactcagttgttcctgccatgtgttagcagccttatttgtaaagacagtgtgttgttgaggtgtgacccagagagtacatggctcgttctcaagagagagtgtaggctattaagggggtggggcagcagccagggggatgcttctttcagagaacctaatgtggtattcaaatgtgtatgcatttgtctgaagagaagatccacagtttctcaagtagtctcttaccccaaagcaggaaggtgaagacggaaagcctatgtggcctagcgtatccagctgagcctctgtccccagccatctcatctgccattactgccctgccttcactttccagggtggctcctgggacccaggcagctccgcaaatggatggaaattcctctccaggagcagggtcgctgtgaaaacaaagcacacccaagtctcatgactgcgatgcacatctcacgacgtcggacagcaactcctgctttttatacctaatcgtcatcagttctttcatggatattcccagctgcatagtcagtcatggaactcagaaataaacatcaagttacaagccacc

SEQ ID NO: 1887 - DNA, 287 bp, Homo sapiens
atccctgtgtgtcctttgtatgcatgtttggtacactgagttctgtggtcactgtcctctcttcagcagggtttttttaccccagtacgattgtccatctctgtattaccaagtctcacaaaactcagatttctggctgagtatgcctgcgtctttgtttctccagagacagattttcatatcctcttggtttttcaagcatcttgtcaagacaagaaaacctataaaacaggaagtgttagattctaattaagtctatcttttattagagctaaccacatactcag

SEQ ID NO: 1888 - DNA, 649 bp, Homo sapiens
gtgaacagaaggagaaggacatgtttattactcggattttattatactatgtattgcaaatagctttgcccaagttgggaagggaacacggcaggtcttgatgctgctgctaacctagttgttactttgtctctagattcctgggtatggcatctccataccaatctgaaaacataagagagctcgaagaaaagcatagactcagatgcaataatcacttgggttctctgagtgaacagccttgggtagccaccatccagagcagtggagacatcaccagtcccagaagtccctgatgtcccttccagtcacgactctgtcccctcgcctaggtaatcaatcactagcctgcctcctcttctaacatctttaaatacttttgactttttttttcaatttttttttaattttgaaaatttcaaattaggttaactgaaataacagtacaatgaacactcatattttccttacccagattcactgattgctaacattttgccgtattttcttatttctctgaaccattctaaagttgtaaacatcatgttttcccccaaatgctttatcagttatcaccttaaaacaaagacgttctcctgtataaccccaataccattatcaccctcataaaattaatcattgatgaagc

SEQ ID NO: 1889 - DNA, 818 bp, Homo sapiens
cgccactgcacttcaacctgggcaatgaagtgagactctgtctcaaaacaaacaaaaagaaaccaaacaaatatcttttcccagtttgtcaactgtcttttgattttgtttatttcttttcttttttaaactctgcccggttttgcctttcccatagaaaccccaataaaagtgatggtctaggctttaccctcagtcctgcttctgcctgaccaaactgtctttctcctgtggctctgtgtgatgtgacttgtcctcttctccaagaaattattactcataaattcttctttagcggcactgatctatctgtgtcatcactcagtcaactgcatacattaagacctaggcacagaacaactctgtttctatttctataaaattctagaaaatgcaaactaaaccataatgacaaaaagaatattagtggtttcctagggatgggatgtgggcaaagagagatgaaggaaggagggattaccaaggagcacagggaaactttgggatgagggatatgctcattgtcttgactggtgatggtgttacaggtgggccaaaactaatcaaactttacacttcatctatatgaccagctatcatatgtcaattatacctcaataaagctgtttaaaaacatttagggtatatctactggaaagtaaaactgcttttaattacagaatatatcatcacgtgcatagaaaaatccaaaggattctacaaaaaagctactagaaccactgacttcatcgagatgcagatatcgaatggggcaaagcaagaaaagaggactctgtgggagtgcattggaattggag

SEQ ID NO: 1890 - DNA, 430 bp, Homo sapiens
tttcagcagaagtaatgatagtggaaaatggaatggtgttttcaaagagcttcaagaaaataatagtcaacctagaagactatgaggcaaaaatatccttccaaagacacgtccagacaaaggaaaatagaatttgccaccaatgaaaagtaccaaaagtatgaaaggaaagtactaaagggtgttgttggagcagaaggaaaatgatcactgaccacagctggaggtgcagaaaggcattgaaaggcaatggaaaggattttgcatatagaagacggtaattttaaaaacagtgaaagaagaaatgtatctgagaattcaatcagtcaatagactttagagtgagtatgatttttgtgtgctcaaaggcatcttttcagtttggctttgtaaggtttcattttttttttggtaggaaaatataaataaa

SEQ ID NO: 1891 - DNA, 2330 bp, Homo sapiens
gattcatccacagaatgttcaaagtttagtgtcagccattttcagcagaaaatagaggctgacaatttcctgtgttctttagaagactttgaaagcttcatgggaagaatgaagactattcttggcctgaacatttgccccatggggtgctggacccagccaaacagccttgtattggcaaaggagggtcaagtgaaaggagaccttgttctgcgccaggctctcaaaaagggtagcctgaaaccctattggccacacggaacctcttttagatgctgtttgtggacctgccgaaatcgaatgccactcaggctttctgaaaccctatgggggtgggaagaggcagtagctgacacctctgagagcagaggtttgtgaagatgtggcatagatgaggaggctagcagagggggggtagtcagacactaccaacaaacttcctttttgttctctttgttctctcttcgaggtgggccaccccgcttagctcccttttgtccaagtgtgttgcaagggagcagcatttcaccgggagatttgcacgccagaaccagcagtcgatttggataccatcaagacacctgaaaccttatcatgaaccagatgccaaggaagagattctggaaggatcctgaggacccccctggttgcagccatgtcaagactgatgctgaggaggaccccaactgtcacgagcaacacccatcaaacacagccacccacctggggacagaccaagaagctgccacagatggcagaagaaaacctgaagaaagcaggacaaccagtcacaatgagtaatttaatggtagctatgatagcggtaatcaccactgctcctgcagatgtggatcctgactcctgagagaagtagctcaccgtgacaaagctgtctttgcttttatcgatttgcaaatcaaagaagggggacatattgggagcaggcctcccaaaatctggccataaactggccacaaaactggccataaacaaaatctctgcagcactgtgacatgctcatgatggccataacgcccacgctggaaggttgtgggtttaccggaatgaaggcaaggaacacctggcctgcccagggcagaaaaccacttaaaggcattcttaaaccacaaacaatagcatgagcgatctgtgcctaaagggcatgttcctgctgcagataactagccagacccacccctttatttctggccatctcttcatttcccataagggatacttttagttaattgaatatctatagaaacaatgctaatgactggcttgctgttaataaatatgtgggtaaatctctgttcggggctctcagctctgaaggctgtgagacccctgatttcccactttacacctctatatttctgtgtgtgtgtctttaattcctctagcaccactgggttagagtctccccgactgagctggtctcggcacttctctttgccttgaaagcaggtacagcggaccttcctggcatcagaaaaaggcctccagaaaaagagacacaggtcctggcttcctgtcctggccatccaatcatatccaccgcaaacaggccttgttcctctgtcactgcaggccagctctgaaccgtctcttttcttccactgacatagaaagatgagatgtgtcagcacccttgcaaacatgaaagcctagccagtgaagtgctgagtgctggaagctttgcctggggcatgaacaggtagagaaactgcagattctgtgtcagatgaagtgactcaaagggacagaatggccatctttggacagtttaagagcttttataaggaagaggaatcagaactcacttcatgtggtgcatggtgccaaatcaacaagataagtgttcccaggaagcagatttcagcccatctcagctcacttcaacctctgcctcccgggttcaagtgattctcccacctcagcctcccgagtagctgggattacaggtatgtgccaccatacccagctaatttttgtatttttagtagaaacggggtttcaccacattgcccaggctgattttgaactcctgagctcaagggatccacccacctcggcctcccaaagtgttgggattacaggcttgagccacagcgcctgacctatatgcgtattttatgtccaaattaaaaaggactataaataaatatgagagtcttgttatgtgtgctgaagtgtttaggggtgaaatgtactaatgctgcaattcattttgaaatgcctccaaataggatggtttgagggatggatagttgaatagattatatgataaactgagcataatgaaatgataattgtagacttcaggggtg

SEQ ID NO: 1892 - DNA, 735 bp, Homo sapiens
ggcgctttttgaggaggccctgcagcaccgagcggacggatgggcggtgcactagctgcagcacgaagaggtgggactgcaatacaacgggaggatgtcatcagggggacttgggccaggggccaccctggccaggtaaagggtgtgctggggggggtgtgtcagggaggacgcatgcaggaccacagtgctggcaccatgggacttacatgtgccacgctaagtttgctctccccatttagtaaataagccacggaagtgaccacaccttcaggctgcttctgagtgccacgccttccgacactgccacaagcaagccccttaccaaagcaggcccagacatgccctggagccctgcccctgagtgtccctgaagggccctcactggcactaccctgggttctgacactcccaggaccacctgacatgtccacctctgcctgcctaggctatccacagaggaacactggctgcagcacaggagaggccgcttcagctgtttctcaggagtccccaggcatgctcgccttggatactactcccttttagggcctacaaggctgccacacacacagacatgccacctgaggcgtgctgaccactggtgccatcctgccatcgcagcactcacatggcctctccctgccccaggagagggtggccccgcattcatctaggctgccatttcttgtgctgaccgagggcctcaccaatggaggtaggaacagcctcacc

SEQ ID NO: 1893 - DNA, 2591 bp, Homo sapiens
gaggagtccagttgacccaagccccagggcacttcactcccaccctctgccttaccttcctccaggctgtcctcatcctcttgctgctcgggggctgagagcccttgagggccagctgggctctggggcccagagggaggaggcacttggcaaggcggcaagatctgcaaggccaggtctttggcatccatggaggccaccttggggctgaggagtggggagtgaggcgagaggctgactcgcggcccagtccccagaggctgtgtggttcctgagacagcagcagcggcaggctggactcctgcctggggcggtgggaggcccagagagcctgggggctcctcgtcttccacagagtcttcctgggggtcctggcacaggcagggggctgggggctccagtgggggtagggctgccccagcaagggtaccaggagcagaagggtcagggcccaggggcctgtccacgggcgtgctgggctgacccttggcaaggttttctgggggctgcagcaagggggtgccaaggacactgggtacttcgtggggttgctcaacactgcccagacccagtacaggctccggctgctgggaggttggtgcagacgtgggggcaggcgcgtcagggcagcctctgtccagactggacacagcccctactgaagactctgggcaggagtccagactggcctctgtggccacagctgagggaagcgtgggctccggggtggacttgccactcaggcctctttcctccctggctgggctcaggagccgggcctggctgacctcagggcaggcagcaggaggcgcatcggggacctcccttgcacctccaagtgctgacctgggtccatgttcctgtgccagtggcttcaggcctccttcctgctggttctcaacctccagggtctccttttggggtgagtcaggcttagccccatcacctgtgtgcgctcgcgcttccagacatgcttcccgtccaggcctagaaagggcttctgctatttcctccccagcaccagaggccggctcagggagactgagggcctccatgcccaaagtggaatccgcatcttcctgtgcggcccaaggtgtcccagcttctgcagctggctgtgggtcatcctgttggacctggtccaaggctgcaggctccgggactgtagggagggctgcattcttctcctcaggtgctggcctggggcctaaggcctcacctacttcctgctgagccatggtggccacaggctctgtccctggggcacagcctgcttctgcctgcaaggtttgaggggtggccacagccagaggctctggacctgaggtggggcctgtgtcttgcagaggcagaggtgctgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaggcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaatcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagatctgtgtcttgtaggggcagaggcggtgtcatagcggagtcctggggtaaggtgaggccctcttcagcctgctgggacacaagcgtggctgcagccacaggctttggggctgacgagagttctgtgtcttgtaggggcagaggcggtgtcataacggagtcctggggtaaggtgaggtcctctttagcctgcctggggacaatcgtggctgcagctacaggctttctgccagaggggaggtccagccctccttcttccttcaagttctgaggagagtctggacacaatgtgaggcttgtttcttcctgtggagttggaagtttttctgcagtgacagactcttggcctaagatctcgctgatgccctcctgggagggctgaggcattgccatggcagcagattcttgtccagcggtggagtctgtttcttcctccccagcctgtggggtcactctggtagccacctccacctggaggcctggggctacctgcagagtgtgaggggtcacagtggcagtggactcctggcctaaagcaag

SEQ ID NO: 1894 - DNA, 693 bp, Homo sapiens
gctttaaggaaggctttgtgacatatctctgggcctatcacctaggtgatgtgacttcctgcttggccctgcccacatcgagcattgtgacataagggtggaacctgcacctaggtgatggaactctcttgcttggatccttttctaagggggactggtgaatatctctggacccaggaccaggtgatgtggctctgcagcctgggttctgcccacatattaaattgtgacatatacttaaagaagcacctatatgatatgactgtcttcttctgcctgagccctgcctactggtgacattggaccatatctctgagcccctgacctaagtgatgggactctcttctgtctgggcctttacaatgggaagattgtgacatgttgatgagcccagcacttcggtattgtgactctcgtcttgttgctgaacaatgcccgtgaacaggacttttgccgtatttcagagcccagcacccagttgatgttactcttctgcataaacaggtcatgcataaagagggaattatggcatattgcttggcccagccccctaatgatgtgactctcctgcctgtgccagagccacagaagggcccagaacccaaatgatgttactcttctgcctaagtcctgaattaagatggaattatggcatattgctgggcccagcaccctgatgatgtgactctcctg

SEQ ID NO: 1895 - DNA, 504 bp, Homo sapiens
tgtaaatgtcaggaagcctccaaaaaaagaaataagatttcttttttgtcttcaaagtgttttccaagcagtgaagcacttgccgtgttgaactgaatgcactactggagaatgttctgggtccaagatgctcttgagagaagactaggcttttcaaatcaaacactcaaaggaatcatgcaaccctcttatgactgggatgccgtcatgtgccactgaccaatgctatctctccagaaaaccattcaagactcttaaaaaatcagacttataataaatatacataaaatgaagacaccaactgctctttgacatgactacgataatgtctgtgctatgtggaagcacatttaaaaagagcctattcggcaaaagaagaaagaggaggatgcagatagaagatgaaagaagacatgattactaaaaaatcatggggaagtctttttatcaaggaaaaaaccataagggataatgtgagaagaaaatatattattttgctaagcc

SEQ ID NO: 1896 - DNA, 1195 bp, Homo sapiens
ccctgcccgctgacgcccggtcgggacgctccacaccctgtgtgggggcggaggggacgcggtgggtgcggcctgggcgcgggtgggctagagcctggagaccgccgggagcccgacttcctggcgctttgccctttggggagcggagccaaggaacagcgccaacctctctccacaagccagggaccctacgacccaccgccgcaggccagaaccagcagctgatttagataccatcaagacacctaaaaccttatcatgagccagatgctgtggaagagattctgggagaatcctgaggaccccccagttgcagccatgtcaagactgatgctgaggaggaccccaactgtcacgagcaacacccgtcgaacacagccacctacttggggaaagatcaagaagctgtcacagatggtggaagaaaacctgaggaaagcgggacaaccagtcacaatgagtaatttaatgatagctatgagagcggtgatcaccattgcttctgcagatgcagatcctgactcctgcgagaagtagctcaccgtgataaagctgcctttgcttttattgccctgcaaaaacaagaagggggatatgctggggaataggcccccaaatctggacataaactggccccaaaactggccataaacaaaatctctgcagcgctgtgacatgttcatggtggccataacgcccatgctggaaggctgtggtttaccggaatgagagcgaggaacacctggcctatccagggcggaaaaccacttataggtattcctaaaccacaaacaacctatgccttaaggacatgttcctgctgcagataactagccagagcccatccctttgtttcggcccatccttttgtttcctgtaaggagtgcttttagttaatctataatctatagaaacaatacttatcactggcttgctgtcaataaatatgtgggtaaatctctgctcatggctctcagctctgaaggctgtgagtcccctgatttcccactccacatgctatatttctgtgtgtgtgtctttaattcctctagtgctgctgggttagggtctccacgaccgagctgggcttggcaaacgtaactctttctgggtacttcctgttggaaaggagtgctgtgggccgggcgcggtggctcacgactgtaatttcagcactttaggaggccaaggtggg

SEQ ID NO: 1897 - DNA, 241 bp, Homo sapiens
ggggaagatgaagagtgactagtttttgtttgtttgtttgagacagagtcttgcactgtcacccaggctggagtgcaggggcgtaatctcagctcactgcaactttcgcctcccaggttcaagtgattctcctgcctcagcctcccgagcagctgggactacaggcacccaccaccacgcccggccaattttttgtatttttagtagagacggggtttcaccatgttaaccaggatgatct

SEQ ID NO: 1898 - DNA, 1070 bp, Homo sapiens
gttcggttaaagaaaacatctggtaaatatggcagttttcctttatacactaagataacatattaataatatatacttcatttgatcggtaagttgcatgctaagttaatttatattaatatgtacattttatataaagattcttttttgactagtctgctgactttctcatcacttaatagcagaaatcatcaactaatactgaatgagagaaaatgggatgctaatgaggtaaatgggaagatggtgattgatgagttccgtcttagtggcttattctggatatgagagctgccaagctccaatcgtcctggccatgatcaatccccagctgtgcttctatttacacccaacatattgggggcaatatacaaaatacagtcatttactactgtgctttgagagacaactcacgtcccaagtctaatgaccgctacgatcacagcgacccctcctccccatccaacagttgacagttcaccaacccaatgcctggacagactttctgagtctaatttttctccaaagtcattgtttttggttggtccttggagaaaaagcttcttcctggattcagaactggggaagaaaatcagaccccaataaggacccctgaaagctgattttgagctaagaaagagaaaatatacaccaatttgcattgtttcatttacagacagcggacaccaaaagagagactttatcacaactgcctcttgggacttgtgttcaaaaaggagctcccagttcctagtgcaattcatgggtgaaatccagaccctctcagtagggagcattcactccatcttgtttcagacaaaatagatgggagggcttgtctggtttacttttcctctggctttagagaaacctgaagccagggaggaatgtcactcaacataacctagatagtgggtggaagagtcctggctcctgggctttctccagctggtagtaccgtccacactttgagttctttcttctgctctcctggcctcagtttaacaggtctgagagccctgagagaggcattctgggcttgacagatgtcagcatcctcccaggaatgg

SEQ ID NO: 1899 - DNA, 592 bp, Homo sapiens
ggcgggcgcctgtagtcccagctactcgggaggctgaggcaagagaatggcgtgaacccgggaggcggagcttgcatgagccgagatcgtgccactgcactctagcctggagacagagcatgactccatctcaaaaaaacacaaaagaaacaagcagaaatgccagagacgtgcagagaaaaggtcacatgaagacacagcaagaaggcagctatctgcaagccaatgagagaacactctgaagaagtcagccctgctggcaccttgatctttgacttctggcctctagaattgtgagaaaataacttccagctgttgaagccatggtctgtggcattttgctatggtagcccgagcaaactaatagagacttcctaaatccgagaaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgagaaagcaggaaagctggggagaattcctctgggaaagcagggcagtcacaag

SEQ ID NO: 1900 - DNA, 406 bp, Homo sapiens
ttgacagaattataaggaatgtccatttgtgctttagcaacttgaagcttcagtgaaaagaatcagaacacagagaaaacttgctgctaggacaaaaatgaaggaaagaatcatcccaggatggtgatactcgggttacaggctcacaggcagaagggacttggcctttctcagatgagactttggactgtggacttcagaggtaatgctgaaatgagttgactttggggggactgttgggatggcatgattggttatgaaatgtgatgacatgagattttgggaggagccagctaccgctcataaggtttcactctctgtccccactcaaatctcatcttgaattgtactcccataattcccatgtgctatgtgagggacgcagtgagagataattgaatcatgg

SEQ ID NO: 1901 - DNA, 410 bp, Homo sapiens
ttgcttttgattttacaggctcacaggcagaagggacttggcctttctcagatgagactttggactgtggacttcagagctaagctttctggcccccagatctgcacctgacctttaccacctcctcatcatccactctggtctgcatcctcttgaccgcgtctgagtctcctttggggctggatgtctgcttcagcattaggaaatggacacatctatagaatctctcatggcaacacaccaagtaattttctgggcaattttatacttttataagaatgaaagatgttttgattccaaaacattctgccctgttctctaatcattttagtcttttaaagcatattgtcttggaatggttaagatgttttgctcatcaatttctttgtagcccaacaatttataacagt

SEQ ID NO: 1902 - DNA, 1866 bp, Homo sapiens
ataccattgtatgctaaataacagtgtgggtcttaaatacagagtgaaatgagtagatgcccagcatctttcaatcaatttatatttgtcttatatgtcaaattttcagaaattgtggcaatgtttgaggcttctagtcagagaaatgttaaaaaaaaattacaactggcagaaaacaaaacgaacgaaggaggggagaatccagagaaagacaatgccatcatgtcatatatgtgtttagttaagcatcatttgtataagaggatgatatggctgaagagtatggactcagtgaataaatgcacttacctccgttaaatgaggattgggattaaaaccacagagactacagacagtggtttgacactcagtgcatgtgttaaaattggccttttctggaacatgcaacagaagttcagtggtattgcaaagaggacagatggttttagggaggccttgtgaaggaggctgttttgcagatggagacactgttggtggctgcagaggttttccagatcctgtttggcttactggttttgtagattgctgagccgagggctttgctgggctaggctgttgagctgagggttttgctgagccaggctgttgagatgggggttttgttgagccaggctgttgaggtgggggctttgctgggccaggctgttgaggtgggggctttgctgggccaggcagttgtgaaggaggctttgttgggccagtctgctgggcagaagtctttccgggtcctgcctgttgagctggaatctttcctggcccaggctgctgaactggagtctttgtaggcccaggtgccttagctggagactgtagcccaggttgttgagctaggggttttggtgtccccacctgctgggttggaggctttgctggccctggctgttgagctggagtctttccaactccaggaggctgagctaaagcctttggcccaggctgctccgatgaaggcttctctgacccagtctgctgagctggaggcttagcaggaccaagaggctgagctggaggctttgttgtccctggtggctggactgggggtttcactgtccctggttgttgagccaatggctttgttagccctgagggctgagctgggggctttgcaggcccaggctgtgatttttcatgtccaggctgctgtgctggaggttttccaggagttggttgctgaataggtggtttggatgggcttggcagtgagggtttaactgattctccccttactatgtctgcctgtttagtctgaggcctggatgcatctcgttgaagtggcaattttgcatggtctgtctgaggagtctgggtaggaccctgaattggctttcctgtacctggaggttgtgatttaattttttctggttgttgagaagatattgatttgggagtgccatcctgctgaagcggatccctaccaggtccttgctgcttaggaatcggcttgggtggctgttgttgtaaaggaggttttatgattccttcaggttttccttgctccttctgaaccactttttgtttcttggtggtttcttcctgggatgcctcagagtctgatatcaaatcaaaagggttgaatttatttacaacagaggaaacagcacttaaagcgttaacctctgagaggaagccaggcatcatactagacttgtgctcttcctttaaatcagttctggactttgattctttcaagctaatagtggaaggactcctcccaggcaatttctgctctgacctgaaagtgtctgtagttctacttttactgagaccaggttgagctggacgcccagggtccgggggtcttcctgattgctttggaggatgactactatccaactcttgtttcct

SEQ ID NO: 1903 - DNA, 253 bp, Homo sapiens
ataataacataatagaatgagcatttattatatatcacataactatatacaaaacacttaatgtgtaagctagattggttgattttcaatgcaagacatttatttgtttaagcaaaattctctttcatttaaggtcatgagaaacaaggaaagactgagaaacggttactatctggggagactaaggagagatgatgactaaatgcagtatgccatgtaagaagtgtctttcacctcccgccgtgattctgag

SEQ ID NO: 1904 - DNA, 2068 bp, Homo sapiens
aaagatctttagaggtgtatagttttgtttttcaaaatttacaatatctaaaatacttaaagtgggagaatccttccttaatatatttacctaaaagtgttgtaccttagagaattgtccacctttgataacccaaggaataactagaaagaaatttaaatgaaatccttaagaaacaagcttattggatatatcacctagtctatttttggatcgcaaatctcccgccctctctgagttatctcactgtcagataagaaaatggaacagggtcgatgaaaagatatgctccctgtctggcttttcgatttttcactcaagccaaaaggagcaaagggcagtgagttaaggctcctttccaaccctgcttgcgggagggcaaacctctggccgcctccggcttcggagcttatctgggctgcatggaccaggtctcgctgaccgttgcccacctctgcctgcaacctccacacccacatgaaaccgcccgtatccacggattcctgtgcacaaagccttagggagcccccaaatagaaacaaattctgagcccagagctgagatggaggtggttggctgatgagactggtctctctggggtctgcgagtgctagttcgtcccttcacctctcgcaccctggccgcagatctatgccctgaaatctccctcctcccagacacagacgtgggcgcacacacacaaactctcactcatgcacacccacatcgcctctgccctccacccttcccactccagtcaggactgtagggactggtccatgctctacctcaactttcccggctgcgcctgccccacgcggcacccgagcttccgcgccctggctgggcgccctccagagggacacgtcctcctctgggacccttacctcgcaccgacaactcctggcaggaactggagctgaccgcggtggcagcggcggcggtgagcctgcacccgggctctggctcatggttggtcctcctcatccgacacaaaagagcctccgctggtgataaccaggaaaacagggtctggagtagacctccagcaaactccaacagacctgcagctgagggacctgactgttagaaggaaaactaacaaacagaaagtaatagcatcaacatcaacaaaaaggacatccacaccaaaaccctatctgtaggtcaccatcatcaaagaccaaaggcagataaaaccacaaaggtggggagaaaccagagcagaaaagctgaaaattctgaaaaccagagtgccccttctcccctaaaggatcacagctcctcgccagcaacggaacaaagcaggacagagaatgactttgacgagctgacagaagtaggcttcagaaagtcggtaataacaaacttctctgagctaaaggaggatgtacaaacccattgcaaggaagttaaaaaccttgaaaaaagattagatgaatggctaactggaataaacagtgtagagaagaccttaaatgacctgacggagctgaaaaccatggcacaagaactacatgacgcattcacaagcctcagtagccgattcgatcaagtggaagaaagggtatcagtgattgaagatcaaatgaatgaaatgaagtgagaagaaaagtttagagaaaaaagagtaaaaagaaatgaacaaagcctccaagaaatatgggactatgtgaaaagaccaaaactacatttgattggcggacctgaaagtgacggggggaatggaaccaagctgggaaacactcttcaggatattatccaggagaacttccccaacctagcaaggcaggccaacattcaaattcaggaaatacagagaacactacaaagatagtcctcgagaaggagcaaccccaagacacataattgtcagattcaccaaagttgaaataaaggaaaaaatgctaagggcagccagagagaaaggtcaggttacctacaaagggaagcccatcagactaatagcagatctctcagcagaaaccctacaagccaggagagagtgggggccaatattcaacattctttaagaaaataattttcaactcagaatttcatatccagc

SEQ ID NO: 1905 - DNA, 819 bp, Homo sapiens
ctatctattattaacaatcaaaagaaacagcctccaccagatggaggggcgatctgtgatatctgttccttttttatgtccattaattactctagcacatatcacaaatcagagaaagaccctcaagtaaagatttgtttcagccctttggttgtgtgaaaagaagtgtgaaaagaagtataagctcatgcaattaagacagcaggtttcctgtctgtgggaaggcactgaggtcagagaataatgagatgtgggttttcctggagcagcactaccaacagtctttggaatctccagcaggtcactttgcatctcctattcttagtgtgtttaaaattcataatccctgatcccttccagtttcatgctgttgtatatattatggataaatgtcccgatgtgtaaaatgctgagagttttctaacataaagatgaaccattactacttcagcagggtaaagaaatttgaaaattttactatactacaaaacttttttaccagcttgttttcctggtgggaagtaggtaggttgtaagaggagagaaacatcagcattttagcctcagcagaaatcctactcacctctatcctggctttttgtgagagtagtaacaaattggaagcacttatgttagaactgaagagaaaatatggaaaaacttaaacatgatggagtggaggaagaacaagaagaaaatatatctggaaggttgatggttttcataaggtgaataattcatttctaagtaatgcaactgttactgtcaattagaaattcacattctgatgaattttgttgcataggctttagtttaggg

SEQ ID NO: 1906 - DNA, 1561 bp, Homo sapiens
gcctataaattcagaatgtgttggagggttagtacgttatgtggttctagaactatatgttctttagtacttcttggatgaaatacttcagtttaaaatttggaaaattttatgaaccaaggaaggtagtgaaaaatatattttgggtgttgggggaagtgggacttttggcattcctcaaaacatttttttcaaggggacgtcttgaacaaaatctatggaagagatttgttagacatctaagttcatgtcttgtctactaatcaattttgaagttaggtatggtctggctaccagtgtagtagtgaccaatatagtatggactggtcaccagtccatatatgtggattccacagaaatcactgggattaatgcataagcatgtagagggtctctgctttttcaggaaaaacaagatgttccaaagtagaaagttaattatactctctagatatccttttctccttgaggcagatataaattccaacgtttttgaccttgtagtgccatctctcagattggcatgtattctgacatattttgtaaaagcagcttccattatgttgtattcaccaagacatggttcattgaaactgttaagcaaatattactaataatctatctgctatctattattaacaatcaaaagaaacagcctccaccagatggaggggcgatctgtgatatctgttccttttttatgtccattaattactctagcacatatcacaaatcagagaaagaccctcaagtaaagatttgtttcagccctttggttgtgtgaaaagaagtgtgaaaagaagtataagctcatgcaattaagacagcaggtttcctgtctgtgggaaggcactgaggtcagagaataatgagatgtgggttttcctggagcagcactaccaacagtctttggaatctccagcaggtcactttgcatctcctattcttagtgtgtttaaaattcataatccctgatcccttccagtttcatgctgttgtatatattatggataaatgtcccgatgtgtaaaatgctgagagttttctaacataaagatgaaccattactacttcagcagggtaaagaaatttgaaaattttactatactacaaaacttttttaccagcttgttttcctggtgggaagtaggtaggttgtaagaggagagaaacatcagcattttagcctcagcagaaatcctactcacctctatcctggctttttgtgagagtagtaacaaattggaagcacttatgttagaactgaagagaaaatatggaaaaacttaaacatggcaagaaagatgaagctcccttgacccagccatctggtcacccaggctgcaaataaagcagatgggccataataaagccaccattataaacaacccagtgaatactttttgtgagagatggagtggaggaagaacaagaagaaaatatatctggaaggttgatggttttcataaggtgaataattcatttctaagtaatgcaactgttactgtcaattagaaattcacattctgatgaattttgttgcataggctttagtttaggg

SEQ ID NO: 1907 - DNA, 631 bp, Homo sapiens
gggcatggtggcatgcgcctgtaatcccagctactcgagaggctgaggcaggagaatcacccgaacccaggaggcagacgttgcagtaagccgagatcgcaccactgcactccagcctgggtgacagaatgagactctgtctcaaaataaataaataaataaaaatattcttgggacacttagggaaatttcatttaagtattaactggatattaggtggtattatggactcttaggtttaataatggcattgatgttatgtagaagaatgtccttattcttaggagataaatgcttatatatttaggagtgtcataatatctgcactgtactctcaaatgattcagcaaaaacatgtgtgtgtgtgtgtgtgtgtgtgtagaaagaaaaatcaagcaactatggcaaaacattaatgactatttaatctaggtgcttgttgttctgttctttactgtatgttaggaattttttcaaaatgaaaagctggggagaaggagaaaaaattctaagagtcaatgaaactgaactgtaatccccatttttatcactttttttgtgaccaagtcatttcactcacctttttattcatcagttccctatttacatacttagagcaaatgagataacg

SEQ ID NO: 1908 - DNA, 878 bp, Homo sapiens
cccacctcaaataaacaaaacaaaatatttaaaatttacaatcgtctttggaggctcaagttggtgcccagagaaaaatgctagttatgattgctcattttattttaattttgttttagcagagatgggagtctcgctatgttgcccaggctggactcgaacgcctggcctcaagcgatcctcccacttcggcctcccaaagtgcggggattacggcgtgaaccaccgtgacaggcccgcgtttacgtaaataaactcatttaaataaataaaacagcaggccccctaggaaatgtcttggtaacaccgtcagcccactccgatttactacacgggcttggcgaataaaactccacttttggggtcaggcccttcgctaactcagaccagctagaccggccttttcccggaatcctgagagcaacgcaggccaaggcaaagtcccaaaaggaccagtgaggacatacagaccagctcgcaccagggcacggtcgccggctcctgacggcggggccctcggtccgcgaggtgaatgaaccagggctgaagagaaacaggccctcctcgcacccgggcctccgcgcactctcggggaagcgaactaccgtcggccgcggccggacgccgcctccttctactcccgtgaaggcaaaacaagctgccaccccgctgcgaccccaaaacggcttccgggtactcaccgaggggaggggcgggcctggccgctgtcctgtcacctacacactcgcgctcggggccaccacagcctctcccgggccgctgtagacagccccgaggccggcgcttctcggtggcacttccggcgacggagtgcagggtcccgaatgagggccccccctcctccgcccaggcatgag

SEQ ID NO: 1909 - DNA, 846 bp, Homo sapiens
cagaagtttaagcacatggtccacttgactaaccaccacgtgggaccctcagggcccctggtccccaggcaatggcagggacaccaaggccaggtctaccctcaaatccttcccaatggcacgacagaccgctgggggaccaagacctacaatctaagaaaatcagattggagctggctagcctggtggagggtggctagcctaggtctgcaaagggcacaggaaagatgggaaggagaaagaaccccaaatcccccatgtcggcagcaaaggagagacccttactggtaccaccgatggtgtttccatgccaaaggcgaggggttggcggggttctaaattgaaacttctatatagactcgaagaggcagtgcacaagagggtgggaaagctgacgatcttccagaacgacactttgagaggcaggagggaagtaaggcttgggtggctggaaaaaaaaaatccaatccagctaacaagtctttatgtagcatctcctagttcctagcactaggatgcaacagacctggagtctgaccgggaatgcgagtaatgactgtataacagagaagagagacgaggggcttttaaaaagttactcggaaatttttttgtttttttttttttttaaggcaaagtgtgagagctgtggccagggagctgctgcacggaggggcatgagctgagaagggcctggcctgggacggggaggacaagcagtctctgctaaggaaggtatttcccgcggccgagcaactgggaagaaggagaccccaatgacccagcactaagatcgccggagcgaaaggaaacagaggttgcagtccagtggcgcgatctcggctc

SEQ ID NO: 1910 - DNA, 550 bp, Homo sapiens
cgaagccatcttggtaaaggaagcgcctgggagcacgcggcctgccccggcccgcctcgcgactcaaacactctgcagggaccctcctaagatcaaattggttccccccgctgtcctaagccagaggcttactttcagatcgcatgaacgcattcctggacaccagccacagttgctaaaactaaatgggatcctgcagacccattgacggactgtcatagccaactcaatcacagtcgagaagcatttgaatacttacagcctatggcgctaggatcctggtagcgaagaaactaaactctaatttgaaatgttgtacagctagcttagagtggctgctgaacttaagggtgattaagagctgcttgcacctgggtggagctgaaactgcataaggtgaataatacctttgtgcaacagaagaaaaaaaaaaaagtaacagcatacatacaaacccaaagggtaagttgaagttactactcaaaagttcttcatagtgttcttgactaagcaacggagaagtaatcccggcactttgggagggcaaggc

SEQ ID NO: 1911 - DNA, 621 bp, Homo sapiens
gggagctcggctcttgagacaggagtcttgccaatgcccctggccggataaaccccttctttctttaactcggtgtctgaggagttttgtctgtggctcgtcctgctacatttcttggttccctgactgggaagcgaggtgattggtggatggtggaggcagctccttaggcagcttaagcctgtcctgtggaacatccctgtgggagactgtgaccagaccaagcgacacggatcctgagagcgctcccgggtaggcatttgccccggtgggacacctcaccacagcagtgtgtggcaggcccccgtggagaatcaacgcagtggctgaacaccgggaaggaatgggcacttggagtctggacatctaaaacttgaattagaggagacagcactgattgcagtgacagaagcggtgccagctaactccccaccatcaaaagtatcttctgctgtagcctggcacaaggtgtgaaatttcatttttaaagatttacttctttgatttgtcattgttatggttaaaatgctataatgctgtctgagggttaaaggacataacttgtgaaaaatcattaatttcctggtgctaatttaaattctttgataattatctgggagg

SEQ ID NO: 1912 - DNA, 254 bp, Homo sapiens
ggtggaagacgtgaacagaaatgtgttccgatggtggcaatcacgtgtgttactctctgcagtttcaagcatccactgggggtcttgggatgtgtcgccctgcagataagggcaactgctgtgcagcatgaacagtatggagacaatacttatcttcatggagtttatattagagtaagacaagagcttcacacttggaagattaataaatattggttgaattaatgaagaaagaaaggaagaaaacagcagag

SEQ ID NO: 1913 - DNA, 397 bp, Homo sapiens
atggcagcccgtctgtttttgcttcattttctggctcagttaaaagtacctttgagagaacacttgctccttctcctcaaaataactgtggagaacactattcacgctccatgaaaaccttagttttaagcattacctgttggatgtcagtgtgtgtgtctgtgtatgtatttctctctgtgggagcccgtgtttttgtgtgtgggtgggtctcagggtgtgtgtggtttgtgtggggtgtctctgtaaccatggagaagactctctgtggagatggccatgggattcttttttttttttgaggcggattttttttgctcatgttgcccaggctggagtgcaatggcgcgatctcggctcaccgcaacctccacctcccgggctcaagcgattctcc

SEQ ID NO: 1914 - DNA, 2244 bp, Homo sapiens
gtacagatgggaaggaagaggcagtggggtaaaacaacaatcaaaccaacgtgaagctaccgaacacacagaattctggaatatttaaacactatcataatagcatgtttccaaaattgtctgattataaaaatgggtatagaaaaccaacgtcagacaggagctctttcatttttttctttttttttttttttttgtgagatagtctcactctgtcacccaggctggagtgcagtggcatgatcttgactcattgtaacctccgcctcctgggttcgagcgattttttctcatgcctcagcctcccaagtagctggagttttaggcgtgtgccactacacccagctaatttttgtatttttagtagagatggggttttgccatgttggccacgctggtcttgacctcctgacctcaggtgatccgcccacctcggcctcccaaagtgttgggattataggtgtgagccaccgcgcccagccctctttcacttttcaacagtaactgaagtctgtgtcagattgtgaggaacacctgtctgctgctttctggaagctttcagtatttgaaaaagtggctagggaagctgctgggaagtccttcaattaaccttaaaaagcatgtaataaaacctaattatagagcatgcttctttcatcctctctgtcactcctttagagaatgtggtgactttctaagccactgtccctgcaacctcctaggatttagatgtatgaacattatttacagatgggaaaaacagagcactgaaagttttggtcaagaaaaccgtacgggttagtgatggggtttctcaattgtgaagacctgagcttgacaaatgcattttcagcttcccaggatacccctggctcctcagtgagcactggaagtttgtcccttctatagcagcccttggcagttccagtctaggggcagaagccagcctgccactgcagagaagagcagcaagttccagcccagccggcgagcacgctgcactcatgggcttcccaaggctctggcgggaagtcacgggtcaagtgaggtcttcttaggtgctcaacagtcacactctggggcctgaaaggtcttagaagcttatctctgtcaatctctgcttagaatcaaatcgatcaatcaataccttttccttctctttgcttctcctactgagccccagcatatttgagtgaaggtacttacatgtacgtagccttttaaaagccaagtactatcaagtgagctcccatttcaaggcacgtttgaactgggaatagaaagacgggcagcttaagctttgggatcatacagacccggattcaaatttcacttgttacacagccttggcaagctattcaatccttttggggctttagttttttgtttttgttttgtttttttaatttataaagtagaaatgatgttaactctcagagttgttgtgaaaacacagctgactcaaataaaatacaagatacatagattttcaacacattaacccccaccaccccaccactttcccctgtgaggggatggcacatctaacatttttgggtaaaatttccagaagatctatacagtcgagttgttaaaaactggtgtgaaagactaaaataagattaggcatcagtaaatcaaggctgcgggtgggtctgggggcttctctggagggaaaggccagaccaagggatgtcccaacaggaacttactgtgtgattttctgttaggagaactgtacccacagctttaatttgatgcatttgctggatcatgcttttttaaacaaatataaagcagagaagaaaaaaaatccaaggtagatttcagttaaactatcaccaccacgactctccaattcactcccgtgtagaaaatgtgcatttgtttctacggagcatgtgtagacagccctagctccctggaagagagatctgagggaaggccattatggacgcacagtggtcttaacacagcgaaactcctctcttcagtagctttttttttttttttttttttttgagacagagtcttgctctgttgcccaggccggaggcagtggtgcgatctaggctcactgcaacctccgcctcccaggttcaagtgattctcctgcctcagcctcccaagtagctagactatgggtatgccccactacacccagctaatttttgtattttgagtagagatgggatttcactatgttggccaggctggtcttaaactcctgatctcaggtgatcc

SEQ ID NO: 1915 - DNA, 1300 bp, Homo sapiens
ccccaatttattagtattcctggaaatatttgagaattacatcaacataacaacaacaacaacaacaaaaaagaactacaagaaaaagctctatgaaattaaaaatgcaagcctcaaataacaatagggaacactatgtgtgcacatgcttgagtaacttaacctcacacttgtacttcttttttcctttttttcttttcttttttttttcctgagacacagtctcattctgtcgcccaggctggagtgcagtagcgtgatctcagctcactgcaacctctgcctcccaggttcaagcaattttcctttctcagtctcccaagtagctgggattacaggtgtgcaccaccacgtgcagctaacttttgtatttttagtaggaatgggtttttgccatgttggccaggctggtctcaaactcctgacctcaagtgctccacccacctcagactcccaaagtgttgggattacaggcgtgaaacaccacacccagcctttgtatttctgatttaatctaccatatagacaataccttacctagaatgtgttatattttacagtactgtcaacagtttgtaatggcatatgtggactatgttcatgacaaagggacagtgccaccatgtccactgttcaagaaaacctgagtctgtttttaactcctctgcaagtttacagtttacttctctcaatacctgctcatcttttctacagaaggggagtaaccaaaagtcacaggttttttttgttttcgttttgtttttttgagacagagtatcactctgtcacccaggctggagtgcagtggtacaatctcggctcactgaaacctctgtctcccaggttcatgcaattctcctgcctcagcctcccgagtagctgggattacaggcgcataccaccatgcccagctaatttttgtatttttagtagagatgatgtttcaccacattggtcaggatggtcttgaactcctaacctcaaatgatccacccacctcagcctcccaaagtactagaattacacacatgaactaccacacctggcctatatttgaatatttaacaattaagctgaaaagcttcttgatgacatatctttagagatgattaccaagttacatcttccccttttccatatctgtgggaaatatacccaacacagtgctacagactaccaaagctggagtcctggtgcacttcctcatttctgacctgacagctaccacactcggaccaaagacagtaggccatctgagaacccacacaggcacttggcaagtctataaaatgacttgcag

SEQ ID NO: 1916 - DNA, 256 bp, Homo sapiens
ctttgtttgtgtccgtttcattctcagcacagcatctggcccaggttgagggctcagtagttgcaatattggcattcagtaataagaacaacgtgaatgctatctggagtccaccaatccttaccgtgtgtgctagcactgagctacgtgttttacatggatgggcccattggatcttcacaacaactccacgagcacgtgtgggtcatgcatttccagatttggttctttgtgtgtgcagtactgccccctccac

SEQ ID NO: 1917 - DNA, 428 bp, Homo sapiens
catgtgcctggccttagtaggtgctcaataaatactggctggatgaatgaatcttcctccaaagcagagggaggatgttgcctcatgttcattgctgactcccagctcctagaagaagctccacaaatgtttgctgattgaaataatgatgaacactaagatggtggattctgccacaagtgattctagggaccaggatgagcatcacacttggctgggatcctggaggatagagaatgagtgaaaggtacgatactggacttttaggagtttgggatctaactgggaagttatatgtgcatgggttgaaatatgcagcttaaggcttaatgaagcaacagattagcgaaggcaaaaaaaaagcctatctagatattgattagtgacgtggatcaatgtaaaacattttacattgagaccagcctggg

SEQ ID NO: 1918 - DNA, 230 bp, Homo sapiens
ggaataaagaggtgtgaatgcacaatggacgactagccaaaaagtgccagtagtgcaagcgcgaaaagagccaagtgaaacctgatggaatcttgacagcttctgggctcagaaaacaagtagctccaaagtgtccaggaggatttgtgaagataacaacagacaacaatgttagggagtggtgagatcaagtacagagcctcaagaggaccagggccattctaaagtcc

SEQ ID NO: 1919 - DNA, 1405 bp, Homo sapiens
gtcagtcagagttcaaacttgagagtgaaactctcaatatttggaatattatagagtaacaaccttttacaggaatggtgtgaggtgctatggaagtaaaggtctgtcgagtggggtacagcatcgcatggtggccctggactcactgcaagtcagcagggctggaaatcgggaaataaagacaggggtaaggaagagtgaagacaaacttgcaccctgtgtcagctccactgtgtctctcaccacttctgaccaattgtaactgggcagtttaactgcaaaatgcattttaaactttttacttatttctcgtgcgtttcaagatataaccttgaagcaaattgcagaagcctttccctctttgtcttaaaatgaactccacatccctccctttctcaccatctatactcccttcacattcatctacctgtatgctagcatctaattatgtccctttttagaagctcctgggggtaatcttgagacagatgaaccaagtctggagacccacctgcaaagttccagagatgacttcaaggtggcgagtcaacagcctcaccattgttgagatgacaccagcccgtgatccagcttccacacaacagccctgatgtttaccagcaggcgtctcttgtttagtctcattgtctttggcaagttcaatctcaaccagattgttgttcttctcaagaggactgatcccagcaggctccagccctaaagcggactgttcgggagatctgtgttaactttgtgtttcagtcctcagtctcacggtactgggtcctaccgtgagcggaaaatccctctctacatcagaacagccttctggccatgctacagtcctcgctcagaaacacggtatgtgtctctgctacccgtctgctcacctgcatctcctacatcctatccagcattctcccgtccacaccactgggcacatcagatttagcaaatgatcagttaatttacactcattaagcagcagtctctacgatgaatctcttctaagctcaggacatttgacacacactttgcaaaaatcattatgtgtcattgtggcgagctggcaggttcccagttatgctgaacaatgaaaaagggataaagctctgcaaaagatagagtggggagagaaagaaatctgcatcgcattgtcaggactaaacattctttaaagaaacctacagtgaggtaagaatggcatctgtgctactctagtccaaaacgtgtattcccttccccctaaaagacagacaaagacaccaaggtactgagcacatcaatataaaataggagaagaacaagacaggactgcagtaacttggtctttaaaagaatctctaattaaaaagatataaaatcatatttgctcagactttgaaggtaaaggcagagtgtcttg

SEQ ID NO: 1920 - DNA, 305 bp, Homo sapiens
cctcgttctctgatttcccccacaggattgcagggactctcaccttatggagaagacaggtgtttgtaggaggtatgctgggaagagctttgctatatctccggaaggaagaagattgtttccccttgggggatggcactttcaacatgtgggagcttgtcgggtcacagaagaatgacagactcctgggaagttggagctaatgtgaacccgtctttctgtgtcctggttgcacatcactgttcttaaagactgtgactctatcagtctggagtgaagcttcagtatctgcatatctttacagg

SEQ ID NO: 1921 - DNA, 304 bp, Homo sapiens
gttaaatatactaaaatctcaaatctgaagagccactttgaattagaaatctgaaaactgaaagcaaaaatagaaaaagcagaaaaaaatgaacagagttgattgaacttagcaaagaaatgataaaaagaagacaaaatcatctcagagtgaagaagaccgaaatggaagataataaagtgaattgacggaacgcaagaaaataatctgcaaatgaatataagttaacaaacatcacaaagcaccagctcctttaattgagaaaagaagaaagcacgatgtacaaaataatgacaagggggac

SEQ ID NO: 1922 - DNA, 497 bp, Homo sapiens
gtggcgtagtgtggcatcaagggcatgaatgataagaaaacagagtcatctgagggaagaggccgtggggcagaaggctgccgtgggtgttctgctgagctctgaagcttggccggcaacaatgctgttccctgcaggctcctgttgcctcaagcggggcactgtgtgtgagggtgtgtgtgaatgagcatgttttttgtgtgtgttttgtgtgaaaatgagtgtgtgagcgtgagttttgtctgagttgtgtgtacaagctatgtatgtgttttgtgtgagctgacttgtgattgttttgtgtgtcagttgtgtgagttctgtaagctgtgtaagttgtgagtgtgtgtggttgtgagttgtgttagagtgaaagtgtgtgtgtgtgtgagttgtgtggttagcgtcagagtatgtgtgggtgtgtgtgagttgtgtgagtgtgagttgtgtgtgagagtgtgtatgagtgtgagttgtgcacatgtgagtgtatg

SEQ ID NO: 1923 - DNA, 12600 bp, Homo sapiens
ctgaactacttccccagtgtctctggattcaactcaactcctgtggaaggattagagttgttaggccgtatggggaaagtgacttgatttgcacaagtgcattcgaggagaaaaccaattctcagtagaatgagaacgttaaatacaatgagggcttatgcttgaactggccatcagcaagttattttaggcagttataaaccttagcaaattatttttaaaaagagaaggtcagttttataacgtgaaccagctgcttcatttgttcaactcagtgttgtgtgtgtacatggttctattaggggaactggtttcggttcagtatgtgtgtgcatggttaagaggggaactagtttcggttcagcgtgtgtgtgtgtgtgtgtgtgtgtgtgcgcgcgcgcgcgtggttctgttaggaggggaactagttttggttcagtgtgtgtgtgtgtgtgtgtgtatgtggttttgttaggaggggaactagttttagttcagcgtgtgtgtgtgtgtgtggttgttaggaggggaactagtttcggttcagcgtgtgtgtgtgtgtgtgtgcgtgtgtgtgtgtgtgcgtgtgtggttctgttaggaggggaactagtttcggttgagtatgtgtgtgtgtgtgtgtttctgttaggaggggaactagtttcggttgagtgtgtgtgtgtgtgtgtgtgtgtgtggttaggaggggaactagtttcgtttcagtgtgtgtgtgtgtggttgttaggaggggaacttgttttggttcagcgtgtgtgtgtgtggttgttaggaggggaactagtttcgtttcagtgtgtgtgtgtatgtagttgttaggaggggaacttgttttggttcagtgcgtgtgtgtgtgtgtggttgttaggaggggaacttgttttggttcagtgtgtgtgtgtgtgtgtgtggttctgttaggaggggaacttgtttcagttcagtgtgtgtgtgtgtgtgtgtgtgcatggttctgttaggggaactagtttcagttgagtgtgtgtgtgtgtgtgtgtggttaggaggggaactagtttcagttgagtgtgtgtgtgtgtgtgtgtggtaggaggggaactagtttcatttcagtgtgtgtgtgtacgtagttaggaggggaacttgtttcggttcagtgtgtgtgtgtgtgtgtgtggttctgttaggggaacttgtttcgtttcagtgtgtgtgtgcgtggttgttaggaggggaactagtttcggttcagtgtgtgtgtgtgtggttgttaggaggggaactagtttcggttcagtgtgtgtgtgtacatggttctgttaggttctattacacagtgttcattcctccataggcttcaaatgaattcagttgctcggcttgttttgtagaaaattgtataagatttttaacatgaagttcagtacttagaaaatgcaagtcatttatgcattagagttactgaatttaagaaaacctctaaggaaaacaaaaatccctttgaatctgttttcttttgacattggcagatagagccggtattgcttctgtctgggaactggcaatgctgatgtactccatgaaggcccctgaattgagaccccaggctgtttttagcctggagaaagccaatgtctgcatttagctgtgtttatgtcctagtaaccagtattgggagtgaaggattcatcaaaaaccatttaaagattggatgaggtacatggatcagtaagtttgctataggattgctaatacatagagacagctacttatttgaccaaattggaggaaatgaaaattattacatgtagaagacacatttaacaagtcctggtttttcagtggagatacagggttgccacctcaattccactgttagttcagagtggttgctacacacatgccctgtctattttgcggggttcccttcttctatttttaagcccctctgcacactggacagtatcagtaagactcacgtgcggggatagagctgtaaaagctcataccttgctcctttcgttccttgtggatgccagcagctttgccatgtcattttcagtgcagccttgggaatatctgtccctgggggctggcctggctagcgttcctacatagtccctgctgcctttgagatggatggtgaagcctccactgtgcagtgttctcacagaagtacccccccgaggctaatgttgtgagactgtgcaaccccaggagagcccggcctcccccgcgaatgcaggaattgctctgctgcggaccacagatgaggaggaggagaacctgctcatgatgtctgaacacaggatttcagcagtgatgggaatttagagaatctttcctaagatatttaagatgatttgtaagtggttttatccagttcagtatattcttgaccatctattgatactcaagacagatcaaatggtaggtcctggggataagatataggcagaaaggaaggggtagctgctgaaaaaggttctatgcaccaagaagaaaactaaccactgttcagggtccctgttgtgttatctcagtgacgtgattggtgttgggaatttattcctacctgggctgcaggtgctgaggagagaagaggctctgactctattacataacgtgtgacatgagtcatcacaggcctctgtaagcagatctagtcagctagactcgaacaaaatgaagacagggagttagcaaagctgagaaagtcgggaaaggaatcacgtccgtcgcgctcctgacgtggctacacacggtgcatccaattccatcgagttgtcatttacaacacacctgcagtttgcatatgatggtcccgctttacaaatggtgcctacatagtgacggcagggtttgaacatcgggctgtctgaccagcacacctgcactcctgccattccacgagactgttgaccagatctttaacagcttttaattctcatcagaggataaaatcatataaggctctaaaccctttataatgaagggatcaaaggttagtagttataaaagagacaagtcacccgcagagacctttagaaacaagtgctcccatggggagacagcggagacaccagaaagaccagaaaggcagaggcctccgtggcaggacggtggctgacctttaatttcctcccatccactttcctgtgttttctgggagattttttagactatgtatacattttacattccagacagtatgtagttaaaatgctaaaatgctgcgtgcacaaagcttatgctcaggcctgatagcttggagctgtcaacataaacaatactgtgtaaggtggtgttttaaagaaatggcattactttttgctattgtggaaaaatagacataacatgaaatttactactgaactatttttagtgtaccgttcactggtgttaaggacattcacaatattgtacaaccacctcccccatccagccacagaactttttctagtagaccagccctacaagtaatactaaaaggagttctaaagcttgaaacaaaaggtctataggcaccagaatagaacctcctgaaaacataacagtcacagggcctataaaataataacatcatgaagaaaacttaatatctaggtaacagtcatcacgatgattggaaatggacctcacgtctcaatattaatgttgaacataaatggtgtaactgctccagttaaaagttacagattcacagaatggatggaaaatcacaaaccaaacatctgctgtcttcaagagaactctgctaacatgtaaggattctcatggactcaagataaagggatgggaaaagtgtgaaaatggaaaccagaagcaagcaggagtagctatttttctatcatgggcattactctctaaagtcacaatttctacatgtgagagtgaattactggtcaaagggaaaattttgcatggcgaggcaagaatgaaaggcagacgtatggctcccttcagtgccatatttcccgtgtggaggagaagcccatgacacagagggttttgtggtatattcgaagccctgccattcctaatccggggtgattctggggaagcccctgcctactcttagcatatctcctatctttaaaattacgggatcaggctaagggatctccaaatatcttccagtttaaaatctaagattctataagtggatgtcccagcagagctcatcctgctcaaagttgggtgttccagtgtgctttggaccccaacaccacacccaacattgagcccccgggggccagttttcatcatacgagcaaatccatctcactgccctccagccacactttgtactgctcagcaggccatatggcttagtctaatcacccagccttctctccagtcttgcccttgactaacttttgactattacaaaatgttcactctcaaaagactcttaatcacacaatccaggggcctgaaagatgtagggacatgagaggctttcaataaagatgtggaaagcaaatgctaggggttgaaatgtttagagatgtgacatcaatagggaagattcagtagaatgttccaactctgaagacagatgaattgtggtgtgtcagctaagcctgtgttattaaaaacagcaaaaaccctggacaccctccagaatcgctggctttggggggaagcatgctttgctcatgcaccccctcctctgttggctggaaagtgagctctgtcacctgtactcaaaaacaacaaaggtattgggttccctctgccctggctctttctggccaaggaatgtggaaggacaggaggagaggtggacctagcatgtggtctgacatcctgtggatcatgtcagagtcccatcagccacctggaaacagctcatcctgccagtcagggagagctgcctccagttggaggatgggacagtgcgctgtctttgggcagctcagaagtgtgtgtgatcaacttgacttctcaggtgaagaaacagctcatctctttcctttctctaaaaaattttgatctgttcattttatacctttgttaataacttctgtatatatgtggtataattttattttaaattctccctgaaatatttttgaaagtaggttgagcaaaaagacaacacatattctgttacccaatgtaacggcctccgtcgctcggacgctttgtagactgagaaaggtcgcgtggatggggctttacttttcttctgacccaggaattatttggagctggtcacattgtgttgctgtctcgagcctcccctttccactcatgtcacccctcttctcggaacgccttcccaaggtctttcatttcactcctgctcatccacacatcccaagcctacgctgcctcctccagcaacagtgcccaccccgtgcgtgggtcagggtcccctctgagtgctcctaagcacgtgtcctccctgcattaggaccctgggcgtgtccgtctcccccagagcacaacggctgttcctcgtgtctcttttttccacatgcctaagacaggtgcttatccaggcctttgagtccaaagcagctggagtaagtcaacctgacccacaagtgggggagaaaggggtactcatgagcagggtctgcattttcaatccttgtgtgtctgaaaatccctccctgtctccccctctctctctgtctctgtcttcctctttccatctctttgtctttttgtctctgtctccctctcacacacacacatgggcccacatgccctctccctctcctggtgcagtgcagggggactcaggagtggagcatggcccccagccaggcagcagcaggctgggctcccggacggctgagccatggctccttccctgtgcctcccttttctgggctcccggacggctgagccatggctccttccctggcagcagcaggctgggctcccggacagctgagccatggctccttccctgtgcctcccttttctgggctccagtgcagctcatctcagtgagattaatggcacaggagattttcccattatcttcctttgggcctggaatttttcgtgaaataacctacgtatttcttcatttccttctgtgctaaaatttatttgtcacagcctcagccattaacctccaatttgaacagaaaaaaaaaattatcatgcctgctgtctctagaatttctcagaagtcagaggaacagtgcccagcctgagcccttccccattctttataatacaaacaaacgataattaacatttcggagctggggcgaagtgaatcccagagtctccttcttcacttattaaacattttctttttattggatattgttagtatttctttctatctgttattcttattgagcaatatatttaaaaaatagtttattgtcttcagaaacagatgtgctgaggtcctaaagctgattgattttcatgcaaaacaagtatcaggctgcggataccttgcaccgtattggaaagaaaggttgcagcctttcccggggtctcggagcccacacgtgaaggtggctcgctgccaccagggctccctgccgggcagaggggaatggactcgccctcgcttcctggaattccaacaaaactatgtggaggagcaggtggtccctcagggcagacacatcacctcccgaaactgtatggaggagctggtcttccctcagggtcccacagggcccacacatcccctcccacctctccccttgccagtcattcaggttacaggcctttcacaagaatttaattgtcttgatcacattatacttgggctggtaaacattgtcttattaagggaaaaaatgccatgttcacattagaacctcggagaagccagattgtgattggcactctccgtcgtcgtccacgagtgactggtgaggttgttttggtgtctcctgtttgaggcattattttccccatttttctgatgagtcactgagaccatgtgttgaaacacattctcaccgtcacgttctaagtgtgattggtgatggaggtgcatttctctcctgcgattttgtgagctctttacagcgaggatggtgtggcgtcccacctgtgtcgtggcatcactgggtcaatgtcgaattggaattttaaaattaagagtacataggctttttattatctgttaccaaatgtttaaaatataaagccatcccattgaaataatgttgtatgtgtgagagagttagattataaaagcttattttggctgggtgtggtggtgcacacgtgtaatcctggcactttgggaggctgagacagtaggattgcttgagcctcggaggtgcaggttgcagtgagctgagattgtgctgttgcattccagcctgggcgacagagcaagatcttgtctcaaaacaaaaaaaaacaaaacttttttttttaagttactaattttgttatgtagcagttgatgacttgtatattggatatgatataaattaagattttacaagatatttaaacttcacttgaggaaaaaaggagccatataatcattgttaatagaagggtgatatcgctgagcagaaggaaaggaaataattttaaaaggcaaacagcaaacaggaaatctactaccacgggctcatgttgcagtggggactgtgggctgttctcaaactcgtctccttgggtgtctgcgtgttctggcctcccttgcagcagacagacatggcggcaagagtgagtgccaaccagactgaaagcaggaacctgaaaaccccgaatcctccatgccgtctctttctttccatgggatagatacacacagcacatttgcatattgaagatgacagagccttaaaaaccgagcttcctggtgaccgtgggcccggagtcccagcgtggcagctgcaggctctgccctccttggtggctctggagttctccctgggaagcttcttccggccgccaggaggggagggaagccaggaaaggctgtgggcccccagccacgtcagcgggaagcacactctctgtccaccgtgatctgctggagcaccccagccatcctgccccaccgaagtggaaggggctctggtcagcccccgctcctggaaacagctctccacaaaggcaggggaacatgtgtcaaggtaggattatgcctataaatcccaaagggctttgaagtgtttcgtaaaagccaatttggatcctttaaaaacaaatagaagaaaacccactccgggccccagtctctctgtgggcccaagggcaggtgacgccgggcaggggagctgtggggtgtgtcccagccatcgtcccctcgtgacagggaagtgggaagagatgttctgttttgctcacagcagaagccatcatttacacaccttctcatggcacctgcctgggaattggaaacgatttcaggagccttaattaatgaagcgtcacaacatgcctgcaggctacgtgagagttattatcctggttttgccaggagacagccggatgcggaggagtgcaactcggatttgaaggtcaccgagcgcgttaatgaaatccccggaagtgtgtctgccaacaatccttttattttggctttacctgctgttcgcctgatgcctgtaaacctttcccgagtgttgattttcagaagggtgctttgcagggtggagttggggtggatgaaatgcggcccccgggtttctgactccctttcgtggcgcaggtgggctgagacccttgatgaccgagaggttagaaatcaaggacataaattcagcactcttgttgaatagatatgacccttgttccatcttgggttcttttctagaacctcaattataactttataaataaattccgagtgccttaaagagactttcagcgttcctttaatctccctggcacgctggctgcatgtgccttgtaacttccaaaaacaaaatatgtcatgattatccagatccaagggaggtgttatcattggagatttcttagccctcatattgtatgtgtgtctccaggaagcagagccttggtgctcgtgctgatctttgtcgctgcctatcttgcagagtgtgcgttttattaaattctttttgggattctatatgaataaatatttttctggggtagcataaaagctgttttcatgatctgtgcaaagtcttactggacgtggaattttggcaaatcctgggaacagagaacacagccctttcctccccactttacaaaggaggcacttaaagcgtcaaaggctctttgggttcgcttgcgggaaacgtggtaagtgagtccctgaacgtgccactgatgtgcagatggtgtggtgggtgcacagccgcaccggagcggcccccgaaccacacaggacagtgctgcggaggggatgtttcatgcggggctcagaaaggccgggctggaatcctgagtctgtgtaggctgtgtggcactggggtggggtggaggtcattcaatcccaaggtggagttgagcatcccggataatgggaactggagacctcagggcctgtgctaaggaaggaactcaaggagccggaaatacctcagattgtgcctggcacagagcaggttcccagcacagagcaggttcccggcaagcgctgttcctcttctccctctttgctgcgtggttttcgtgaagttggggagaggaaacgtttttacagcaatgcggcaagaatgcaatcacagcgatgagaatgacatggacctccaggtagtgagttatccccagtcacctgtgaaaggcatgcatttgtatccacaaacaaatcttaacacatgtaaacgtacgtcagaaaaacatgtctcccctgctgtttaggatgagaatgttctagagtctagaggttgttggccatctctctaagaaccagagcttcagtgagagctttaaatcatgtatttcatgtggtgagaaacgtggcatgcgcgaacagacaccacgcgagacagggaggagaaaggtggcatgcgtgaacagacactacacgagacagggaggagaaacgtggcaggcatgaacagacaccacgtgagacagggaggagaaacgtggcaggcatgaacagacaccacgtgagacagggaggagaaacgtggcaggcatgaacagacaccacgtgagacagggaggagaaacgtggcaggcgtgaacagacaccacgtgagacagggaggagaaacgtggcaggcgtgaacagacaccacgtgagacagggaggagaaacgtggcaggcgtgaacagacaccatgtgagacggaggagaaacgtggcaggcgtgaacagacaccacgtgagacagggaggagaaacgtggcaggcgtgaacagacaccacgtgagacagggaggagaaacgtggcaggcatgaacagacaccacgtgagacagggaggagaaacgtggcaggcatgaacagacaccacgtgagacagggaggagaaacgtggcaggcgtgaacagacaccacgtgagacagggaggagaaacgtggcaggcgtcaacagacaccacgtgagacagggaggagaaacgtggcaggcgtgaacagacacgtgagacagggaggagaaacgtggcaggcgtcaacagacaccacgtgagacagggaggagaaacgtggcaggcgtcaacagacaccacgtgagacagggaggagaaacgtggcatgcatgaacggagaaatgtggcgtgcatgaacggacaccacgcgagatagggaggattcaggatgtgatcttatttcagcatctttataagtgatcaagtaaaagtcatataattgaagttatctaaaccccccatacaccaaatgcgtccgcttcctggtctgtcgtcctgcagcctacagaggccgcgtccttccacatgatggccccgcacctggcactgtcgccgtccctcagtggagacaccaggaagccctggatcacagtgtgacacgttctgtactggggtataaatacggtttcatggggacacacaggagggagctgagtgtgctcctctggccccggagagtgctgagaggcagcgtaccctgcagaagagtggcagtcgctgagcgtgggggacggctcagtaggtacctcggccacagtcctgcccgtccacatgtcctgcagaagcatggcaggcgctgagcgtgtgggacggctcagcaggcacctcggccatggtagatgccgagggccccaggacaagcatgcatgcatgccagaggggaactagaatgtcaaaagggcaagacaatcccttataaaaactttaaactaaagacttctatttgcaaagatcgtcttgagaggcaatataacgctggccgtggcagctcatgaacaggtgctggtaattcgaatgtcccagcgaactcccatgggcaataacacaggcctgaggcaggaacggggggagaacccggggggagaacctcttcccagggccagggtcgagctgcggcattcacgtctgtctcagtggctcgtgctgaatgacccaaaggggcccaagggagcaaaggtgggcaaaggctgttactgccatccgtctagaccagtgctgccagcagagaatgtgagccttgtgggtaacttttaatttggattactgacatctaaatgtgtatggtacaaagaagcaggcaatattaagtatgattttgaccaaatgcaagatggcatttcaggggctcagagtggtggtgggtactgtgcagggcggcacagctctgggctccgccatagatgccagtcctgaccgtccacagaggcccccacccgaggccacccagggtgccgcatggatggtctgtctggcctccctggattttccagtggtgtctccaccatacaagggaataaacaagtgtgaaatctggaaacagattctcatggcccttctttcacatgtggatctcatctaatgtttttccataaaattgtgatgatgtttaataatactctttgtgataatcttaggaatcttaggaatgccaggttgcatgaggtgagcataaacgcatagggaggaacggtccatgccaactgcaactcggttttcagaattcactcgcacctttggctcagtaactagcagattcgttcctgctgggatattcattttaaaagcttgtcttctgatgttggctgcaaattagaagcaataatgctattccctatctaatatttttaaattatttttttaaagtactgtgagctcctcagaataaaaccaaatgatatcgtaattattatcatctacaatcccccctggactgcacttttaaaggaggtcaagaatggatctgaagcaactttcttatgtaagtaaaatttgaaaatcaacccaaatgactttgtcttaatctgctggaactcccacaacaaaacaccatagactaagcggcttaagcaacataaattaattttctcaccgttctggaggctgatcaaggcgtgggcagacctggctcctggggagggcctcttcctggccacctgctcactgtgtcctcagggagacaggctggtgtctcttcctgaaagaccctgatccattcagatcagtgtccccctctcattacctcagtttaccttcattacatcctcacttcaaacacagccac

SEQ ID NO: 1924 - DNA, 2553 bp, Homo sapiens
cttgaaggggatggcattgaatctgtaaattactttgggcagtatggccattttcacgatattgattcttcctacccatgagcatggaatgttcttccatttgtttgtatcttcttttatttccttgagcagtggtttgtagttctccttgaagaggtccttcacatcccttgtaagttggattcctaggtattttattctcttcgaagcaattgtgaatgggagttcactcctgatttggctctctgtttgtctgttgttggtgtataagaatgcttgtgatttttgtacattgattttgtatcctgagactttgctgaagttgcttatcagcttaaggagattttgggctgagacagtggggttttccagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagtcttcaaagggaatgcttctagtttttgcccattcggtatgatattggctgtgggtttgttatagatagctcttattattttgagatacgtcccatcaataccttatttattgagagtttttagtatgaaaggttgttgaattttgtcaaaggccttttctgcgtctattgagataatcatgtggtttttgtctttggttctgtttatatgctggattacatttatagatttgcgtatattgaactagccttgcatcccagggatgaagcccacttgatcatggtggataagctttttgatgtgctgctggattcggtttgccagtattttattgaggatttttacatcaatgttcatcaaggatattggtctaaaattctcttttttggttgtgtctctgccaggctttggtatcaggatgatgctggcctcataaaatgagttagggaggattccctctttttctattgattggaatagtttcagaaggaatggtacaaattcctccttgtacctctggtagaattcggttgtgagtccatctggtcctgcactctttttcgttggtaagctattgattattgccacaatttcagctcctgtttttggtctattcagagattcaacttcttcctggtttagtcttgggagagtgtatgtgtccaggaatttatccatttcttctagattttctagtttatttgcatagaggtgtttgtagtattctctgatggcagttcgtatttctgtgggattggtggtgatatcccctttatcatttttattgtatctatttgattcctctctgtttttttcttagtcttgctagtggtctaccaattttgtggatcctttcaaaaaaccagctcctggattcgttaattttttgaagggttttttgtgtctctatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagactctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttatagttgtagatatgcagcattatttctgagggctctgttctgttccattggtctctatctctgttttggttactgtagccttgtagtacagtttgaagtcaggtagggtgatgcctccagctttgttcttttggcttaggattgacttggtgattcgggctcttttttggttccatatgaactttaaagtagttttttctaattctgtgaagaaagtcattggtaacttgaaggggatggcattgaatctataaattaccttgggcagtatggccattttcacaatattgattcttcctacctatgagcatggaatgttcttccatttgtttgtatcctcttttatttccttgagcagtggtttgtagttctccctgaagaggtccttcacatcccttgtaagttggattcctaggtattttattctctttgaagcaattgtgaatgggagttcactcatgatttggctctctgtttgtctgttattggcatatgagaatgcttgtgatttttgcacattgattttgtatcctgagactttgctgaagttgcccatcagcttaaggagatttggggctgagacgatggggttttctccatatacaatcacgtcatctgccaacagggacaatttgacttcctcttttcctaattgaatactctttatttcctccagctgcctgattgccctggccagaacttccaacactatgttgaataggactggtgagagag

SEQ ID NO: 1925 - DNA, 3088 bp, Homo sapiens
ggaagaaaaaaaggggaaaagatggtgagatttcgatcctaataccacctgaaaaagaccatagctgctttattgatgaggagaaacatcctccactgcaagtatctttccctctcagctgattgtcgcctttcctctgagggcccttctcactgactctgtgttctctttgcaggggactagcttggtgtgttcttcctctctgcagccttcacatctagcccaggtgctctgcaattttactgaatgacttttctccttccgtagctatttgcgtattttgccctttatgctagattgtaaagtctttgaggtagaaacggtatctttctcatctctgctcccccacaacatgtaagccaggacctcatgcaaaatagcgacctggcatctagatgtgtttgaagtggaattgagtttgtagacagagcttcggcttatagggagaggaggacatgggagaaggagagtggaagtgatttcggactctcccagacttgggaatctggtgatcgtttggaataagctaccttcagcggcaaggagggctttcctgatgtgtgggccatgattttgtggctaagaaactaaagaaaaaagaaagaataattgaaagaaaaatttcttaagcccttctttggagaggaaacacatcccttcagctgttggttttgtagaggcacctactctatttctgagttctgagtcctgtctggtagcactggctgaggagtggttaagggtagggtaggtgattttggagttgggtgctaatctgggctgaagttcccccactacatttttctttttttgtggtaaaatatacatgacatttgccatcctaacctttttaaattgtataattcagtggccttaaatatactcacatgtggtgcaaccaccaccaccatccatttccagaacatttttttatcatcccaaacagaaaccctatccccactgcttttttttttttttttttttttttttttttttgactatgcaactttggtcaagttgccagtttcttcatctgtaaatcagggctaatcatattatgtactgaataggattattgtcaggattaaatgacgtaatgcatgaaaactgcttaacatagtgcctggcactgtgttttattgactacgcactgaataaatgttaatataggaaatggcaagaggaacgagaatttaaatcatttagagccagcagagggacacagtaaattttttcccaactctgaatgatttgaactaatgattagttcctggaacgcatgctgggcagttttgatggggcttgactggaactataactgttggcaaataacctctccagagctgaagggtgtggggctgggggaggttatttctaaaatccttccaccaccagtgtcacatctagcatgtcatggaaacgcaagataatgcttgagtgagtgaatgagtgaatgcctacgtatacatttcagtgcttgaagggaggatggagatcattttcttttagtcgtcagtttgtcagtgagaaggctgagacccaaataagtagagtgacttattcaagatcacataattaggggtagagccggtttaaaaagccaagattcctgaacatattgtgcaatcttaacttgaaagagaacccagagaaatgggagaaaaactggagaaaacctcaaaagctcacgcagttgctaactgagagtcaaggtctccagtgttcaatgtcattttcccttctctgactgcacatctgatccaaagtgttgcagataattgctttttgttaaggaaagaacatccccttccagtttaggagcaatggcgattctagtaaggaagatcatggaaaataactgttttaaaaccataattcttagggaaactagaaatttttaagagacctcaaatagcttgcactgtttaaccttacctaggctcagtctgcttcctggtcaggtatgcatagtaatacctcgcaaagcatggtgagctttaaataacataaagaacgtgacagtggcttgcacacaacctggcatatgggtggtgttcagcaaatacttgttgcaagaaaaggaggatatcattgatgaaacacactctccagccctatcaacagcccacttgactctgctgggaagaattgctggtgccgtatacactttgtttgcaacgtgacctggagaataacctcgggggaggaggtagccattaggatggagcactttatagcaaacacgtgctgctgttttgctgcggcaccccaggttgcagttagtcagaaatggcttcccatgtttactggaaacatcgagacgtgtctcagtgacactaatgctgcaaatgcaggtttcagtctcatacccggggacacaggtcacttggcacacaggcagtcactgctcacccatgtagagcaataggaagaatcctgtaccaggaatcggagcactgggttctagaggtggccacttacaagctttgtaatctcacggctttacctctctgaacctcagaatcctcttctgtgaaacaagggggttgaatacgtgatttctgaccccttcccgcttgaaaacaccatgatctgtttagttattgcactcacagctttgcaagtattgctgctcagtgaaaatgtaagtgccatacatgtgtaccatcacacacacacacacacacacacacacacacacacacacacacccccttctagacccagattctccactcagggaaatagcatgaaagaaaacctgatgccccagtgaatagccattttactcaccacctttagaatgacatagcccagctgcttctgggctagaacctcatcctccttgtgactcgatgcttctgctgccaaatgaggtggagaactgtcacagtgcgtccttggatgatggaccgcagatggaacacccagcaggaagtaactcctccactgaggatggcattcatctctaccacctgcatggtttttgctataactatggagtctcattctgttgcccaggctggagtgcaatggtgcgatctcagctcaccgtaatctctgcctcctgagtttaagcaattctcct

SEQ ID NO: 1926 - DNA, 3250 bp, Homo sapiens
ggtccatcatctatcttgaaattacttctgtgtatggtgtgatatgggtcaggattcatttgtttcatatacacagccaattgaattgaaaaggccttactttttccattggattgccttggcatcttggtctaaataagttggtctgaattagtataagtacaggtctatttctggagttatgtcatttttttgctgacctgggtattctaggactgggtatctggtttggtttttatttgatatctgacctggatgtctttgtttccacttgaaagtggcatacagagagtcggtaaaaatagctatttaaggcaatcttttggtagcccaagtggttgctgctattggccattatgatgggaacgaggaacacaagtggtagaacaggtagggaggcagacacgagcagagcaggagagatccccatcccccaatgaggagtggcaggtgaccctcaggtaatgctcagcagttgttaagctgtctctttaaaacaataattggtcacagctggcaccagggaacggcagtctcacagtagatagaaaacacctaaagctggtgaccagcagcttcccagtaagatctcaggagctgggttagtgggcccaagcatgtgcacgaagaggcaaaatggcagagtttaactggtatatgaccttcctccagaaatgttcgactgataagggaaaaatgcctcaagtgaacacgcacacaactttagtcaacacactgcgcatcctcacctcccaagtgctggcaggccactgggcgtgtggagagcccaccccaagggaagaatcagggaaaaagagatgcagacccctcaagcctgccaacgtataaaaccccaagtcaaaggccaaacagcgcacttgaatctctcaagttgcctgcttggccctcttccaagtatactttacttcctttctttcctgctctaaaactttttgataaactttcactactgctcaaaaacttgccttagtttctccctcttccttatgcccctcagtcaaactctttcttctgaggaggcaagaactgaggttgctgcagacccacatggatttgctgctgttaacacaagaactgtgggggcaagctaattgtttagagtagagctgaatttaagaaaatagcagctcaggtttttattttattttatttttggcttaagtctctctcttttttttttttttttattttttctgagacagagtcttgctctttcacccaggccggagtgcagtggcgctatctcggctcactgcaagctccgcctcctgggttcacgccattctcctgcctcagcctcccgggtagctgggactacaggtgcctgccaccgcacccagctaattttttgtatttttagtagagacggggtttcaccgtgttagccaggatggtcttgatctcctggccttgtgatccacccacctcggcctcccaaagtactgggattacaggcgtgagccaccgtgcccggccaagcctcttctctcttgtagctgtagaaccagtgtagcaaatacttgggctccaaatttaatcctattgattgcatgaatacaatataaatacaattcacagcctttctaggtctctcatgtgaaaggtagggttgggggaaagattagacatctgagactcaaaataggaggatttgggtagattttcatatatctgttataaaatggaagcattattattatttatgtgtggtaaagccaacagatcagaagacaactgccattgaaaagagagtttgttactcacagtttcctggaggaggagcatgcagaaccacatggggaagcaccagaggcagaaggagcaggcaagagcatgcaggcagagtctttactgtgggctttgcaggaaggaatgggtgaggcaggctccacaggctgaggattggctagtgtggataattcagcaggctctggaggatagagatggctgccagttgcctggcacctggctctggtgattaggggagagagagcacaataaaggaggtatttggtgggtagtcgctttgcattggttgggttgcatatgaaaagtgcacttgcagacgagtcttttactctgtctaggaactgtccagccctgggatgggcagacactctaggatcaacaaggtcccagatatcaaacaccataaatacaaaacactgaaaatacaaaaacttcaaaaacaaaaaaaggcacgattaatacagtattcaagtaccttgaaaacacaaatcccactgagtctcacttaccagcaaaaaaaacctttcctctcttctgaaaactctggccatttcctgcttgagagtcctggaatgatctcatatgaagcagttactttatagaaggatgctaattatcttcaaaacccaacccaccaactctcctggcctccaggattataaatacaactcaatttcacagtatcccacaggaaaaaaaagtacaaaaattggatctggaggacattaaacaacaaaaggatgctaaaattttgctaagacatcagaatgcacctgcaaaatatggttgagataaaatctaaaagtactaaaacaagggggaaaaacatagcactggagtggactggattaatccatataattagtttatggcatattctgaattcaataaactaatgaacagatgggagtggctctaatagtttgcttggttaattaaaccttgcatttaaaagtgttctacattaaatgatgcagtcatgtcagatatttctagttacactgaagagaaaaggatacaaattcttagggagatgagaagttggggcagattcattatgctaatgaatccctctccatccctctttatgtcccataagaaggtctaaagatgcttctttcaccaaagcagtaggaatgcatcaatgaagggtaaggggcaatatgctggaagtggttaacggtctacagaaatcatgcttcctttccatgttgtagaaggacattagaaagtgtctctgcccagctgggcgcagtggctcacgcctgtaatcccagcactttgggagaccgaggcgggcggatcacaaggtcaagagaccgagaccatcctggtcaacatggtgaaaccccatctctaccaaaaatacaaaaattagctaggcgtggtggcgcatgcctgtggtcccagatgcctgggaggctggagcaggagaatcgcttgaacccaagaggcagaggttgcagtgagccaagatcac

SEQ ID NO: 1927 - DNA, 2217 bp, Homo sapiens
cattttccgagtgtgctctttcctcctcttggcttctgtgtctgtgttattcccaggcagagggtaggatccatcggattttccatattcctaggccagttttgaaagctcctccccagatgctgagaccacatttcccgtgcaggaggaggtggatggggagagtttgcatctgggagtataattcagatgacttttatcatcagtacatgtcacaagaaaacatttaaaatgacactgaaacaatcattgaaatcatggtgcatggaggaaaaaggtaaagaaaacaacttttggcttgttttggcatgagaccttgatacaatttgggttccccaaaaccatgtgaagggtggtaaaatagaaatgctcaaaactgacttaaaaaaataaacaggctttacaaaaaccctcttttttcttaacccagccacttctcgacatggtctgcacatacagtagatacattcattattgtccaagggaagacagtaactgcctttcattttaaagagcttggtggagaggctgaagaaatgtgctgcagctgaaggtgagtagaatgttccagagaacacaaaagtctagatggtcttcagaaacagcactgagcatgatgtggggagggtctctgggaagagaggtggaggtggaggagggtgcggagtccagatctgaagccacggagactgaggatggagttgggttgtcagtggtgaacgtgggggcagggatctctccgcctgagcagtcctgggtttgtcctcagcctgggaacgttgctctttcagcaagaggcgaaccctgggctttggagacggggctggggctcttttcaggcatagcagcagtggggagactggggacaggcttgcaatggattccacgggaggggcttctctcctggttctgactgcttattaggtggttattaaggcaataaggacttaagcaaactagaagttaagggcagctaagttcagccagatcaaaggtaaacaaaaggtgagaaggtgtccctttctcctcagctacctttcccccaagcacaggaggcctcagctcctgaagctctgaatttacagtacacagtagcagacggcttgccctttggaaggctccatggaaagaaggctcatccctgacttggggcaacttgaccgaagtttctactctccagaatctcttttctgtggtcacccgactggcaagtggaagatggaagcaccaaggttcctgcaaaagatagatcaagacctttgctatcaacctttcagcccatcccaatggccttgaatggcacgtgtcctggaaaaccaggtctgctgcctgtacgcccgagcgaaacctatgctcagctggagaagaggacagcctttcagggttcatgaatgttctccctagaacagatggaatggcagctacaatgcccttgggaatgtgaggtcctggtggagtctctggggaagtgaaagaagctcctttaacttgactccactcacaggacaaagtgcaggagacagaacagaatggatagaagaggcttctcctttcttcttgctctagagtgaaggagatggacagttaccttgaaatgctacgggaaggatgagcatggagagctgcctgttattctgagccaacttctggcaagatgctgggtgaatcgactgcctagaattgaagaactggctctcaagcagttgctgctaaagaatgccagcaaacaaaccacacacaactgtggtaagccaggcggaaatccctccaccctctggcatgagatggcagtctagaaaggactctccatgagatgcctggggcctgaggaagcagaggcatggacacactgttctacgatgactcagggccacccatgagtgggacattcgtggggatgagatgggagcagggagaagcagcagttgtaatggccagccacgtggggaccagttccgtgcctggcctttctttctctggtggaagccatcttgttttgatcctaagaaaaatgggtgtcattttatccaggaatctaagaattataataataaattaataaagtgaatgtgataatcaaactgtgaggatacgaacaacataagatttaatgatcgttgtcaaaaccagtccgtagggctgtggaactttatcgtacaattcgactttgatatgtgtttaaatatattttctaagttatccacaacccaaaacagg

SEQ ID NO: 1928 - DNA, 1444 bp, Homo sapiens
ggccgggcatggtgactcatgcctgttatcccagcattttgggaggccaaagcaagtggatcacttcaggcctgcagttcgagaccacctgggacaacatggttcattcacctgttgccaacaacatgagggagtttctccacagcccttgattcctgaattgttcaacaaatcaacagtcaccaatacattgacttaaggagtaaacaagcagcttttctctacacaccaccgggcaccccaggaaggcgcagctccctgctccacgaccgcctcttggtgcctgtatccagcagaaggacccagcaggaggctgaatccaagcactgctctcaggccactctatcctcatccctggatcctccagggaacaagataaaaaaaaaaaaatcctgttttcctgctttccaaaatggagggccttaacatcaaccaaagttacaaaacaaaaacaaaacacaggagctagctgggcgcggtggctcacacccgtggtcccaacattttgggagaccaaggtgggaggaatgcttgagttgtaggagttcaaaccagcctggcaaatatggcaagaccccatctctctaaaaagtaaacaaaaatcagccgagcatcatatcacatgcctgtagtcccagctactctggaggctgagatgaagactgcttgagccagggagggcaaggctgccgtgagccaagatcacaccaccacaccctagccagggagacagagcaagactctctctcaaaacaaacaaccaaaaaaaaaaaaaaaacccacatcatctgcaaagctatgttgggagcacagccatttcccataggctttctttttccttgccccattgccttccgggaagttttccccttacccatcatcacgatttttcccatctttcacgatggtgcaattcaacaggatgaattaactgaactagaaaaggataaaaaaaatctaaccctatgaaaactctgccttcaacataactccagggagacgaatattatactactggcacctctgacccacactatcctctgtaccccgtccctgcccacatcctcctttctggacacttagacgtcaggttccccaagcggcaaggttccgtgaggagcaccaccagctccttaggagaactggcactgctctggctcctctgacaactggggctggcactgcgggcaccaccaggtgagcctctgtaacccatcttcgggcccaaacgcctccttcatgacctggtggccagcagggcactgttctttctggtagacctgtgtgtgctgcggtctgccttggaacttgccctgcagccaggctgtactgaactccaccacgtgatccaccaggacctcccgacgcgaggcactcaggactgaaccgagagaaaggggatggatcccagctctgtacaaggcttcattcttaatgatgttcc

SEQ ID NO: 1929 - DNA, 2850 bp, Homo sapiens
gaaagatgtccaagttaatggagatcactaggagtgttactttacaggtatgtaaatacagataatcttggctggactgtggctatattgtctggtgtccctttgagggtgaagcctcttgtattattctaagtgacctctggagaaagcaactgtctcataattacagggacgacttgagaaagcatcctgagcctatgcagaaatgcagaaacacttccatgatctaaacaacctatgtgaaggcctgaaagccaaagcaagatcctcttattacaaagctgtccaacaaaatttttccaagtaacactggaggtccatcagtcactcttcctggtctggaaatgccagaaatgtcctccttggtccttctgagagtcaagatcttttcaaaatcacctcaggagccacagaaccactccatcctacctgaaattgcaggatgactcttcttttgaccagaatctcaaaaatatattcgttgatagtattgattcctgggagctgccattgcttgcaaaagatgtgccagagactagacattttctgtctcctcacttgtccagggaagactgaagttttactgaaacacagcgatgggaatctgaccctctgagcagcctcaggattttctaagtcttccaagcagagtggaaattctggtgaggacccattgcaccccctgatggtctggaatcacataggatgatgctttcaaacaactctaggtggagatacattttctgagatattccaaggaggagggacacaattggaccagatgttagaaggacagctgagcattaagtgcctatgtagtgtttgcagcttagtttcccatgcagaaggggaacctgggccctggtgttaaaattcagtgtaattctgggttcctgctttccttccaggaaatcccacttccaactggatgtctggatgaactactgaaagctgctgagtgtcctgcagcaggtgtgcttcatcagaaggcttcctatgcccgatgtaaagtgtcctgggggaagaaaggagcactgcttagaaagatgctccacagggagaaaggagccgccattttcagaagaatgttccccagaaacatgagcaatccagatgccgtggcttcacacagggtgttggatggtcttatctctttaagcgggacctaggaattgttgtcctttaatgctcataactgcttttgaggtgagccgaattgatgtcctgcctgcgtgtcatgctcattgcactttaattcacacacatgtcacacacaaacactctgaataagcacatttttgttcttgagcaatatttcacccaagattctgtggttctaccgagccctgagttctgtcctggacatctcaactctttggtaggtcaactttgatctttgtacctaatgataaatggactatgaaatcttatcagcaaatatacaaaagtaaggggccattctccacaatcgtttctctctggtaggtcatctttgataactgtacctaacaagaaatgaatatgtgatgattcctaatcaaaaaatttcttgattttttgccattttaattaattctgttaatgtttaaatagagttttaaacccgagatttggcatgaagtctaatcgtcaaatacacaaaaggaagggtccattcttcaaaatcttttccactgaaagaccacctctgatatacaagtctcgttgcattacagggatcctgcttccaagatgcagctttcacagcttgatgattgacccagaatctcctctaatgccatttttttacacccaaaatgagatttatttcagggcttccggattttattttagctgaatacatccactcttctgtttccatttctttcaaactcttttaaataattatcttgctgcatcagcccttatataactactgtccacccaccgagaccattacatttatccatcaattaccctatttactaataatatatcaggattcaattaagttttttgtcttaggttgtatcctcttgcattcctcagagaatttaatggacactgcttacactgtgactatggaagagttgaagcagatttacttgtcagtattatgagcaaatatgttaggtgtggaaccgggctaggatagtagctaaacatttgccttatttcatatataacaatgctatttaacaattgtgtacatattaaacagtttgtgtgtatgagagaaatattcatggcatttttaatccaagggtttcttgtatatgacatcatttttaaaaaagtcaaaatcagaaaagcttcacaaattggaagatatctaagctaaaaccttttgtttcttaaaggaacgatgaagataattgcaatgtaacacacggcatgtgtgataatgttttaatacatatctaaaaatgccttaaaattcaatagaagtaaaataacaacttctaaaacttgacaaaaggaaacaacaaaaattacacactggaaaagcctggctgactggagtgaaatcctgtctcaagaaggaacagacaaacacacaaacaagcaaaggattctaaaagcagggaatcaaacagatacttgtacaccattcttcctactagcaatcttcatagtaggaaaaggcaaaaacaacccaaatgtgtggtgaattacttcatcagttttttaggatctgcaatactgcctcaattttcagttactcattgtggggagaacctgcagttaccacatttgttccaaaattttatggtgatgaaggtaaacctgtccggcattctcagagggacagaattctggtgtttctccaggttccttggcttatcaggaatgaagatccaagctgtatag

SEQ ID NO: 1930 - DNA, 6248 bp, Homo sapiens
ctgtaactgggtcttccaaattcattcttctggatgtaaaagaggacataggcctgttgactcaaaggagaagtgataccagaggcagtgacctcggcatcatccattttataccactggccttcttgagtttgacacaagagaagtaatgtccgttgtgacaactccacccggtgacgacgagaacagcatagaggacatagaaaagaggtcctgtgttctgctgagacatgtatggctgcatgtcaacgcactcaggatattgcagattcttggcaagtttgttgcctgtgacatcggagaatctcttcaagacaaggatgaggaccttggcagaagtgggtaaagttaacgtcttggcggcaggcgccttctggagacaaagaccacaatgataggcattctctccattgagttcttcgggcttcaccaactgttcctaagcttgcttgacactctgagctgcctggatatccagggcgatatccaggtaagggtcgaaggtgtctgaaatgccgtggaagtagagacacttgatttgagatctctagtaccctccaaatatttggtggatgaggatggtgtccttgcagtgatgatctagctgcttgtgcccgggaaggcatgcctttctaatggcatccacagtgaatatgagaaattcatgggcatcttcctgcttgcctctatggaagtcagcagccaatgcctgtgagggctggatgacatggccaggacggtggaggtgcccgtgtgctgtgagcttccataatacagagcatgcagcacttgggacgatgacacatttgagagagctcccaggacagcatgtagttggcaaggggcggtgtgtatgtcaggcactgcagggaagcattcaagtggcaggtatttcccatattctggagaccagctcccaccgcagcaggtctcctgctactcggaggaagcttctccctgggagcaagctgtcttgtcacaggagccaaatcgtcacagaggtcgacacgggtctccgatgagagtggtgacttctcagggagagaagtccgctggatttcaggaaaagctgcatctggctgagaagatgtgagttttgaaaagtggttgaactgccactcacctcccaagtagagtgagtcttcctccatgtcgcccgcaacaaggatcacaaggtttttctgctgggactgcaggttgcagaaagacgctatctcttccgagagagtcttcaaataacgagttctctggccaaatcagcccttacataactcacccgcaccaagagcgaacaccccacccgcacataaggtgggcaataaaccaatcaaatatcagcactcaattaaggaatgagtcacagggtgtgtccccttgcatcgctgggaattcaacagacacagtccacatcatgacttctaaaacaccttcatcaaattactcctcaggatgataggcacatataatatgatggtaaccgggttgggacagtggccacacagttgccttattttaggtaaaagaatgtcagggaagaaatctttacctatgaaaccgtgtgagtatgtgtgtttgtgtgcgtgtgtgtgtgtgtgtgtttgtgctgggatgtacttccgagtatgtgcttttggcagataccatcatcctttcagcgatagaaggagaagtctgaagtgcgctttctgacctgagaataggcaatgaagtacagtaattagcacagcatatttttttcctcaataaaaaaggagagatccgtggaatcaaacagacctcccagcgataacctttccatgttcagcctaatgattctatatccgagtgaaattacctgccagtggagaaaaagacaagtctttacattaaatgctcttgtggaagctagattgctgaataataaagcattaagtcgtagaaacatgcactgaagtttgaagagatactcagtgcacaaactagactgtaaaagactttggggaaataatgcaatcaccgagagactaattgatgacattccgaaaatttatatttgccagaaaagagagatggtcaagacattgcatagcgagtggttttggacgtgcgacggcagtttaagaaaacatgaaacaaaaaacttgagaaatcagaaggtatcccaactataacctttgttttacaaaagaattgatgaaaataaaaacaacgtatctcacagcacgcgtgataatattttcatacgtatgtgataatggagcaacatttgatagagatgaaatgaaaatttctaaatttgacaaaagcgaacaacaaaaattacaccgtagaaaagcgtgggtgacggcagtgacgccctgtctcaagaagtaaacatccgagagatttaaaagtggggagtgaaaccaaggatagcataacattgttaatactagccattgtttcagtgggaaaaggcaaaaataagcggtgtgtctcctagattctcacatgaattgttcaggatatgagatgttgcctctatttccagttatgcattgtatggtggaattgcagttagcacatttggtgccaaaattttaatgctgacgaaaatggacatgttccctgaactaagagggacataatttgggtgtgtctccaggctctctggcttaccaggattgaagatccaggctctagggattttcccaaaatgtcttagacagtaagcaccggggcagaattgaggcctggcgccaaggtctcgaggtgtaaagaaacagccgtggccgcagagcccatgaaattaggatgattttaaggaggatggtggaatgagaggactgtgatgtttggccccgtttcttatcccttgtcttttcatgggccaggtgtgctccatcagaaggctttctgtgcctgatgtaaagtgtcctgggtgaagaaagggcactgcttagagaggtgctccacaggcaggaaggagccaccattttcaggagaatgatccccagaagcatgagcaatccagatgccgtggcttcacacaagacgtcggagggtcttattcctgcagccgggacctgggcatcggtgtcctttaatgctcataactaattttgaggggagcccaatcgataacctgtctgcaagtcatgctcatcacactgtagttttcacacacgtcacacagagaccctgttcgtatgcacatttgggtgcttgagcagggttgcgcccaagattctgtggttctacggagccctgagttgtgacctggacagctttcctcaggggttggtcaactttgatcactgcacctaacaagaaagggaccatgaaatctaatcagcaaatacagaaaaggaaggggccatttcccataataatttccacagaaacaccacgtcggataaataagtctgattgcaggacagggactgtgtttcagagatgcagctttcgcagctggatgaatgacctggaatctccccaaatgccatttgtaaacacaccaaatgaggtttatgtcagggctttctgaatgtattttagatgaatacacacactccagtgtttgatttcctttagtatcaatgagacttagttccaaatgacttccgtgccagtgggaaaattttccggttccactcattggaagtggacaccgtgaaacaggtaagtcggtctgtctgtttcccgcgttatgtgggttccagcaagagcccaagtctcagggcacctgaggtccattcagaaaccaaaataaaatgggcgagccagggtaagaaaggagagcaccgttcctatcttccaattgaattccagtatccactattcaaggtggcgagaatgatccacggatgtaccacatgagcaaaatttcaccttctcttgccgaccaacaactgacgaatgaaacaaaccccaagaggaaatagtaaaccatgtcccctgcaataacctcacacgcaaacctacaggtcaataggtcacattaagaaatacacactgaatgtcatctaccatgaacacaaacacacagacagtccctccagaggttcggaagactcacgaacccaaaacttgatgtttcccatgtgtgggctcatcctgagacgcagccatcactatccaattgtccctgttgtagagacagaaactggggctcctcattactttatgtaggattgacggtgttcgtgtttgtgtgggtgtgtgtgtgtttccgtgcgcgcttgtgggtgtatttgtgtttgtgtgtgtgtgtgtgtgcacccatcagtgtgggtcggtacttccactgtgatcactggcacacaagcagagatctcttgctgtgtttgttattccctttggatctcctggtgctcccttgcagagaagcgagtgtgccagtgttcatggactcctgatctgtcggtttcgtcgaagagaggtttagcagggagctttgctgttcaggatgatggtttttcataccacacttgtattttgattgatgaatcacaagtacgttgggaggcagggtaccttcaacttttctgacgttgaactcaggcttcgttttgttttgctcttgggggaatttccagtggtctaaggtgctttcctgagtggctctttccaccaagtgctcgtccaactcgggtacctggaggcaagggtggtctctcttgagctctccttgcgttgctggcctgtctgtgtcttcagcaccaagggctcttggttccctgcctcttgacacactctcactgtgtctttcccattcactcttctggatgtaaaagaggacataggcctgttgactcaggacagaggtgatgccagaggcagtgacctcggcatcatccattttataccactggccttcttgagctttgacataagagaagtaatgtccgttgtgacaactccacccagcgtggaccagcacagcatagaggacatagacaagaggtcctgtgttctgctgagacatgtatggctgcatgtcacggcacttaggatattgcacattcttggcaagtttgttgcctgtgacatcggagaatctcttcaatacaagaatgaggaccttggcagaagtgggtaaagttaacgtcttggaggcaggcgccttctggagacaaagaccacaatgataggcattctctccattgagttctttgggcttcaccaactgttccaaagcttgcttgacactctgagctgcctggatatccagggcgatgtccaggtaagggtcaaaggtgtctgaaacgccgtggcagtggagatacttgatttgagatctccaatacgctccaaatatttggtggatgagggtggtgtccttggagtgatgatctagctgcttgtgcccgggaaggcatgcctttttcatggcatccacagtaaacatgagaaattcatgggcatcctcctgctcacctctatggaagccagcagccaatacctgtgagggctggatgacatggccaggactgtggagggcccatgtgatgtgagcttgcatagtacagaacatgcagcacttgtgaagatgacacgtttgagagtcctcccgggacagcatgtagttggaaagcggcagtgtgtatgtcaggcactgcagggaaacgttcacatagaaggtatttcctatcttctggagcccagcccccaccgcagcaggtctcctgctactcagaggaagcttctccctgggagcaagctgtcttgccacaggagccaaatcatcacagaggtcgaaacgggtctcagatgagagtggtgacttttcagagagagaagtccgctggatttcagcaaaagctgcatctagccgagaagatgtgagttttgaaaagtgattgaactgccagtcacctcccaaatagagtgagtcgtcttccatgtcgcccgcaacaaggatcacaaggtttttctgctgggaccgcaggttgcagcaagacgctatctcttccaagagagtcttcaaatgacgagctctctggccgcatcagcccttatataactcacccccaccaaccgcgaacaccccacccacccatcaggtgtgcgataaaccaatcaaatatcagcactcaattaaggaatgagtcacagggtgtgtccccttgcatcgctgggaattcaacagacacagcccacatcatgacttctagaacacctgaatcaaattactcctcagggtgataggcacatataatatgagtgtaaccgggttgggacagtggccacacagttgccttattttaggtaaaagaatgtcagggaag

SEQ ID NO: 1931 - DNA, 6244 bp, Homo sapiens
ctgtaactgggtcttccaaattcattcttctggatgtaaaagaggacataggcctgttgactcaaaggagaagtgataccagaggcagtgacctcggcatcatccattttataccactggccttcttgagtttgacacaagagaagtaatgtccgttgtgacaactccacccggtgacgacgagaacagcatagaggacatagaaaagaggtcctgtgttctgctgagacatgtatggctgcatgtcaacgcactcaggatattgcagattcttggcaagtttgttgcctgtgacatcggagaatctcttcaagacaaggatgaggaccttggcagaagtgggtaaagttaacgtcttggcggcaggcgccttctggagacaaagaccacaatgataggcattctctccattgagttcttcgggcttcaccaactgttcctaagcttgcttgacactctgagctgcctggatatccagggcgatatccaggtaagggtcgaaggtgtctgaaatgccgtggaagtagagacacttgatttgagatctctagtaccctccaaatatttggtggatgaggatggtgtccttgcagtgatgatctagctgcttgtgcccgggaaggcatgcctttctaatggcatccacagtgaatatgagaaattcatgggcatcttcctgcttgcctctatggaagtcagcagccaatgcctgtgagggctggatgacatggccaggacggtggaggtgcccgtgtgctgtgagcttccataatacagagcatgcagcacttgggacgatgacacatttgagagagctcccaggacagcatgtagttggcaaggggcggtgtgtatgtcaggcactgcagggaagcattcaagtggcaggtatttcccatattctggagaccagctcccaccgcagcaggtctcctgctactcggaggaagcttctccctgggagcaagctgtcttgtcacaggagccaaatcgtcacagaggtcgacacgggtctccgatgagagtggtgacttctcagggagagaagtccgctggatttcaggaaaagctgcatctggctgagaagatgtgagttttgaaaagtggttgaactgccactcacctcccaagtagagtgagtcttcctccatgtcgcccgcaacaaggatcacaaggtttttctgctgggactgcaggttgcagaaagacgctatctcttccgagagagtcttcaaataacgagttctctggccaaatcagcccttacataactcacccgcaccaagagcgaacaccccacccgcacataaggtgggcaataaaccaatcaaatatcagcactcaattaaggaatgagtcacagggtgtgtccccttgcatcgctgggaattcaacagacacagtccacatcatgacttctaaaacaccttcatcaaattactcctcaggatgataggcacatataatatgatggtaaccgggttgggacagtggccacacagttgccttattttaggtaaaagaatgtcagggaagaaatctttacctatgaaaccgtgtgagtatgtgtgtttgtgtgcgtgtgtgtgtgtgtgtgtttgtgctgggatgtacttccgagtatgtgcttttggcagataccatcatcctttcagcgatagaaggagaagtctgaagtgcgctttctgacctgagaataggcaatgaagtacagtaattagcacagcatatttttttcctcaataaaaaaggagagatccgtggaatcaaacagacctcccagcgataacctttccatgttcagcctaatgattctatatccgagtgaaattacctgccagtggagaaaaagacaagtctttacattaaatgctcttgtggaagctagattgctgaataataaagcattaagtcgtagaaacatgcactgaagtttgaagagatactcagtgcacaaactagactgtaaaagactttggggaaataatgcaatcaccgagagactaattgatgacattccgaaaatttatatttgccagaaaagagagatggtcaagacattgcatagcgagtggttttggacgtgcgacggcagtttaagaaaacatgaaacaaaaaacttgagaaatcagaaggtatcccaactataacctttgttttacaaaagaattgatgaaaataaaaacaacgtatctcacagcacgcgtgataatattttcatacgtatgtgataatggagcaacatttgatagagatgaaatgaaaatttctaaatttgacaaaagcgaacaacaaaaattacaccgtagaaaagcgtgggtgacggcagtgacgccctgtctcaagaagtaaacatccgagagatttaaaagtggggagtgaaaccaaggatagcataacattgttaatactagccattgtttcagtgggaaaaggcaaaaataagcggtgtgtctcctagattctcacatgaattgttcaggatatgagatgttgcctctatttccagttatgcattgtatggtggaattgcagttagcacatttggtgccaaaattttaatgctgacgaaaatggacatgttccctgaactaagagggacataatttgggtgtgtctccaggctctctggcttaccaggattgaagatccaggctctagggattttcccaaaatgtcttagacagtaagcaccggggcagaattgaggcctggcgccaaggtctcgaggtgtaaagaaacagccgtggccgcagagcccatgaaattaggatgattttaaggaggatggtggaatgagaggactgtgatgtttggccccgtttcttatcccttgtcttttcatgggccaggtgtgctccatcagaaggctttctgtgcctgatgtaaagtgtcctgggtgaagaaagggcactgcttagagaggtgctccacaggcaggaaggagccaccattttcaggagaatgatccccagaagcatgagcaatccagatgccgtggcttcacacaagacgtcggagggtcttattcctgcagccgggacctgggcatcggtgtcctttaatgctcataactaattttgaggggagcccaatcgataacctgtctgcaagtcatgctcatcacactgtagttttcacacacgtcacacagagaccctgttcgtatgcacatttgggtgcttgagcagggttgcgcccaagattctgtggttctacggagccctgagttgtgacctggacagctttcctcaggggttggtcaactttgatcactgcacctaacaagaaagggaccatgaaatctaatcagcaaatacagaaaaggaaggggccatttcccataataatttccacagaaacaccacgtcggataaataagtctgattgcaggacagggactgtgtttcagagatgcagctttcgcagctggatgaatgacctggaatctccccaaatgccatttgtaaacacaccaaatgaggtttatttcagggctttctgaatttatttcagttgaatacacacactcctgtgtttgatttcctttattatcaatacgacttatttccaaatgactgacatgccagtgggaaaattttccatttcgactcattggaattggacatcgtgaaacaggcaagtcggtctgtctgtttccggcgttatgtgggttccagcaagagcacaagtcccagggcgcctgaggtccattcagaaaccaatgtaaaaacggtgagccagggtaagaaagaagagcaccgttcctatcttctaaatgcattccagtttccactattcaaggtggcgagaatgatccatggatgtgccacatgagcaaaatttcaccttctcgtgccgcccaacaactgacgaatgaaacacaccccaagagaaaataggaaaccgagtcccctgcaataacctcacactcaaacctacacgtcagtaggtcatattcagaaatacacagtgaatgtcatctaccatgaacacaaacacacagacagtctctccagaggttcggaagactcacgaccccaaaacttgatgtttcccatgtgtgggctcatcctgagatgcagccatcactatccagttgtccctgttgtagagacagaaacttggactcctcattactttatgtaggattgacggtgttcgtgtttgtgtgtgtgtgtgtgtttgcgtgcgcgcttgtgggtgtatttgtgcgtgtgtgtgtgtgcgttcacccctacgtgtgggtcggcacttccactgagatcactggcacacaagcagagccctcttgctgtgtttgttcttccctttggatctcctggtcctcccttgcagagaagcgagggtgccagtgttcacggactcctgatctgtccgggtcgtcgaagagaggtttagcagggagctttgctgttcaggatgatggtttttcatcccacacttgtatttcgattgatgaatcacaagtacgttgggaggcagggtaccttcgacttttctgacgttgaactcaggcttcgttttgttttgctcttgggggaatttccagtggtctaaggtgctttcctgagtggctctttccaccaagcgctcgtccaactcgggtgcctggaggcaggggtggtctctcttgagctctccttgcgttgctcgcctgtctgtgtcttcagcgccgagggctcttggttccctgcctcttgacacactctcactgtgtctttcccattcactcttctggatgtaaaagaggacataggcctgttgactcaggacagaagtgatgctacaggcagtgaccttggcatcatccattttataccactggccttcttgagctttgacataagagaagtaatgtccgtcgtgacaactccacccagcgtggaccagcacagcatagaggacatagacaagaggtcctgtgttctgctgagacatgtatggctgcatgtcaaggcactcaggatattgcacattcttggcaagtttgttgcctgtgacatcggagaatctcttcaagacaaggatgaggaccttggcagaagtgtgtaaagttaacgtcttggaggccggcgccctctggagacaaagaccgcaatgataggcattctctccattgagttcttcgggcttcaccaactgttccaaagcttgcttgacactctgagctgcctggatatccagggcgatgtccaggtaagggtcaaaagtgtctgaaatcccgtggcagtggagacacttgatttgagatctccagcagcctccaaatatttggtggatgagggtggtgtccttagagtgatgatctacctgcttgtggccgggaaggcatgcctttttcatggcatccacagtgaacatgagaaattcatgggcatcttcctgcttgcctctatggaagccagcagccaatgcctgtgagggctggatgacatgaccaggactgtggagggcccatgtgatgtgagcttgcatagtacagagcatgcagcacttgggacgctgacatgtttgagagtgctcccgggacagcatgtagttggcaaggggcggtgtgtatgtcaggcactgcagggaagcgttctcgtagcaggtatttcccatattctggagcccagcccccaccgcagcaggtctcctgctactcagaggaagcttcttcctgggagcaagctgtcttgccacaggagccaaatcatcacagaggtcgacacgggcctcagatgagagtggtgacttctcagggagagaagtccgctggatttcagcaaaagctgcatctggccgagaagatgtgagttttgaaaagtggttgaactgccactcacctcccaagtagagtgagtcgtcctccatgtcgcccgcaacaaggatcacaaggtttttctgctgggactgcaggttgcagcaagacgctatctcttccaagagagtcttcaaatgacgagctctctggccgcatcagcccttatataactcacccccaccaaccgcgaacaccccacccacccatcaggtgtgcgataaaccaatcaaatatcagcactcaattaaggaatgagtcacagggtgtgtccccttgcatcgctgggaattcaacagacacagcccacatcatgacttctagaacacctgaatcaaattactcctcagggtgataggcacatataatatgagtgtaaccgggttgggacagtggccacacagttgccttattttaggtaaaagaatgtcagggaag

SEQ ID NO: 1932 - DNA, 4762 bp, Homo sapiens
ctgtaactgggtcttccaaattcattcttctggatgtaaaagaggacataggcctgttgactcaaaggagaagtgataccagaggcagtgacctcggcatcatccattttataccactggccttcttgagtttgacacaagagaagtaatgtccgttgtgacaactccacccggtgacgacgagaacagcatagaggacatagaaaagaggtcctgtgttctgctgagacatgtatggctgcatgtcaacgcactcaggatattgcagattcttggcaagtttgttgcctgtgacatcggagaatctcttcaagacaaggatgaggaccttggcagaagtgggtaaagttaacgtcttggcggcaggcgccttctggagacaaagaccacaatgataggcattctctccattgagttcttcgggcttcaccaactgttcctaagcttgcttgacactctgagctgcctggatatccagggcgatatccaggtaagggtcgaaggtgtctgaaatgccgtggaagtagagacacttgatttgagatctctagtaccctccaaatatttggtggatgaggatggtgtccttgcagtgatgatctagctgcttgtgcccgggaaggcatgcctttctaatggcatccacagtgaatatgagaaattcatgggcatcttcctgcttgcctctatggaagtcagcagccaatgcctgtgagggctggatgacatggccaggacggtggagggcccatgtgatgtgagcttgcatagtacagaacatgcagcacttgtgaagatgacacgtttgagagtcctcccgggacagcatgtagttggaaagcggcagtgtgtatgtcaggcactgcagggaaacgttcacatagaaggtatttcctatcttctggagcccagcccccaccgcagcaggtctcctgctactcagaggaagcttctccctgggagcaagctgtcttgccacaggagccaaatcatcacagaggtcgaaacgggtctcagatgagagtggtgacttttcagagagagaagtccgctggatttcagcaaaagctgcatctagccgagaagatgtgagttttgaaaagtgattgaactgccagtcacctcccaaatagagtgagtcgtcttccatgtcgcccgcaacaaggatcacaaggtttttctgctgggaccgcaggttgcagcaagacgctatctcttccgagagagtcttcaaatgaccagctctctggccgcatcagcccttatataactcaccccctccaaccgcgaacaccccacccacccatcaggtgtgcgataaaccaatcaaatatcagcactcaattaaggaatgagtcacagggtgtgtccccttgcatcgctgggaattcaacagacacagcccacatcatgacttctagaacacctgaatcaaattactcctcaggctgatagacacatgtaatatgagtgtaaccgggttgggacagtggccacacagttgccttattttaggtaaaagaatgtcagggaagaaatctttacctatgaaaccgtgtgtgtgtctgtgtgtgtgtgtgtgtgtgtgtgtgtgtgtgtgtgtgtgtgtgtttgtgtgtgtgtgtgtgtgcttgtgctgggatgaacttccaagtatgtacttttggcagctaccatcatcctctcagcgatggaagcacaagaagtctgaagtgcactttctgacctgagaatagtcaatgaagtatagtatttagcacagcgtatatttttccttaataataaaggagagatccgtggaatcaaacagaccttccagcgataacctttccacgttcagactattgattctctatccgagtgaaattacctgccagtggagaacaagacaagtctttgcatgaaatactcttgtggaagctaggctgccaaataaagcatcaaatggtagaaacatgcactgaagtttgaagagttactcagtgcacaaagtagactgtgaaagactttggggaaatcatgcaatcaccgagagactaattgatgactttccccaaatttatgtgtgccagaaaagagagatggtcctgacattgtatagtgagtggtttcggacgtgcggcggcagtttaagaaaacatgaaacaaaaaccttgagaaatccaaaggtatcccaactataagcttttgtttattaaagaactgatgaaaataaaaacaacgtatctcacagcatgggtgatactatttccatacttacgtgataatggatcaacatttcatagagatgaaataaaaagttctaattttgacaaaagcaaacaaggaaaattataccgtagaaaagcccgggtgacgggagtgaggccctgtctgaagaagaaaacatcggagacgtttaaaagcagtgagtgaaacagagggtagcataacctttttaatactggctcttgtttcactgggaaatggcaaaaataaaccgtgtatctcctggattctcgcatcggttgttcatgctctgagatgttccctccatttccagttatgcattgtatggtggaattgcagttagcacctttgatgcaaaaattgtaatgctgacgaaagtggacatgttccctgaactaagagggacagcatttgggtgtgtcttcaggctctctggcttaccaggaatgaagatcctggctctagggattttcccaaaatgtcttagacagtaaggaacagggcagaattgaggcccggcgccaaggcctctgggtgtaaagaaacagccctggcttcatggcccatgaaattaggatgattttaaggatggtgatgaaatgagtgggctgtgacctttggccctgtttctttcctttgtcttttcatgggccaggtgtgcttcatcagaaggcttcctatgcccgatgtaaagtgtcctgggggaagaaaggagcactgcttagaaagatgctccacagggagaaaggagccgccattttcagaagaatgttccccagaaacatgagcaatccagatgccgtggcttcacacagggtgttggatggtcttatctctttaagcgggacctaggaattgttgtcctttaatgctcataactgcttttgaggtgagccgaattgatgtcctgcctgcgtgtcatgctcattgcactttaattcacacacatgtcacacacaaacactctgaataagcacatttttgttcttgagcaatatttcacccaagattctgtggttctaccgagccctgagttctgtcctggacatctcaactctttggtaggtcaactttgatctttgtacctaatgataaatggactatgaaatcttatcagcaaatatacaaaagtaaggggccattctccacaatcgtttctctctggtaggtcatctttgataactgtacctaacaagaaatgaatatgtgatgattcctaatcaaaaaatttcttgattttttgccattttaattaattctgttaatgtttaaatagagttttaaacccgagatttggcatgaagtctaatcgtcaaatacacaaaaggaagggtccattcttcaaaatcttttccactgaaagaccacctctgatatacaagtctcgttgcattacagggatcctgcttccaagatgcagctttcacagcttgatgattgacccagaatctcctctaatgccatttttttacacccaaaatgagatttatttcagggcttccggattttattttagctgaatacatccactcttctgtttccatttctttcaaactcttttaaataattatcttgctgcatcagcccttatataactactgtccacccaccgagaccattacatttatccatcaattaccctatttactaataatatatcaggattcaattaagttttttgtcttaggttgtatcctcttgcattcctcagagaatttaatggacactgcttacactgtgactatggaagagttgaagcagatttacttgtcagtattatgagcaaatatgttaggtgtggaaccgggctaggatagtagctaaacatttgccttatttcatatataacaatgctatttaacaattgtgtacatattaaacagtttgtgtgtatgagagaaatattcatggcatttttaatccaagggtttcttgtatatgacatcatttttaaaaaagtcaaaatcagaaaagcttcacaaattggaagatatctaagctaaaaccttttgtttcttaaaggaacgatgaagataattgcaatgtaacacacggcatgtgtgataatgttttaatacatatctaaaaatgccttaaaattcaatagaagtaaaataacaacttctaaaacttgacaaaaggaaacaacaaaaattacacactggaaaagcctggctgactggagtgaaatcctgtctcaagaaggaacagacaaacacacaaacaagcaaaggattctaaaagcagggaatcaaacagatacttgtacaccattcttcctactagcaatcttcatagtaggaaaaggcaaaaacaacccaaatgtgtggtgaattacttcatcagttttttaggatctgcaatactgcctcaattttcagttactcattgtggggagaacctgcagttaccacatttgttccaaaattttatggtgatgaaggtaaacctgtccggcattctcagagggacagaattctggtgtttctccaggttccttggcttatcaggaatgaagatccaagctgtatag

SEQ ID NO: 1933 - DNA, 2590 bp, Homo sapiens
gggagcccttggcccaactggggccctccgctgcttctggagggtctgggctctcaccagtctctttgccccaggtttggggtcacgacgtgccgtcatcttcgtctcctgggggttttgtgaccgcctttttcaggggttgactgttgggccacctgaaacacacacaaacacacacatgtggatggttaagcacgttggatattcacacacccacaggaagccccccgctaactccttgccggtgtggtcatgaggagacctcaccaccagtcggtcaaatctgtggaacacaatgtgctgtgcgcatcctcagatattgtgtgttcctctgccatgattacctagtccaagagtaaacttcgcctgccacagggcctgtggcctaggtatggggagttgagctttcaactccaaactaacaactgattctggagactggacttaggtctattacgattcactccggtagaagacacgatgattctatctcccttgacggacagaatgatcgaagccacagggcatggcatttgtcaccctttggcaggtctgtttgaaatctgggataagggatgcttcctgtcacaacttgaatcgctactcttgccatttcattaggcgacttccaaacacaaattcatagagagaagttatcttcctctctaccacactagcaggtgatggtctttcctgttctatctttttggctttagctccagcccctctttatttatttttctggtattttacacgtgccacacgaattcatctaaacaaacggtgaataagtgccatatcgtatcgacgtcttacaccgctgaagggcaaaccacccttttttccaaagtcctttttccatttacccaccaattcagcatgctgcagtacatttcttttcacattcccatcttggtcttctcccacacgtggagacggaaatgctttctcgttttctgttccaagaattactagtaacgagaacacatcctaccccatcagcaaggcccagtgtgatcggtttctctcggcgtcctttgtctcttcccacccacccctcagggactgcgtgaaaaaaacaactgtacagtgaaactaacctgaaattacacgtctactttctttccccggctggcgctgagatgggcaggtgctgcagcagcccggctggaagcgatgcagcatccaggacgacggaggaaggggcagagagggacctctgctttccaggctgccttttatactgcctctggtcacctgacgtggaacgtaccctaacctaatcagttacatgaggcgcttggaaaccaccgtcaattggaccgcactgggaaacacagatgaacaaagtcaacaccgctttgtcctgcagtgcctggctcctttttcagctcgtcttgcgactccaggtattggagtccagggaggggtacgtcgcctttaccctgtgcttgccacgatcttgtctccttaatcctcactgcagttctctgccatagagtcttatactgctttacatgtgggaaactgaggctcagagagtttcacagcagggcagggagcccagatgtgaatctgtagataccaaactttctaatttttcagtagtttccaagcatcttttatttttcttgtttcttcgttggtgtctttttttttttttttttttttttgagacaaaatctctgtgcccaggctgaggtgcagtggtgtgatctcagctcactgcaacctcgacgtctcacattcaacaattctcatgcctcaacctcccgagtggctgggactacaggtgcccaccacacccaacttatttttgtatttttagtagaaacacggttttgccatgttggccaggctggtcttgaactcctgacctcaggtgatccacccgccttggcctcccaatatgctggaattattgatatgagccattgggcccggtcatgtcattggtgccttaaccaagcctcttttaatttttcaaacggaagagcccctgtccctcagttacggctgctgagccctttcaaggtgagtcagtgaggagggagaaaagcggaagtggtgtgggaagaggcggggtctgggccagctgctggtcctgctctcctccctcctttggcctctaggctcccaggagtggtttcgaacctgcgccatgtgctctggaggctgtggcaaggcaggcgcggcttggaacccgcaccatgtgctctgggggctgtggcaaggcaggggcagcttggaacctgcgccatgtgctctgggggctgtgccagggcagggggagtcctcgtgtcccctgcgcacaacacagacagaaggctgggtccacccagtgggcggtcgggtgccaggccagtgcttaccccgccatgtttgcagcccgaggccagctggctgcaggtgcaggactaggcgtcaggggtcagggtgcacacatccctgcaggtctcggggctcctgggttgcttctggaagggcacagatgggacctgactggagctgcagaggggtggagcttctggggaaaggatccctcctagggggagtgtcttgggcctggggccacgtggcagggacagag

SEQ ID NO: 1934 - DNA, 1212 bp, Homo sapiens
gtacattgaagagttggtctaatatttggcctggtggatggagaaattgcctgtctgctccgctctggttgaagaaaccagtctgactgtctctgaggctatggagcagtccatgaagaatgaaagcccttggccaggcacattggctcacacctgtaataccagcgctttgggaggccgaggcaggtggatcacttgaagtcacgagtttgacaccagcatggccaacatggtgaaacgctgtctctacagaaaatagaaaaattagctgggcctggtgacacgtgcctgtaatcccagctactcaggaggctgaggcaggagaatcacttgaacctgggaggcagaggttgcagtggggagctgagatcacaccactgcattccagcctgggcgacagagcgagactctctcaaaaaaaaaaaaaaaaaaaaaaaaaaaaaaagaatgaatgtcctcatgatggcctcaagcacattggtccctgaagagagccaaggaaggcccactttactctgcactgcaaagcaggcaggtggacaggatgagaagtggattcagtgacaggcattgacccaaaggattttctgcctaatggtcggttcagcagaagattaaactgagcacagcatcctgttccctcaaactgtctgatagggtctctctctctgccacccaggccagagtgcagttgacgcagggcaggggagccccgaagtggagcatagtgtgtccggaactggtgggttcttggtctcactgacttcaagaaagaagccgcggaccctcgcggtgagtgtcacagttcttaaaggctgcgtgtccagagtttgttccttctgatgctcggatgtgttcagagtttcttccttctggtggttttgtggtctcgctggcttcaggagtgaagctgcagaccttcaaggtgagtgttacaactcttaaggtggggcgtctggagttgtttgttcctcccggtgggttcatagtctcgctggcttcaggagtgaagctgcagaccttcgaggtgagtgttacagctcataaaggcagtgtggacccaaagagtgagcagcagcaagatttattgcaaagagcaaaagaacaaagcttccacagtgtggaaacggaccccaatgggttgccactgctggctggggcagcctgcttttactcccttctctggccccacccacatcctgctgattggtc

SEQ ID NO: 1935 - DNA, 534 bp, Homo sapiens
cacctctacgtggaagttaccatcatcacacgagagatggtgggtgaagccaaggcttaaggctggactgcagtggtgtgatcatagcttactgcaacgtcgacctctgggctcaagtgatcatcctgcctcagctggccaagtagctggaactataggtatgagtcaccatgcctagctaattttttaatttttgtagagacagcgtctccttatgttgcccaggctggtctcaaactcctgtcctcaagtgatcctcctgctttggcctctcaaagcactgggattagggtgtgagccattgtgcctggccaagagttttgtaatatttgtagagcatgcagtattgggaccatttgttgtggggtatataggtggtaaagattttggagatagataagcatgtttgggacttctttgaaatctgagatctagtttttttttgttgttcactgaatctccatgtgccaagtgcctgatacacggtagacttgcaacaaatgtttgttgaatgatttaatgagtaaataaatt

SEQ ID NO: 1936 - DNA, 216 bp, Homo sapiens
ctgaactaatgcggcagaaatgaagactcaatttatatcagcctacattgctgaggagtgtgggagagaatatgacagccacacacttcaaaggtggaaaatagagggacaagtgttagtttacttgccaggagaggtctgaagcctactttggaatgcagggaagcagatgccaaggggataggagggaagaacacttgtgaaagatgaagggga

SEQ ID NO: 1937 - DNA, 747 bp, Homo sapiens
attgttttgttttgttctgttttgttaaaaaccatgtattgaatttaaattttagtaaagcaagcattacataatgctttaaaattttaaaagtcggggataaaagtttacatccaaaaagatgaatggaaaattgtgctttcagaatgtagaataagttttcttacagggttaaccatttcatcttgccattggatactgggaatttcatttatgtaatgtatatatgtgcagttcatatccaggtcctgcaaaaatctaaaactgtgtgcttcacttcgcgtagcaaaggcacctatgttattctccctttcgagcaaaagtcatgatccagttttcctgctgacgacgctttttccactgctgtgtcaatcacaccctctgtgttgagcagtacagtaaatcacaagagaaggtggtggcgaatccctgctcacactggaagttgctctgtggaccattcgaagaagctctggactgatcacaagggaaaccgagcagaactgtgaagcagacggacaggaacaaaaggctattctggtgtgaggagaaatcagtcacttcagctccacaggcagatgttgctactggactgacaagtggaacctactcctgctggagaaagaagtcactggtcccagaagaagaggtagcacaagaaaaggaaacccaagaagcaccagagagaaagcaaacaaccaagaaaggcaagaacacctcacattgagaaaaagaaagtcaggcagg

SEQ ID NO: 1938 - DNA, 758 bp, Homo sapiens
tatgccacaggtataagaggaagcccttacctgagatcttgggatggctctgctctgatgtgcggcgtctccacagagtgcccaaatacggctccttcagtgcctgggggtagcatgaatatagcagtcagtataagcaagtccacacagtggctttcatctctatgtttatgcatcaaatattcttccaaaacagagaaaacttaaaacaggtacatatgatgtattagtccgttttcacactgctgataaagacatatccgagactgagaagaaaaagaggtttaattgcacttacagttccacatggctggggagccctcagaatcatggcgggaggcaacaggcacttcatacatcgcggtggcaagagaaaaatgaggaagacgcaaaagcagaaacccctgataataccatcagatctcgtgagacttattcacgaccgtgagaacattatgggggaaaccacctccatggttcaaattatctcccaccaggtccctcccacaacacgtgggcattataggagtacaattctagatgagatttgagagaggacacagagccaaaccgtatcacaggatatgaatgagaagaattggaagaatatcaccaggcagggaagagtcaatcaagaagtcactggtcccagaagaagaggtagcacaagaaaaggaaacccaagaagcaccagagagaaagcaaacaaccaagaaaggcaagaacacctcacattgagaaaaagaaagtcaggcagg

SEQ ID NO: 1939 - DNA, 2566 bp, Homo sapiens
cccaggcaaacaggatgtggagtagacccccagcaaactccagcagacctgcagaagaggggcttgttagaaagacaactaacagaaagcaatagcatcaacatcaacaaaaatgacgaccatgcaaaaattccatccgaaggtcaccaacaacaaagaacaaaggtagataaatccatgaagatgaggaaaaaccagtgcaaaaaggctgaaaattcaaaaaaccagaaagcctcttctcctccaaaggatcacaactcctcgccagcaagggaacaaaactggactgagaatgagtttgatgaattgacagaagtaggcttcagaaggtgggtaataaactccttagagctaaaggagcatgttctaactcaatgcaaggaagctaagaaccttgataaaaggttagaagaattgctaactagaataatcagtttagagaagaacataaataaatgacctacctgatggaactgaaaaacacagcacgagaacttcatgaagcatacatagtatcaacagcccaatcgatcaagcagaagaaaggatatcagagactgaagatcaattttatgaaaaaaagcgtgaagacaagattagagaaaaaagaataaaaaggaacaaacaaagcctccaagaaacatgggactatgtgaaaagacaaaacctatgtttgattggtgtacctgaaagtgacagagagactggaaccaagttggaaaacacacttcaggatatccaggagaacttccccaacctagcaagacagcccaacattcaaattcagaaaatacagagaataccacaaagacactccttgagaagagcaaacccaagacgtaattgtcagatttaccaaggttgaaatgaaggaaaaaatgttaagggcagccagagaaaaaggttgggttacccacaaagggaagcccatcagactaacagtggatctctctgcagaaaccctataagccagaagagaatgggggccaatattcaacattcttaaagaattttcaaccaataatttcatatccagccaaactaagcttcataagtggaggagaaataaaaccctttacagacaagcaaatgctgagggattctgtcaccacgaggactgccttacaagagctcctgaaggaagcactaaacatggaaaggaataactggtaccagccactgcaaaatcaaaccaaaatgtaaagaccattgatactatgaagaaactgcatcaactaatgggcaaaataaccagctagcatcataatgacaggatcaaattcacacataacaatattaaccttaaacgggctaaatgccccaattaaaaggcacagactggcaaatgatacagagtcaagatccatcagtatgctgtattcaggaaacccatttcatgtgcaaagacacacacaggcttaaaataaagggatggaggaagatttaccaagccaatggaaagtaaaaaaaagcaggggttgcaatcctggtctctgataaaacagagtttaaaccaagaaaaaccaaaaaagacaaagaagggcattacataatggtaaagggatcaatgtaggaagaagagctaactatcctaaatatatatgcacccaatacaggagcacccagattcataaagcaagttcttagagacctcaaagagacttagactcccacacaataatagtgggagactttaacaccccactgtcaatattagatcaacgagacagaaaattaacaaggatattcaggacttgaactgagttctggaccaaacggaactaatagacatctacagaactatccacccataatcaacagaatataccttcttctcagcaccacatagcaattattctaaaattggccacataattggaagtaaaacactcctcagcaaatgcaaaagaatggaaatcataacagtctcccagaccacactgcaatcaaattagaattccggattaagaaactcactcaaaaccacacaactacatggaaactgaacaacctgctcctcgatgactacttggtaaataatgaaatgaagacagaaataaataagttctttgaaaccaatgagaacaaagacacaatgtaccagaatctctgggacagagcaaaactgtgtttagagggaaatttatagcactaaatgcccacaggagaaagcggtaaaaatctaaaaaatcaacaccctaacatcacaattaaaagaattagagaagcaagagcaaacaaattcaaaagctagcagaagacaagaaataaccaagatcagagcagaacttaaagagacagagacacgaaaaacccttcaaaaaaaaaaaaaaaaatcaatgaatccagcagctgttttgaaaagattaacaaaatagaccactagccagactaaaaaagaagaaaagagagaagaatcaaatagacaaaataaaaaatgataaaggggagatcgtatgggcatggtggctcacacctgtaatcccagcactttgggaggctgaggtgggtggatcacctgaggtcaggagtttgagaccagcctgaccaacatggagaaaccctg

SEQ ID NO: 1940 - DNA, 870 bp, Homo sapiens
gtaacttcagggcatgtgtttggcctgtctctggcatggttctgatggatttgtggtgagtgccctgcatgctcttgtccatatcctcccagcgtaagaaggatgggtgtctaatgaggctggcagtggcaatccaatattctgactgtggaactggacaggtctgagagtctcacaggtggtcccatccgggctgcactctgtgggctcatcagccatttttgtgcttgtttacatttcatatcacagatgcccaagacagtggtgaagaatttttttcctttccaactttttaggaggttcctgtgctgatttgtcacatgggtaaaatgcgtgttgcgggggtctggtgtgcagattcttcggtcacccaggtgcagagaatgaggatcagaaatgttgaagagtttgcccagagatccagctagcaaatagccagcttcagggctgataggaccgtcattgtccctgaccatgacccgtcacatggccagctccagatggattggaaggtctgcgggaactagctttggcctaggccaagatcatccaaccagaccttctcctgcttcctatttaggagaacacagaccccaggtgtcccactgcagagtcccagtgtatgaaggtcaacccagtgtgagacctccagcatataaaatatggatggaaatcacagcttcagaagagcagtgaaggatacaaggaaaggaaatgggattaaaaagaaaactaacaaaggggaccttaattctatatggcagattttcttttctgagatggagtcttactctgctcccaggctggagtacagtggctccatctaggctgactgccagctccgcctcctgcgttcaagcaattctcctg

SEQ ID NO: 1941 - DNA, 1530 bp, Homo sapiens
gccaggcacagtggctcacacctgtaattccagcactttgggaggctgaggtgggcggatcacttgaggtcaggagtttgagaccaacatggcaaaactccatctccactaaaaatacaaaaactagctggatgtggtggcacgcacctgtagtcccagttactcgggaggctgagacagaagaatcacttgaacctgggaggtggaggttgcagtgagctgagattgtgccactgcactccagcctgggcaacaaagccagactccgtctcaaaaaaagaaaaaaaaattaaaattagccaggtgtagtggtgcatgcctacagtcttagctacttgggaggctgaagctggaggactgcttgagcctaggagttcaaggttataatgaactatgattatgccactgctctccagcctgtgtgacagagcaagaccctgtctctataaaaaatttttttaagtagaataatttatgggttacagagcattataataaatactatttcatttgatccttacaatatccagtgagggaggctaaaaccaaaaattaccttatccacattttacattgaagaaacaaagactcagagaaataaaatgaccagcccagttgacatcatgagtcttaaaattccaatcccaggggaattttcattacaccagactatgtaagtcatccaaatatggtaatatgtaaatgtacctttggcatgtcaaaaagcaatataaatatcatcataatgaaattttggtatgttaatattttctaagctccagcaaatgattcactaatttatataaaaaaaattaagtggttcctttcatttcacagagatatagcctaactaagatgggtacagtttgagttattttcagctattatcacaaagaaactgatgaggtaggttaaaatgtagtaaatttttctaatttgaagacattcttaggatttttataaatctgctctaagagcagcagaaaaagaaaggttgatttgaagattcatttactcagctggtccacaaagatctaacagcataagactaaaaggagtctaattactcacttctaagaatcactgttcatcttctaaaattaattaaaaggattggtacatgtctgtacatatatttctttaattataatagtgatatggactgttatctatgcaaaatatgtttcatttggtgtactttacatatttattacctgccacatattattctggtaaagcagagacttcatttcacataggttatagatctttcaaatttctttgatgtgagactcagtactagggtaaaagcaagttgtgtgacatgaattgttcatttaaatatttattgaaaaactgtgtatgaatccctgtgccagctgagttattaaccaattgttctttgaaacaaactgttttgagtttaatattatcttagatcttttgtctagttattgaataaaaaaagttgctgaaatcaaagtactttttgaaaaccttttgataatatattaacatgttagagagaac

SEQ ID NO: 1942 - DNA, 1367 bp, Homo sapiens
tttttatttatttattttagagacaaggatctcactctattacctaggctggagtgcagtggcacagtctgctcacatggatcacttgacctcctcaaactcaagtgatcctcccgcctcagcctcttgagtagttgggactataggcataagccaccatgcctagcttttttattttttttaactttttgtggagacaggatctcgctgtgttgcccaggctggtctcaaactcctgactcaaaatttaatttttaattgtgaatagaaaaaaatatatttttgaatttctgaaactgacagtgcaaattagcgtaatcattcgaaattggaatgattttggtaagaatactcatgactaaacttggaaaactatactgtagcagatgaaacattgagcttttgaaaaggagaacataaataccctatttctgttaactgctatttattcatttttcaaccccctggtgatcagttcagaatgttgttgatcatggaaattttctagataaaagaaatgagaaattacaagacagtctttgaaattctttactggttctaatgtattctctttggacaggctctgatatgctaagtaaatggcctctccaaactacacaggtactatgtggggcagcagtgagataccttctaaggacttgataagaagaaaccaccagagagtctacacatagtgaggagagtctcaatgcttcccagattctgactgcgtagttaggatggccgggtgcagtagctcacacctgtaatcccagcgctttgggaggctgaggtgggtggattgcttcagcccaggagtttgagaccagccagacctcatctttattaaaaaaagaagaagaagaagaagaagaagaagaatcagaatttctgcagtatagttccaggagctgccaaacagtggtataaggaaatgaattgcctgggcctcaacatatcctcagtgtcagtgacacatgtatactttcaaatgaataacctctttttatgaagattatactttggcatcccttatctgtaggctagctgtgcttgattttagtagaatagatttttaggacttaatcatcattaatgtatctgtattagtccgttttcacactgctgatgaagacataccggagaatgggcaatttacaaaagaaagaggttgactggacttacagttccacgtggctggaaggcctcacaatcatggcagaaggtgaaaggcatatctcacatggtggcagacaagaaaagagggcttgtgcagggaaactcccgtttttaaaaccatcggatcttgtgagactgagaccaagaccaactcactatcacaagaacagaacaggaaagagtcaccc

SEQ ID NO: 1943 - DNA, 485 bp, Homo sapiens
ggaaccaagtctgcagcatctccgagggatgctatacagagaagctgtctcttcgcagttcttctgggtgtctgaaaacatatccaccagaaacaccaagttgaagtcatgttctcgcctctgcccgtttctggtggctctgctggccatttagaagcacgtgggaatggcacggctcggccttcctttttgctcagaagagaagtttgggttgactttaagcatttggcccaagttcctaacttggaattaacgaccatgggcagagttccacgtgaatttctcaactggacaagtggaacacaaggacccgaattttctcttcccctcagatcgtccatagatgaaaaatgaaggcccagaggattaaatacagacagaatttatgttcctaatactgatgccaaggacaggaagaccttgactagtctcgggaggacgccctgcctgaagtaccaacccttctgcagtggtgagtgactggc

SEQ ID NO: 1944 - DNA, 348 bp, Homo sapiens
ggggaggggaagggaagggaaggaagaaaggagggagaaaagaaaagaaaagaaaaaagaaaagaagggaaggaaggaaggaaggaaggaaggaaggaaggaggaaggaaggagagatagcaaagtggctcatcaataaaatgtatattttcttcaacctagctcatctttcacttaacactcactcactactgatctatttgcacagcacggattttcattcttctgtgagaactactggaatatacaggctgatgtttctttttttttttttttttttttttgagatggagtctcactctgtggcccaggctggagtgcagtggcacaatctcggctcactgcaac

SEQ ID NO: 1945 - DNA, 525 bp, Homo sapiens
cggctacagtaagctgagatcgtgccactgcactccagccagagtgagactctgtctcaaaaaatcatcatcatcatcatcaacaaaggaagaagagaaattctcattgctaaagcagagaattcataaagagggtatcacagggacatgaaatttccctttggtatagattttttaaattgtaagatatagagagagcaaagctgatagaaagccttcatttttctacggctacagtatcatcttaacaaaggaatttcccataagagctctctcctaaaggaggccagtgtgtttttaggtgagccctggccacatctggacgatagagatgaactgtgccatacaggaggtggaacaagagtagaggaaaacaatacaaatgacttttaacatttggaagcctacttttagagggaataccaaccaaatgggaccaataaaatgataaaataagaggagtgattgaaaaataatttcagcacaatctttaatctatgaagagctaagagatggaagacaggg

SEQ ID NO: 1946 - DNA, 228 bp, Homo sapiens
ccccggccccggtgcgccccatcactccctcccaggaaaggccgagttgcgccgcgaagaccaccaacgccgccccgcgcgcctgactcgccaggcagcgcgctctaggttcttccgccggccggctggtccgacttccacgttagcctacggccgcgaggtgaaaggggagcgtggtagggagagattgcagcatatgggcaggtggacgggattactccaacagag

SEQ ID NO: 1947 - DNA, 1844 bp, Homo sapiens
cagtgggctccacccagtttgaacttcccagaggctttgtttacactgtgaaggaagagtgacctatgggatccatggaggagctgcttcctgaatctgtgtaaagtagatcttgccgtgtgggtaactgtgactgcggtggccatgaagaggcacaactcagacctcggatctcctgctgcagagaacattgactgacagcccagcagctcctgtctggatctaccacctgttcacaattctgaaatacattcaacgcacactttcctactgagatttctaaaatgggacttggaaaacagaaaaatactaaagtggggtactatcatctaaatctccaaaaaggtcattcaactctgatccctgtttaaagagagaaaaaaggaataaaggagcctttgaaggcagaatattgctcactcatctctttgaaaggacctcagactgcagagcagaagaaccactggctacatcagctggggcagagggggatgaagagaacatcatgatgcctgcaaaaaagtgggctctgcaggatctccagtcacctcccttcccttcagatccagagctctctctggctaggaccttccagagttccagaatttttgttccaccttccattgctcacttctattactattactaagatattcacatggaattctgtgcaaaccattttttttttcttttggtgccctctttgttttacttcctctattgggactaatggccatctgacttgggggtcctttgttttttgtgacaaaccaccctcagcagatttccttgaggtccatttgctcaagggccttaaagctttttggagtaatacagagtaagtttctagacagcctcttgtgctctgcagtaagctaaagtggaagattaagatgcctggtgtatactgtgtgtttcccatgtaatggcagaaaaggaatggggctcattagttactttaaggtggcagcagctaccttagagaagactgcattgcttgtactgattcaaaagagcacctaatgaagggaaaaagcagaaataagccaagacttgagctgagtgattcgttgaatcagccaaggataatgttcttcaggcactatgcacatgtcactgatcagtagcgcttctcttaagcttcaacagcactcacttcccctgtcttgatgaggtgagcagcacatttaatttcagctcctggggccatctgcaaacctctactccattcctcagctgtgtttgctcctctgttctcagggagcagcattttcactggatgcaaactgtgaggcactgtctgggcaagcagattggttactaatgaggaaactggcactgacagccttttgggttctgattgaagaaaagagatgtcttcgcatcagaatggtttaactttcaatgtggcatatcaactggttgaaattagggagagagagaaagagaaatttaattgtcaggctgtggtgcgtagtgtcaaagctacctagattatgagaaatacgtcttttcaacagcttaaaggccacagctctcaacattttttctgcatgtacaacacagacaggatccagaaatcccagcctataactcttggttccgtcaaatactcaacagagaaaacagaagtatttgattgtggtattaactatgaaatgttccctattagccatatgattctattagctcagctcattcctgttagatttatagaaacattagagataattggaattagaagggccaagagagacgatccaatcccatatagagaaaagcaagacccctgctctcactgaagaagttttaaaaataattaaacaacaaacaaacaaattgag

SEQ ID NO: 1948 - DNA, 1400 bp, Homo sapiens
gctcagagggttgcctttgttttgccccctccacactagaacagcctcacagtgcttatcagaagcattacctgcagccatctggggctggggacggcaaacggggcaagcagcaaacagaccaaaaaacttggaaaggaaataactgggaggaagatacgtgggagagagaaggctcagaagggcccttgtctgtactaggtagtccggaaggccacacacatgcctaacactggacacatttttggaaaagacctgagaggactctaggcctgcacctctgactgatctttaggctccacagaagtaggaggtggaagctaaagcagaatttaggtgacctggctaagcgctgaaggaatgcccaagtcaggacgaatctacaaagcctgggagaattaccatttttaactttttattttattttattttttttaaatagagacatggtctcgctttgttgcctgggcttgtctttaattcctggcctcaagaaatcctcctgcctcaacttttcaaagtgaaacagtatcttttgttcttttggactcatgacagttaaggaaattaagtgaaatgctgtgtcttacaggattgctttggggaacctatttggctttctctgattggtcccatgttggaagagggagcaaaatgttgggatgatggcagtaactgagtaagtcttgaccattctgaatggatcactggggagattgtggtttggcttccaggagtggttgctgcagagggtctgggtgagagttctattgtcacagaagctcgtccattgtccgtgtgtatgcctagtcccagagttgtttccagtttctggctgctagacttttacatttcacaatgaagtgtgattttagaaataatatgaactcttgcctgccagaacaagggccagtgaattttaaaggaaggaagcacaatctagaactcgacagcaagggtcaaccatgaaaagttaggtatgaatattgttaattcctagagcaagaattttttcaaaaatatagatagatagccaatagaatactaaattactctatttggaatactaataaacccagaaacaaaaagtagtgaaacaaaaacaaaatcacagggacaaacagaagaaataaaatggtacacctaaatccaaccacatcaataattatatcaaatgttaacggtctaagccagaaggtgcgtggcaaacttcttctgtaaagagccagatagtacatattttaggctttgcgggccatacagtctgtatactctgcctcaaattagccataggcaatatataaatgagtgggtatggctgtgttccaataaaactatatttacaacaacaaacaggctggatttagccacaggttatagtttcctgacctttgctgtgg

SEQ ID NO: 1949 - DNA, 1415 bp, Homo sapiens
ctgtattaggccacaaaacaagtttcagtaaatttaaaaagattgaaatcatgctatgtatcttctccagtcacagtggaatgaagttagtaatcattaacagaaggaatactggaaaatttacaaatatatggaaatttacaaatatgtgggaattagagaatacttagaaataaattaaaatggaaacaatatatgtgacttaaatgatgcagtgaaaacagtcctgagagggaaattattagcaataaacatctacattaaagaataagaaaggcctcaaataaataatcttactttacattttaaagaaactagaaaatgcaaagctaccagaaaaaaggaagtaaataaagattagagtggagataaatgaaatagagaataggaaaataatatagagaattagtgaaaccaaaagtttgattctttgaaaagatcaatgaaattgacaaaccttttgctagactgacaaagaaaaaacacagataggtataactaaaactagacgtgagtgtggggacattactactgaccttaaacaaaaaggattaaagagaatactgtgagcaattttatgcacagattagataacctacatgaaatggacacagttttagaaatacgcattactaaaactgactcagaagaaacagaaaatataacagacttacaatgatgaaaactacaactgagatgaaaaatatacggtatgagattaatggtaaattagacattgcagaaaaaattatgaatgaacttgaaggcagagcaatagaaaccatccagaatgaagcatagagaaagaagaaaaaaaagtcagtgagctgtgggacacactcaagcagccaaatagatgaataattgtagttctcaagggacataatatacagaagaatatattttaagaaataatggccaaaaatgttttagacttaagccataaatctacagataaagaagttgaatgagttttaagtataagaaacataaaactacaccaaggtatagcaggtcctcaaataatgtttctttcaacatcattttgtcataatgttgatgagagaaaaagaattgattcctggctggggccagtattggtgtgatgttttcatgttcttcccatgtctgcatgggttttctttgggacttcagtttcctcccacattagggagatgtgagcattaggttaattggcttctctagattgttccagtatgagttagtctgttgtgtgtgtgtgtgtatgtgtgtgtgtgtgtgtgggtgtgtgggcacgcacgcactctagtgtggaatagcattctgtctaaggctggtttctgccttgtgccctgagcggctaggatacgctctgaccacctgtgaccctgaactagaaaaattgggtgaataattatcttacttgtttttat

SEQ ID NO: 1950 - DNA, 1292 bp, Homo sapiens
cagtgatcaaggagtcaagaaggaccagcatcttgtagcccttctccatcactgggttaaagagagaggaatgaaaaccatttttcccccagaagtttgggtttcttttcagcattctaattaccttattcattttttggaaagacacataatatggaatgcttccatcaatcacgcactctgcagtcctaatcagggtttttgcttcctcctcccccgaagagctgtgaaggaaaaacaggcgtgttcaaaaatcaccattgcacaattctagtgggagaagatgtggcttcttagccacacacatgaaaaagtttatagttacctgaagacacaacttaagaccagacacaatctgatgctcacttctgataccatgggttaagtaagacattgatggactggagtgtttagaagacaggaactaggtgagggaagcttacaaactctgactagtctgtagatggaaaaactaaagccagacataattattgttttgaaacttttggagggttgccatgtagaaggcagaagagatgtattgtgcattacccttggagggttgaagtgtgatcaatgataaaatgttagaaaaggagactgatattcatgtttatataaagacagattttatagttagactgggtgacatggatttatgattatataaagaaatactttctatttatactgggtgacatgaatatttaattttatatcctaaaaattagacttgtccaaaactgtattggctgcctccggagggattttcattattgcttgtgagatattaaagcagtgcatagatatgtagatatacaagtcatagatttcactaaatgatctccaggcatcctttaacattctgaagatttagagtcccatgagcataagcactaaatgatcttcacttggtttaatttcaaaataagatccaacttctaaatcataattttcactgaaatatactcaatcaaaccattcgtttctgtacttgctgtcatattatgatataaagctatttactcaccttcaatcttagtgtttggcacataatggaatctgcatttgtatttcttagaagaatgaaaatttttgaattacagaaattatttggttctagtactcagattttgatataaattatgaatgcacatatttatgggccagagcaagcaaatctacaagtgttattgttttgcacaagaaaaaaatgaaaataggatgcattataaatatctaaaaatgggatattgttgtaccagtagtgtattcatccctcatgccctggg

SEQ ID NO: 1951 - DNA, 527 bp, Homo sapiens
cttgggagggcagggctttctctgcttgcggacatcgcgaagggcctctggcaggcgccgccgggtggcggcgagacgcctccgcgcctccggggttccttgttcgctgtcggaggaggaccggctgagggatggcctggtggggagggagccctcgggcaggtggctgcgtcgggcctggggcagttgtgctgcgcttggagacctgcccgccctcggggcctgtgtgcacagggaggataggctgtttatctctgcaggctcaggaaggcaggtagctggcccgtcagtcatccgccctgcaaagcgctcccgagagaccccgtagagcgggccagcgcgcgcctggcctgaggtttcccgcccccggaggccctcacatctccccgagagtaaaaaaatctcactgaagaagagtaggcctttcgtttagcaactgtgaagaaaaccaaccacgctgcacctctcagttctgtagtcagaagtccaacatggttctcaatggcctaaaatcaaggtgtccacag

SEQ ID NO: 1952 - DNA, 1345 bp, Homo sapiens
ggtttcaaagaatcatagccttgtttcaagaggtcctgccaggttttaaggaaacatgcattttctgtacattggaagacaagctattccacttgagctggtactgcagatgtgacctcaagaaatttggttaatgaaaatgctgcatctctgatctgcatctccactttctccagcaggtctaccatttggcccttgttcctgctcagaactggccagcccaaactcactggttgcgtgggaaagatgctaaaaggtgtttgaagatgaggaagaaaagggaagttctgggagctggtgaagaaacccacaactcctcaaggtcagccatggggaagagctaggagctcagaatccaaccagcaagaggacattttaaaacagctctggggatgccaggcaagaaggagatgacggggtagataatggttactttgtaattttctggaagatcatgctggttctactagaagacttttacctcacatgattggatgctcctcaagctgaacttcttccatttgtgatagtatttggaccatttctagaatatgttataagatttttataagattgtctttccaattaaagttttaggttaaagttctcatttgaatcagattatttcaaatataagaaaatttgtgataagcattgaagatagaaattggcaaacatatgtccctctcccagagataacaggtggtaggttattaagagttacttgttgagctgagcagtggaggcatacatgaaggaatgatcagttccacctgggaaagcatgggaaagcttcagaaagaatgaaacacttagattgaagaaaaagaataaatcagtaatcaacaataatttaaacaactaaattttaatgttgccccttgccttaactttcttcatgtaaaatatgaatatgaaattagttcacttttagaacagtatcttaagtaacaatgacctctcccccatttagaaaattgctgcctttcaagaaaaatgtacttcattcttaccactttttatgtgaaggatgcaaatcaaaccccagattattcccaatacaaaacgatgatttagcacctttctcaaatattaactttatgggtctatgactgcatgtatttttatatttagacattaaaaactgttagaatttataattatcaatacacctacttgtttcattgtcttgtcctacgatatttccatagattctattatttggtcagaatcaaagccaaaagatgtttcacaacaaatgaaatttagaaatcaaagaaaattctgccatatcatcctgaatgcacccagaatgcatggtgattttgagtacacaaagttgggc

SEQ ID NO: 1953 - DNA, 2507 bp, Homo sapiens
gtggttatctcttccctgtcacaggttggcttccctaggaagctgactctgaaatggagattagcatacaggatgtttatcagggagtattatgggcataaacacatggaaaaagaggaagcaaaattggacaaagggagaattatagtcttgatgaaggatacagttgatcttagggaagttctaaaattgacatgaccctttagaattgtctcaagttgtgggagaaaggcagacttcatatctttccttgatgagtcattgggtatgggctgcccaaggaagggggcaaaatattgggcaaggggtgtgtctccaacaaagacattttctgtagaaggctaatagcggagacctgccttagggaagtacttatagaagtttaaaaaacaagccctttatttctacaagggatctgggcagcacactatctatgacaaacacattccattaattccttagtttttgataaagtttagaaatatttttggaatatttttatttctgtcagttaaaagagaaccaaccttgtaactaagactgacttaaattttaccttggtccctggctagttgtgtaatttggaataaactcagtaattattctgatacccattttttcttatataaagtgaaggagactatatttgatatataacaaaattctaatatttataagtaaaattgtgtggggtgtgtgggggggtggagagagagagagagacagagagagagagaggaagggagatgagccctattcagttaaaatgaagaaaagtaactatatcaactcacaacagattagcaaatggtggccctgtatcatattctacaaagtaagggcagattgtcagaggcactgagttagttttacactgctacataataagccaccagacttcatggttcaaaacaagctacatccatttattagctcagagttcagtagttcagaagtccagccacgtttcagctgggttctctggtcaaagtcttacaagactgaaatcaaggtgtcagtcagactggagtctcatttggaatgtgaagtcttttttcaaacttatttaagttgttgacagaatttagttcattgtagttttaggactgagacactcagaccctaatgatgattcaccttcacggaaattcaaaatatggctatttgctttcttgtttgaggccatagggagaatgtctctctgattctttgcattttaaaactctagacccccatttgatacctcacctgagtaggacagactctgattagataatttccgatctgattaacttaactgaatgtggaactttaattatatctgctaaagtctctattgcatataatagaacataatgatgaggttgataatgcatcatatttacaggcttcacccgtactcaaaagcagtgcattatacacaatggggtagaaatctcaaggattgtcttggaattctgcttgccatgggcacacagaaaatctcagcgataaagaggctgttggaggtagagaggttggtccacttgttctgtcatgtaataactcttagatacaggaaagaccttgtaattaaacattttccatctgagattaacacagaaatccctaaccaataattcaacttgacaagaacagattagatatttttcctgtgctgagtatggatgtagagttgtgaaatggaagacaagggaaatttagaaagatgtggagattcaaagtgttcaaccttgttgcatttgccacaatatttacatcctatttcttgggattatattatttccccagcagtggtttcttcttactttgagacataactgaattgagtatctcgtttgcactgcaactgcaattttgacagtccagtcttgatattggtcctcagtttatctgctctgccactttaggagataagggattggttcaaagttaccaccaaggctttctcgtttttgatttatattctgagttggaatttcacagcctttagttcctctttttcgtgtgtaaactacgtaggacatctagtaaaaggtaatgtatatacaatattaatgatcactattgtttttcaacacctaaactacccacaaaatttgtggttgattatgttccctgttacaggctgttgcgggaccagccactgccagggtcacttctgttcttgtgttcagctccagtcacccgcaccagtgacctcttctctgaaggtctgagatttctaaaaattaaacctgaatctccctgtgagtggcttaattacaacacaaattgaatttccaaccccacgaggtgttttctgttaaaatgattgggaaggaatgggatcctgaaaattggaatgagggcatattgacagatcccaatgaagctggggacactgaacccttgaatttggacagttttcttgctgggagaagcagccatccacccctgtctaaggaggttatctgttcttcctgaagaatctataattgccttgcaaggtactgctgattcttctt

SEQ ID NO: 1954 - DNA, 763 bp, Homo sapiens
aacaaattcccttataaaagagacattatgaaaagactttgaaataggagtcattttgcttattcagaggagaatgcagcccaaattcttgcaggtccagtgttggttctacaggacagcatttcaaacatggtgtttaatctggaggaaactaaagattggtgaggtattcaaaagggaaagagccaagtcaagaataaaagagaggataaagataaacagttcaagatcaggaaaagaggccatttgttaaagttacttgtcaccttgaacagctgttattggaccactatacttacaataattttcacctaagaactcattctagagtttacctggtgtgtgacatgcatctaagagctatcatcacattttcaggtcaaatgatagatcagccacaggtatataatttccttctccccaaagctctactaaaactatagaaaatctattttatttctttattttcaaagacctaggaaaaggagatacaagtgaggagaccatggcaacatttggaaagctgaaaacaagtggacacctggtaactggcttagcagaaccaaggaaaccaaatcatagaaactgggaggggcaagcagagagcaaacccaactccatcacatatgtgttgaatgctgggggaatggacacaccaagcagctgcggacatgaggaattctgacatgctaaatgccaagaaaaaaaatcagccgaaaacatcagaagagatttttgcggaggaagactatgtgagtagggg

SEQ ID NO: 1955 - DNA, 777 bp, Homo sapiens
gcacagtagcatggcacatgtatacatacgtaactaacctgcacattgtgcacatgtaccctaaaacttaaagtataataataaaaaaaaagaatgttatgatagccttaatttgacttcatgggtgctgtgttacctattggtcacagtttgtcatttactaagtaaaaagagagagattccgataatggaaagagtagaagactgagtttaagttttcagcactactgttcactaattgtgtgaatttgttgttccttctccccataatctcattaccccagatcttgacatctatggttcttcattgttcaggacacagctgaagtattacctttcccaagagatcttacatgacaataaccacccctgtcctatgttttggtatcaagatgaagctgacctcatagaatgagttgaagagtagtccctcctcctcactttcttggaacagtttctgtaggaatggaaccagctcttctttgtacatctggtagaatttggctgtgactccatcaggtcctgggctttttttttggttggtaggctatttattactgattcaattttggagcccatcattggtctgttaagggaatcaatttcttcctggctcagtcttgggagggtgtgtgtgtccaggaatttatcagtctcttctagattttctagtttgtgtgcatagaggtgtttttagtagtttctgatggttgtctttatatctgttgggtcagtggtaccattcctttcatcatttttaattgtgtttatttggat

SEQ ID NO: 1956 - DNA, 653 bp, Homo sapiens
ctttaatgctatctcttatgtcattgctgtttcaaaaacctcagactcaggatcaggaatcaggaatcagaagaaaatattaatgataacttcatcctcaagcacaatggacaaagctatagatgtacctaattcttcagcaaaaatgtacaattatgagatcttgacatctatggttcttcattgttcaggacacagctgaagtattacctttcccaagagatcttacatgacaataaccacccctgtcctatgttttggtatcaagatgaagctgacctcatagaatgagttgaagagtagtccctcctcctcactttcttggaacagtttctgtaggaatggaaccagctcttctttgtacatctggtagaatttggctgtgactccatcaggtcctgggctttttttttggttggtaggctatttattactgattcaattttggagcccatcattggtctgttaagggaatcaatttcttcctggctcagtcttgggagggtgtgtgtgtccaggaatttatcagtctcttctagattttctagtttgtgtgcatagaggtgtttttagtagtttctgatggttgtctttatatctgttgggtcagtggtaccattcctttcatcatttttaattgtgtttatttggat

SEQ ID NO: 1957 - DNA, 4892 bp, Homo sapiens
ggcaaagggaaataatggaagagaagtagtttaattaaagactatgaaaaaggcttaaggattttatttgattggaagtctggtatcagttaagaatacaatgtgttggccaaaaaatcctagtgcaattccaggctgaatacattcattcagcaatgatttattgggtgtctactaagtgcttggtgttgtgtggaaaacaaggatgaaggtgtggcccctgctttcgagcagcttacaaaagtgacatgtgttcctcctagaccacaaagtagaaagcatttggtgctgcaaagtaaaagagacaggaaaggtcggcacatgtatgatgaaggggaagagtgggcttgtggagaagcacaaggaatgataaggtagggaagatatttcagtgccagtctgtagtaggtccttagtgccaggccaagaagattggaagttatgtgaggggatgaggaaatgaaagattttgcagccaaaaaaaaaaaaaaaaaagatggtcagtgttttaggaagatttctttggaagcagtctgttggacaaattggagtggggagacacacacacagaggcttatacttggcatcatttcaaagattgatgttcttgttcctcatcttcattctataagtggagaaagtgaagctgaaggtttaaatgatgtccctaaagacacagagctgacaggggtatgcagaagcagaatccaggatggtgcttctgggtccagtgggtgataaaccaatggcaattagaccttgcacagttgttggagtttagaaaaacatttctggagggacttaaggaaaccagttaagagatcatttccacaggcaaagtaaaaaatattgagcactgaaagtggaaagagggtcagctgggggagaaactgctctgatgctgtgggttgagagggaaggaagcaaggcaaagaggacttggagacagaaggacagcagtgggatgaatgaccatggggaatacaaggatgaaaaagcaacttggaggagtaccattttgagtggggccaattttttttttctttttgagacggagtttcgctcttgttgtccaggctagagtgcaatgaagcgatcttggctcaccacaacctcagcttcccgggctcaagcgattctcctgccttagcctcccaagtaggtgggattacaagcacgtgccaccatgtctgcctaattttgtatttttagtagagatggggtttcttcatgttggtcaggctggtcttgaactccccacctcaggtgatccacccgcctcagcctcccaaagtgccgggattacaggcgtgagccaccgtgcccagcaacagagattctagtggggcccattttaacagaaggggcactggaaatgaatgtgtccagaagaaggtaactggaaagcaaattgcaggaatgagagaaggaactgcttagtctgggaaagcctaagttatttgcagaattgaattgaaaagatttccggggagaacagatagctagcatcctacatctgtagagcttttacagaacaatgttaagttgcctcctaacgagctttagcatggcaccagtggaaggcactgttagatggcagcaatgcagagttgtggaaaggccaaggggcagaagatttgaggcagatcagctcctatctgtgaagcagtatagtgggaggagcacagactttggagtcacacagacctgggttctagtcccagcctacctctaccagctatgtgaccttggggaagttgctgaacctctttgtgcctcagtttccatatgtacaaaataaagaggctagattggaagacttccaagatcttgtctagctataaaattccttggttctaaaaaggtggcttatgtgcataaaataaatagatggaaatacagtattatcttctttggattttgctctcaaatctgtactaatattggttatcaagtatgcacagccagcctgcttctgttgcactgcatgatggcatgtaatgatggaacagagctgacatgttcacaaaagcacttttctctgtgggtaggagtggaaaatagttccatttagctgatatcactaatttttaaagaaaaccatatgagctaaagagaactgaagatgaatgtgggagctatgagtcaaccactgaatctcagctgcattaattttacattataaatgacacagttttaaagtttcttagattttataatagttgaaatttttctttaaaagagtacaccctatacatgccgatacacgttaaaaagattgaacatttcttcccattctaaagcatcttgaaaacaatgactgtgctgttagcgatttttaatataaaatacatttcctagcagtgttataaaccgctaacagcactttttgtgaaaattggctacttcatacaaaaaaaacctcacagtttttgttatctttgtaggattttcttccccctttttgaattgttttataatggataatgttgcttaaaaacatccagcatttccatgagaaatgaaatattcagaagacttctggataagtgatatttatacatagttcctttaatcttaaatacctaactcttaaatagcatataagagaaattgttttcctttaccgtcgtagattaaaagtggcatcacaaattttcaggtaggaaactaaaatataagacctagagattatataagaaagatccacactggccatccttacctcaaagcaaactaagacccagaggcagagaagaatttcaaagcctgacttagaggattgtggaaaataattatatcaaatcaaagtttaggacaatcttggaccatggaaagaagaaaagaacatttagcacattgttaaaaatagatactcattctcttttaaccatagacagttctttaacatcttacattagcaacacagacagactggatccagtttcagttcattctgtcacttaaccattccacgactcaattttttcatcaccaaaatgggggcgatattatttcctagcaggctaagtgtgcagctgacatgtgacgatgtgtgtgcagtcctttgtaaattatacagcacttcaaacacagaggtctgctgttatgggtcaagactgtcaggagagctcatggttaatgcgaatgacccggaaacgactcgtagctgtttaacacacatgtttttggtatcaaaactgcaagcgggattgagtttgaaagagcattattaagagaaaacaatctgctctgcagattccaactgtgatgtggtgcctgtttcttggcacagacctcccacttaaactaattaaagttccacacaggtagaaaatgaatgcttgacttgagatctgccatgtggacctaaaagatggaattgtctatggctcttttatttcggttaaaagaaagcagcatttgctttgtttaaaaaagaaaatggggggaggggaatgtatgtgggtttgtttaaatgctgaagaaaactgttctaagcagctggatgaataaaagggaggagcactaaagaaagaatgcgctaaatctaaagatacaagaacaacacccaggaattgattgaaaattgttaaattcccaggtccctcagttctttagggatggactaaatgatggctagtatcattgctcacaagagtgtcttgaacttgatggagcttatgttgagaaatttttatttcgtatttttatcttttatttcaatttttctacaaactttttgaagtcccctgtgtgtatgtatatgtacattcctgagctggagtataacattactttggacaaaattctttacattaaaattcacttctagaataaagaggttcacaactataggtttcaaagaatatcagaacaagaaagagaacaagagatctctctccaggttaaacatcattccactatcgatgaggtttgaatgtagttgctcaagcagctgtatattcacctaaacagagtaacaacccagtctacatttctccaccatatccatcatataatgtgaggatttcggagtgattttgtcagatgtagggttaaactccattgccagcacccctcaatgtacccaaacaggaatagtctacttttcctgattcctttttaaagtctcacaaattatctttttaattaagcattctataattttttcccaggaaacagcttcgattttatcagctggtatttattgtccatgagtcaccttttggactactgggttgacatttcctcaattcctgtcttttggccactctcatttatcataagctttaagaacttatggctacgcaattttatctgcatatcttttcagtgccccaaaagcaaatttttagggcctagagatatattttgtatagctactatattgtgttctcttttaaccatgtttgtttcatgccttctaattttgagaaatgagaacactatctttcatgaagaagaaatggaaagtaggggttatttgttgatgtgaaaggataagaggtatcacatggaatagaaccttttaaaagtgttacgcttttctaaagtttaaacagcagtagttctcaaccctggccacacatcagaaccacctggaaagcttaaaacaagacaaaaacaaacaagcaaacaatcatgcctgatccccactccagagttcctgatttaattggtctggggtggggcatggacacgtgtgtttttaaaagttctccaggagattctaacatgcagagttgagaattactgcaaatctaaccattagaagagtataacatttctttttttaaaggcctgatttccataggaaatcctgtctgttgttccatgagttaggatgcagcaaagctttgataaaaagggattttcaggctgtaagccca

SEQ ID NO: 1958 - DNA, 300 bp, Homo sapiens
gaaatatatcgaacaagcacagcagcaactacaaaaggcgtgcttctgtggaggacccaggactaacaaccgatacagccaaaatggcggcagtagagctgaagggagacgccagagggctgcaacagtccatgaacgttcctgatggtgacagaagatacacgaccattttccttggaccatagataatgctgaaatgagcttcagtgaatgaatggataaagaaaatgtgatatatttacaaattggaacattatacagcctttaaaaagaagaaaatgtcattcacgataacatggg

SEQ ID NO: 1959 - DNA, 670 bp, Homo sapiens
agtatattcatctgctacttaaaggtcttggaaggaggaagaaagaaaatctccaggaagtcttctgggtgacttcagcaacaattgcattacccttttccagcaaccaggagtaaaacccaaagagttgctggctgttggctggaaatcaaacaaaacaaagaattaattggagctaaggctgtggaaagtgccagtctgtgacatgcatggaagaaagcaaggaaagcctggagtgacctggattgcatagcagaaagaaaaatccctgcaggggcagtgtgaaaagactagggaggtaagagaacctgaaaatacagcactgtaggtagaaggctgtaaagctggaatgatgctaacaaatactgtattattaccttagctgatagcggtgacatagtggcccacacagaatcattgaatagcatcgggtgtggtaattcagggagagccagtggggcaatgtagaaactctaagctggcaaagttctgtggtttttgtaaagtgcctatccagagtacatggttcattcatgccagatcagcaaaagcagctgctgatgtgatgatgatttcccttttgagctaaacctctacagagttccttttttctctagggcttttggctatgactgatgacgtagccttaggctcaggattctaacacccc

SEQ ID NO: 1960 - DNA, 548 bp, Homo sapiens
gagtagaattactcatagaatcagagtagaagggtagagttggtagaaacttttagaggtcatttagttccactttaagaagagattgcattccgctaacactcaagacctcctaggtacaaggcactgtgccagactgaaggcggagacttaaagagagtgaggcaaccctggctctctggaagctatatgatcaataacccggggaagttagaggggaaacaaatgcaaggcaggcaggagttacctggttgatggaaatgaccgccagccggggtatgaccacttggaggatgacctgcagcagcgaggtgcccaggccggccaggatggcccaggtgagcggcagcggcagcatactgtaggtggcgaagagcgtgaagagcacgtagcctatgccgtcgcccaggagcccgtagccgaggcctgctgccaggatctgggtggtcatggccacccaggtgaccacgccgctgtactgcagctctgtgaccttggccatgtcacttaacttccctccgcttcaatgtcttcatctacaaaccagg

SEQ ID NO: 1961 - DNA, 449 bp, Homo sapiens
agtcctcacccggtctcctcgccacgcagcaccttcccgagcccgaggtggccaagccttgcgtgtgactgtgaaccagtgcctgccgcaggccccgccctcaacctcgtcctccatcgcgtgctgtggggcctggggagatgactgaatggctaggtgcctcagtttccccacctgtaaaccagtgtcggctgcacgtggttgtgatgaagactgagtgtcgatatgaaaagcacttggacaagtccggtcacaggaaaatgcggtgctgcgggaggggccacacttggaggagctggagtgctggggacgcccaccctgagaatggaccgcagtaccagcctgctgtcaccccaccaactggaacctcacagaaaaagcgcatgtcctggccaagggtgaggaggagcaaagggctggggaccaggtagggaggaggagtccccagg

SEQ ID NO: 1962 - DNA, 2013 bp, Homo sapiens
ccttaggcctcccaaagtgttgggattataggcatgaaccactgcacctggcctgtttttcatttccaaaagttctttaaggagtcctgcctattcatgcgtgacagtatgtaccctacagctttctcatcactgactgcgcgacttctttgaacacctcacacataactatcctctcacctgtatgatgacagtttcaggatctgcgtttctttgtggctgacagcggctgcctgctgtttctgttggccctcagtcagctgactctccttgtgtgcttggggatctttgcaagctgaatgcctgacttacgagcaggaatgaggctaagccaggtaagcttccttcagggagcaggtgctttgaccgctactggtacctgaggatcttggctcagcatgggagacacaggctcatcttcccacctcaccaccggcccaggggtcaggagcttaattaacggtggggccaccaaatccattctgagaccacccctgcccctacaggctgcacaaccctaagctcatgcattttaacaaaatcggtgccaagagccctcaaagcgactgtcttggaagcggcagccagctcaggacccagaattcttcccaattagtccttacctgggcagagaactgcaggaggtggtcacaagccacacccagaccaggatgggcgaatcctgcaaccgcaccccaggggctcacggccagtaggcggctcacatttccctgtcatcccaagaaactcaaagcccacctcgcttaattcatgatgacagagctttactatacgcccccaaaaacgctccccaaagagacacttctacttttctatctagaaaataacattttaaaaaatgaaaatattttacaggaaataacatttgtacatactcataacagtctcaaagagaaaacgattcctctacccacagaacgcttctgaaatcacatgtgtgtaagcctttccctccacaccaaccagctctccaactccctctcagacaccaacgcgatgtcctacaatttaactcgattctgtcaccaattgcccggagctagtgcagaacccacagggtaaggggtcagtcccacaagaccaccccgacttcagatgccaagtgcagacggtgggccccggggaccccacgacccccttctcaggttccaattttttttttgagatgggtctctctgtcgcccaggctaaagtacagtgcccagatctccgctcactgcaacctccgcctcccaggttcaagtgattctcctgccccaggctcccaagtagctgagattacaggcgcacgccaccacgcccaattaattttttgtatttttagtcgagatgggggttttgccatgttggccaggatggtcttgatctcttgaccgtgtgatccgcccgcctcggcctcccaaagtgctaggattacaggcgggagccaccgcacccggccaagttccataattttctaagcacacagaagtcgggaccatatgaaccggctgtgaaaaggcgttgaaatacatggatgaaccaccgacccgcaagggttttgatggaggcctggttgcggaggaatgaccgattcaatcaccggccactgccccgcagcagctgaccgtgggaggcggggagtctcagaggcgggcggccggcccgggacagacccctgagacctccccgcctctgggaatcgcctcccgcgggcagcgctcgccttccccgagccctgtctctcctgattgctcccaagccaaggcggatgcaggcctggcgaggctttcgcaacccgagaaccaggcgcgcagccggctgttacttcctcaccgcgcacggggcggacaggagcctcccccggcctcggcctcgcgcccaccaggccgccggcatctcttccgccgcagccccggctcactcggcgccatgcacccgccggtgctggatgaggtggaagctcaggcggaaggcgcggccgcactcggtgcagcggaacggcttctcgcc

SEQ ID NO: 1963 - DNA, 602 bp, Homo sapiens
ggaaggggctgtgctgccaggcaggtccatgcgtcctaaaggcacagaggcccctccagactgcctctctcaggaacttgtcacacagacggagccaggtgtaatgccagccccagggccaagcagcagctttgcaaatgttgcagcagccacaccacagtaagaaattctttttctgcgcatccaggtggctccaaccagcaccgtcctttccgtgtggggtgtgcctgaccccctcctttccccctcccagaaaggtgaagaagccggccctgacctcccaagtccattccatggcttgctgatgggctgggtcacagctctaaacccctcaacctggcctgtcctggagcaggcggctttggacccctgagcacaagaaatgaagaaaatcacacaaggcacatcatcatcgagttactcaaaaccagttacaaagagataaatctcaaaagcagccagaaaaaaaaaaagcaaggccttttgtgtatgaaggaacaaagacacagatgacagcagatttctcatgagaaacaatgcaagtgcgaagacaatggtgtagtgtgtttaagatgctgaaagggaaaaaaaaaaaaactgtc

SEQ ID NO: 1964 - DNA, 389 bp, Homo sapiens
ccggcggcggcggcggaggacgccgacagcacgggctgccgcggcagcagcggcggagcagcagagaggccggggagcggcggctggctcacgcgcgtcgcgcgggccgggatgagggactgtggcggcgcggcccgcgcgcagccggccggacccctgagcacaagaaatgaagaaaatcacacaaggcacatcatcatcgagttactcaaaaccagttacaaagagataaatctcaaaagcagccagaaaaaaaaaaagcaaggccttttgtgtatgaaggaacaaagacacagatgacagcagatttctcatgagaaacaatgcaagtgcgaagacaatggtgtagtgtgtttaagatgctgaaagggaaaaaaaaaaaaactgtc

SEQ ID NO: 1965 - DNA, 351 bp, Homo sapiens
gccgggttgcgtccgcacttctgcgcgctggcccctcccttgctcctctccctagcagtctccagggttttaccgggaggacctaggcaacggcctgagactccgagactctatgttgaagatgcctggactaacctactgaagatacgtggttttaccaacagccagcaccaataggaagatatgaatgaagccatctgagaccagccatctggcagccaaactgccaactgactgcaaatgcatgaatgatcccactgacaccacgtagagcacaaatgagttgcctccactgagcccagcccaaattgttatcctataaaatcataaaaacataaacagttgttttaa

SEQ ID NO: 1966 - DNA, 453 bp, Homo sapiens
ctttttggtctcaggactcctttacatttataaaaattactgcaggccccaaagaatttttgcttatgtaagttatgtttatcagtatttattgtaatagaaaataaaaccgattaggatctaggagaatttgaaacaaaatgggaaaaaatttaaatagttgctaattcatttaaacataaactcattacatgttaacataaataacatttttgtttagagacccatgattttatgtttctgcaaagctctcatgtctgccttcatagaagaaagttggatctcatactgcttcgcattagaccaattgaattgttattttgttagaagtatctggagaagtctgatcttgtgcagataatgtagttggaaaaaggaggagtattctgatcttttcaggctgctggaatgcagtggcatgatcataacttcactgtaacctcgaacacctgg

SEQ ID NO: 1967 - DNA, 1028 bp, Homo sapiens
gataaacttttaaggattataaatctttaatcttgtttattttgcaatttcctttgttttgattctaagtagcatttataataatattttcttagtgatgataagttacaacagttctcaaactttttggtctcaggactcctttacatttataaaaattactgcaggccccaaagaatttttgcttatgtaagttatgtttatcagtatttattgtaatagaaaataaaaccgattaggatctaggagaatttgaaacaaaatgggaaaaaatttaaatagttgctaattcatttaaacataaactcattacatgttaacataaataacatttttgtttagagacccatgattttatgtttctgcaaagctctcatgtctgccttcatagaagaaagttggatctcatactgcttcgcattagaccaattgaattgttattttgttagaagtatctggagaagtctgatcttgtgcagataatgtagttggaaaaaggaggagtattctgatcttttcagtttctgtgggtcaggcattcagaaagggcacagcagcttttctgtcttccatggtgtctgaggtcttagctggaggaccgaaagatcctggaagattctatggctggcaactgcaatcaacagaagcctcgtttactcgcatacctgatggttgatgctggctgtcagctgagaactcagcttgggttatcatccagaacacctacatggacctctacatataactttgggcttacttacagcatgatggctgggttctagaagacagtggcccaagacaaccagaaagaaactatgtcactttttgtcacctagcttcagaagtcacaaacctgtagtcccaagcttatccagagtcagcgggagagaacataattccatttcatgggaagagtgtcagagtcacacttcacaggaaaagtatataggatgggagatattgttgaggacatctttggaaattaaatttgcccaatcatcatgttgtatggaagaattaaactacct

SEQ ID NO: 1968 - DNA, 2083 bp, Homo sapiens
ggactcttatcaataccgaacattgaaatctggaggctcggccatcagaactcttacacagcacagaagacgagtttcacgggtcactcagcatctactggaaggaatttcaaggctgcctgctgtgtggctgttgatactgcaggccctcactcttaccagtaagatccgcctgctcttgaggaaagccggtgagaagcagtagacaggggaatgacaccatctatctgaggtgagttttgcaaggcatggccctggataaaggggaatgcatgggagattgtttagaagtgttgttattgtccaaggaaaaagtaggcggtttacgctcactggtggcagtggagatgagaagaaactgatgactttgagaggtgctgagaaggcagaactgaagactgctagcacttcagatgtgggggcgagggtgaggggctggcagctgggatgctcaggtttctggcctgggtaactgggtgggtgtttatgccatcgtgagaaaggaagtttatcatgattgatctaaacctaatagacttcaattgaaatgcattggtggtagaattctctatggaaacaggctttagaatcaggcaaaagtagatatgtattgcctgtaatgcaacacactagctaagagacgtcgggtgaatcatttaaccccacaggtttcagtttccttatttgttgttgttgtttgagacagggtttcgctctgtcacccaggctggagtacagtggcatgatcatggctcactgcagcctgacctcctgagctcaagtgatctgcccacctcagccctcaagtagctggtacgcgccaccatgcctggttaatttgtgtgtgtgtgtatgtgtatgtacatagtgcattcacatatatatatatgtagacacagggtttttccatgttgcccagactccatgtggtcctgaactccttggctgaagcacctcacccacctcggccttccaaagtgctgggattacaggggtatgccactgcacccggcccgtgttctcattcattaaaagtgaaggtaatgatatgagttagtatatgtaaagagcatatggtatgcaaataatcagaggttagcttttataaaatattttataagtaatatgatgctctcctttggagcatttcaatgatacatcttactcatttttattattggccaggcacagtggctcacatctgtaatcccagcactttgagaggccaaggcaagaggatcgcttgagcccaggagttgagatcagcgtgggcaacatggggagacctcatctccacaaaaaaatacaaaaattagccaggcatggtggcatgcacttgtagtcccagctactcaagaggctgaggtggaaggatcacctgagcctgggaggttgaggctgcagtgagttgtgattgcaccactgcactccagcctgggaaacaaagtgagacactgttttaaaaaaatcattattttaaaataaagtagagaggatcttgtttttatttcctcaattgaatgtgggagaagtgtagggaaactgtggaatatagacactaaggatcggtgcaagctccctttaatatctcaagaaaataaaaataattttctagttctgtctgtttgtgcaactataaggtatttttagtgcagagtttagaaagcccagcagtgtagagagtatatatttctttatttccaataactcatgggaacagcatgtactggtaacaaaatagcactttctcttgactagcagcttttttttcccctgtctaaagggctactaaaaccattatgtttttttcaatgcaggacatcttgtcctttccctgaggttatagtacttggtgcctttcatgatttcagatggtaaactgcttcctaagtgggactctgttctttgtctaagacattttatcttttctaaagcacagtgttcccaccatgacaagtgctatttatgtgtacattatcagagctacacaaacaataattcttacttttcttgaaatatttaaaacaaaacactcagtacaaattaataaagatcaggtacttttaatatttgtataactggg

SEQ ID NO: 1969 - DNA, 2143 bp, Homo sapiens
ccacgtggttggcagccccattctgcctctcgttctcatccacatgacatttcttcttggcgatcttgtggagaattgaagccttttctctgaacctccctgaagcaaaagaaagtggcaggaaggagacacaatgagaaagaagagagtctcagggccaagcagaatttcaaggctgcctgctgtgtggctgttgatactgcaggccctcactcttaccagtaagatccgcctgctcttgaggaaagccggtgagaagcagtagacaggggaatgacaccatctatctgaggtgagttttgcaaggcatggccctggataaaggggaatgcatgggagattgtttagaagtgttgttattgtccaaggaaaaagtaggcggtttacgctcactggtggcagtggagatgagaagaaactgatgactttgagaggtgctgagaaggcagaactgaagactgctagcacttcagatgtgggggcgagggtgaggggctggcagctgggatgctcaggtttctggcctgggtaactgggtgggtgtttatgccatcgtgagaaaggaagtttatcatgattgatctaaacctaatagacttcaattgaaatgcattggtggtagaattctctatggaaacaggctttagaatcaggcaaaagtagatatgtattgcctgtaatgcaacacactagctaagagacgtcgggtgaatcatttaaccccacaggtttcagtttccttatttgttgttgttgtttgagacagggtttcgctctgtcacccaggctggagtacagtggcatgatcatggctcactgcagcctgacctcctgagctcaagtgatctgcccacctcagccctcaagtagctggtacgcgccaccatgcctggttaatttgtgtgtgtgtgtatgtgtatgtacatagtgcattcacatatatatatatgtagacacagggtttttccatgttgcccagactccatgtggtcctgaactccttggctgaagcacctcacccacctcggccttccaaagtgctgggattacaggggtatgccactgcacccggcccgtgttctcattcattaaaagtgaaggtaatgatatgagttagtatatgtaaagagcatatggtatgcaaataatcagaggttagcttttataaaatattttataagtaatatgatgctctcctttggagcatttcaatgatacatcttactcatttttattattggccaggcacagtggctcacatctgtaatcccagcactttgagaggccaaggcaagaggatcgcttgagcccaggagttgagatcagcgtgggcaacatggggagacctcatctccacaaaaaaatacaaaaattagccaggcatggtggcatgcacttgtagtcccagctactcaagaggctgaggtggaaggatcacctgagcctgggaggttgaggctgcagtgagttgtgattgcaccactgcactccagcctgggaaacaaagtgagacactgttttaaaaaaatcattattttaaaataaagtagagaggatcttgtttttatttcctcaattgaatgtgggagaagtgtagggaaactgtggaatatagacactaaggatcggtgcaagctccctttaatatctcaagaaaataaaaataattttctagttctgtctgtttgtgcaactataaggtatttttagtgcagagtttagaaagcccagcagtgtagagagtatatatttctttatttccaataactcatgggaacagcatgtactggtaacaaaatagcactttctcttgactagcagcttttttttcccctgtctaaagggctactaaaaccattatgtttttttcaatgcaggacatcttgtcctttccctgaggttatagtacttggtgcctttcatgatttcagatggtaaactgcttcctaagtgggactctgttctttgtctaagacattttatcttttctaaagcacagtgttcccaccatgacaagtgctatttatgtgtacattatcagagctacacaaacaataattcttacttttcttgaaatatttaaaacaaaacactcagtacaaattaataaagatcaggtacttttaatatttgtataactggg

SEQ ID NO: 1970 - DNA, 294 bp, Homo sapiens
ctgggaaactgggccttggtagaactcttcaaagttgctgatgtgcctttccgtactccaggagtgtatgccataaaagggtcccagtgagagtcatcttaaatgtattcaccaagagaatcatatgaatccaagacccacccacatgtggtccaagaaaagcccaaagcctgggaggcagagagtccacatgaccagccagatgctgccttgtctgcctcagaggaactgcccttaccatgtctaacaggaagaacttctaggaaaccaccaaacgcctataaaaaagggggc

SEQ ID NO: 1971 - DNA, 616 bp, Homo sapiens
cacttgcttacagtaatatttatgtagttggcctgcaaagcaaacacatttcactcatgttcagatttttgtaatcaaaattattttgttctcactataaaggcagtaagctcctacaggacattttaaaactacataaatgtgccatccccagctcaaccgattataaacaactgccgaaagattgtgggtacaagccagctgccatgttgtgagcacataccacatagctccatggagatgcccatgtgactgtgatgaagagctaagacttcctgtcagtggccgtgtgagtgacccatgttagaaacagatccgccagcccaaacagaaccttcagacaactgcagccccagctggcatcttgactgcaactcatgagcgattctaagcccaccgaagctgctcttgaattattgattcacaaaaacttttaggtctccagaaattctagctactgatcaagcccagtgaggaatttcagttctttgtgctgaaaacgttggagatctgctggatcatctcatgaagaacattggtggcctgagccttttggaatttggtgccatgcggctgctctaggggaaacttaaaaaacattcttgttcttcagaca

SEQ ID NO: 1972 - DNA, 631 bp, Homo sapiens
aggcattggctgagtaattcaaaagagtgattgaagactggaaagtaccttaacagataacttgggagatttctaatgcctggaggctgctccgtctatccaagtgggagctgcaagcaagtcctgcctcctctccgccatcttaacccctcaaccagtaaatgtttaaagacacaaatctcaagccctctcagtctccactcttcaaaagtccgtcctttcctgactttacgtggcagaaagacaatctgccttgcagcaagtttatggataacacggagttcccctgcaatgaatatgtgaaccctctgttcttcaggatagcacttgggatgatgtggagttgctcaggccaggacctccagtaccatactgaattgaaatggtaattcaatatccttgtggaaagaagaatctagatggcactgcactagcgaccctggggtggcggtggctgaggcactcattggaggaagatagaagattcttattagaaggatagtccttgaatatcaaaggtgcttgagattttcaaactcatcaacttttagaggaaaataagtgttatgggaaacatcagctttgaaatcagaaaagtctatgtttcgatctcagctgtgccgccggagag

SEQ ID NO: 1973 - DNA, 699 bp, Homo sapiens
ttttttagagacaaggtctggctctgttgcccaggctggaatgcagtggtgcaattatagctcaccagcaatcttgaactcctggactcaagtgatctgcccgcctcatcctccctagtagctgggactacagctgaatgccaccataccaaggctgctccgtctatccaagtgggagctgcaagcaagtcctgcctcctctccgccatcttaacccctcaaccagtaaatgtttaaagacacaaatctcaagccctctcagtctccactcttcaaaagtccgtcctttcctgactttacgtggcagaaagacaatctgccttgcagcaagtttatggataacacggagttcccctgcaatgaatatgtgaaccctctgttcttcaggatagcacttgggatgatgtggagttgctcaggccaggacctccagtaccatactgaattgaaatggtaattcaatatccttgtggaaagaagaatctagatggcactgcactagcgaccctggggtggcggtggctgaggcactcattggaggaagatagaagattcttattagaaggatagtccttgaatatcaaaggtgcttgagattttcaaactcatcaacttttagaggaaaataagtgttatgggaaacatcagctttgaaatcagaaaagtctatgtttcgatctcagctgtgccgccggagag

SEQ ID NO: 1974 - DNA, 514 bp, Homo sapiens
ttttttagagacaaggtctggctctgttgcccaggctggaatgcagtggtgcaattatagctcaccagcaatcttgaactcctggactcaagtgatctgcccgcctcatcctccctagtagctgggactacagctgaatgccaccataccaaggctgctccgtctatccaagtgggagctgcaagcaagtcctgcctcctctccgccatcttaacccctcaaccagtaaatgtttaaagacacaaatctcaagccctctcagtctccactcttcaaaagtccgtcctttcctgactttacgtggcagaaagacaatctgccttgcagcaagtttatggataacacggagttcccctgcaatgaatatgtgaaccctctgttcttcaggatagcacttgggatgatgtggagttgctcaggccaggacctccagtaccatactgaattgaaatgttcacaggctaaggaatctgaaaaattggcattgaccgactgacaaccaggtgaagctgag

SEQ ID NO: 1975 - DNA, 550 bp, Homo sapiens
agagacaaggtctggctctgttgcccaggctggaatgcagtggtgcaattatagctcaccagcaatcttgaactcctggactcaagtgatctgcccgcctcatcctccctagtagctgggactacagctgaatgccaccataccaaggctgctccgtctatccaagtgggagctgcaagcaagtcctgcctcctctccgccatcttaacccctcaaccagtaaatgtttaaagacacaaatctcaagccctctcagtctccactcttcaaaagtccgtcctttcctgactttacgtggcagaaagacaatctgccttgcagcaagtttatggataacacggagttcccctgcaatgaatatgtgaaccctctgttcttcaggatagcacttgggatgatgtggagtccctttcttctgtcctgctgattggaatgtggacaatggccagagctgcatttggatcaagagaatgagggagactccataagccatagtagagcgaaagaccagagagggcctgagtccctgggaagtttgggaaacaaagcc

SEQ ID NO: 1976 - DNA, 409 bp, Homo sapiens
ttttagagacaaggtctggctctgttgcccaggctggaatgcagtggtgcaattatagctcaccagcaatcttgaactcctggactcaagtgatctgcccgcctcatcctccctagtagctgggactacagctgaatgccaccataccaaggtgtgtgtggtcccggagctgcagcagatcatatccagaggccatagcatggggctgatgcagaactggaacatgaagaacagaacagactcagaagtaatggagcaaggtgtggtattttgagttccaacgtatcggggaagggagttgctaagtgattgtgatttgggtgttactataaatgtgacctcatgttattgtcattagaaatgaaacttttggtatagtgttctcaggagtaatatttctgaaatcaag

SEQ ID NO: 1977 - DNA, 1512 bp, Homo sapiens
gtattttaatgcccaagtagaaaatggaaaatcatgaaggaaaaatatcacttgtgaaaatcgtggcagttagctttatgaagacacagtggcctctgtggggacatgggatatgcagaaagagatggctagtacagttgttctgtcttctgcagttcagtcagggacatattgagagaggaaagtttaagcaggtacattagaaattgataaccagcccagcattcttagaacagatgggtttagagaacacgagttgtagttccttggcagaatgccatggtggatatgagaaactgtgaactgtgttgaaattgagcttgagcagaaaatgagaatactaaaaatttgaagttcagagggtatgcattagattatttctaatggtccccatatatgatcattgcctgcctgactatataagactcctgttgggagcttgagaacagattgctgagcttagccctttggagactctggtatgctgtgtctgggatggagtctgcaaaaaaaaatttaaagaagagacttaaaaattatacaaaactagaatagtgctttggtactatcagattacttgggggctattcccacttcgattcttcatatagaggatgtgaacagagaaacatgcagataaatcagtcaatgccaactgctgggggaaacgtccatagtctgcaggttcccacagaaaggatagcacttccgtcctctcccatgagggaaaaacaaaggagaaaagcttttggcctctcaccataagctcattcagtcctccccttgggaagagaaatgacttaactgaggaatgtgcttgaaagtagctgtactggtgaaactcagcctctgtgggtttctctctctttcagagtcagctctcttcaggatgcgcatttatttctccctttggaggaggcctcagtccagctcagccaaggactgaaaggcacatctggctaattcaagactgagaaaggcttttacatcaaatattgataatgataataataatgaacacatgttgagcacttaccatgtctcaagcactgctctagagcttcccatgaaagaacccctctaatcttcagaacaaccctgtgaggagctgctgttaaatgaacaccttgatactttcgttcttggagagaaatgagccaaggaggaagaccatctaaaaaaaaccactagacaatttgtgctcactggagtggtctctgctgggcaaaaggtctttagaatgactcgtggattttctggcaagtggcaaaccatacaagtgctatgtcaggccagggagacaggtgcagccctgtcagtgtcaaagaagaacactggtagcagaagagctaagagtgaatgaaaattgaattatctttatttctaggacttgtctattgagaaacaacagtgctggcaaccatttactaccaacaagaggcagttccaagagaagaatataaaatatgctctgctcaatcccacgaaactcagagtgtctcacaatggcca

SEQ ID NO: 1978 - DNA, 17272 bp, Homo sapiens
cccacttgaggaggcagtctgcccattctcagatctccagctgcgtgttgtgagaaccactgctctcttcaaagctgtcagacagggacatttaagtctgcagaggttactgctgtctttttgtttgtctgtgccctgcccccagaggtggagcctacagaggcaggcaggcctctttgaggtgtggtgggctccacccagtttgagcttcctggctgctttgtttacctaagcaagcctgggcaatggtggacgcccctcctgcagcctcgctgctgccttgcagcttgaactcagactgctgtgctagcaatcagccatactccatagccataggaccctccgagccaggtgcgggatataatctcctgttgcaccggtttttaagcctgtcagaaaagcgcagtgttcaggagagggtgacccgattttccaggtgccatctgtcacccctttctttgactaggaaagggaactccctgaccccttgcacttcctgagtgaggcaatgcctcaccctgcttcagctcctgcacagtgcactgcacccactctcctgcacccactgtagggctggcacttcctagtgagatgaacccagtacctcagacggaaatgcacaaatcatccatcttctgtgtcgctcacgctgggagctgtagaccagagctgttcctattcggccatcttggctgccttccagtgttctggaatcccatgtgatgggcaaacattcagacaatcgtagcagtgttctggaattctatgtgatgcacaaacattcggaacctcatcacagagtgctggaattctatgtgaggtagaaacattcaaacccttgtagcagtgttctggaatcctgtgtgaggggtaaacattcagaccaaagcaggagtgttctggaaacccctgtggggaacaaacattcataacctcatagcaatgttctggaatcctatgtgatgaacaaacatttagactccagcagcggtgttctggaatcctatgtgagggagaaacactaagaacacagtacgagtgttttggaatcctatgtgagggacaaacattcataccctcttagcagtgttctggaatcctatgtgagggacaaacattcagaccacagcaggattgttctggaatcctttgtgagggacaaacactcagactacagcaagagtgttttggattcctatgtgagagacaaacattcagagcatcatagcagtgttctggaattccttatgagggacaaactttcacaacctcatagcagtgttctggaatcctatgtgagggacaaacattcagatcaagtcaggagtgttcttgaatcccctgtgtggaacaaacattcagaccctcctagcagcgtcctggaatcctatgtgaaggaaaatcattcaaacaagggcgggagtgttctggaatcctatgttatgcacaaacattcagaccctagtcacagttttctggaattctatgtgagggagaaacaatgagtacctagcagcagtgttctggaatgctctgtgacggataaacactcagaacctagcagcagtgttctggaaccctatgtgagggacaaacaatcagaccacagcaggattgttctggaatcctatgtgagggagaaacactcagaaaaaagcattagtgtattgcaatcctatgggagggacaacatttagacccttgtagcagagttctggaatccagtgtgagggacaaacattcagaccactgcaggatggttcaggaatcctatctgagggacaaacatgcagaccctcacagcagtgttctggaatcctacatgagggataaacattcagaccatcgtattagtgttctggaatcctgtgtgagagacaaccgttcagacccaagaagaagtgttctgcaatcctatgtgagagacaaacattctaacaacagctggagtgttctggagtcctatgttacggacaaacattcagacccctgttgcagtcttctgcaaatctatgtgaggtagaaacactcaaaacccagcagtagggttctggaatcgtatgtgagggacaatcactcagatcaaagcaggagtgttttggaatcttatgtgagggacaaacattaatatcctcttagcagtgttctggaatcctgtttatggacaaacattcagaccctcgtcaccatgttctttatttctacatgagggagtaacactcagaacccagtggcagtgtcatggaatcctatgtgatggacatacatgtaaacccctgcagcagtgttctggaatcctgtgtgagggacaaacattcagaaaccagcaacagtgttagggaatcctacgtaagggacaatcattcagaccctcgtagcagtgatctggaattctgtttgagggacaaaattcagaacccagtagcagtgttctggaatcctgtgtgagggacaaacattcagacaccagcagcagagttctggaaacgtatgagagggccaatctttcagacactcatagcagtgttctggaattctttgttagggacaaacattgagacctgcgtagcattgttctggattcctttgtgagggacaaacattcagaccacagcaggagtgttctggaatccactgtgaagaacaaacattcagaacctcttagcagtgttctggaatcctgtgatggataaatatttatatctgacgagcagtgttctgaaatcctaggtgagtgacattcagacaatcatagcagattctggaatactatgtatgggacaaacattcagacacaagtagcagtgttctggaatgctatgtgcaggacaaacatttaaacaacatcgagagtgttacggaatcctattttacggacgaacattcagaccctcgtcgtactgttctggaattctatgtgagggagaatcactcataacactgcagcagttctctgtaaccctatgtatgggacaaaccttcagaacacagcaggattgttctggaatcctatgtgagggacaaacactcagaacacagcaggagtgttttggaatcctacgtgggaaacatacattcagaccctcatagctgtgttctggaatcctatgtgaaggataaatatttatattcgaggagcagtgttctgaaatcctaggtgagggacaaacattcagaacctagcagtgttctggaatcctatgtgagggacaaaccttcagacaatcatagcagattctggaatactatgtgtgggacaaacattcagacaccagtagcagtgttctggaatgctatgtgtgggacaaacatttaaacaacatcgagagtgttatggaatcctattttatggacgaacattcagaccctcgtcatagtgttctggaattctatgtgagggagaatcactcataacactgcagcagtgttctggaaccctatgtatgggacaaaccttcagaacacagcaggattgttctggaatcctatgtgagggacaaacactcagaacacagcaggagtgttttggaatcctatgtgggggacaaacattcagaccctcatagcagtgctcaggaatcctatgtgagggacaaacatacagaccacagcaggattgttctggaatcctatgtgacggacaaacattcagaccctcgttgcagtgttccggaatcctatgtgagcaacaaacagtcagacaatcgtggtagtgttctggaatcctaagtgagggacaaacattcagaccccagcagcagtgttctggaatcctatgtgagggagaaacactcagaatacagcaggaatatttggcatcctatgagacggacaatcattgagaacctcatagcagtgttctggaatcctatgtgagggagaaacattcagaacacagcaggagggttttgggaccctatgtgaggaatgaacattctcaccacagcaggattgttctggaatcctatgtgagggacaaacactcagaacacagcaggaatattttggaatcctatgtgagggacaaacattcataccctcttagcagtgttcagtaatcctatgtgagggacaaacattcagaccacagcaggagtgttctggaatcctatgtgagggacaaacattcagacactctcagcagtgttctggaatcctatacgagttatgaacattcaaacaacagcgggagtgttctgcaatcctatgttacggacaaacattctgaccctcgtcacagttttctggaattctgtatgagggagaagcactcagaaaccagcagcagttttctggaatcctatgtgagggacaaacattcagactccagcagcagtgttctggaatgctatgtgagggaaaatcattcagaccctcatagcggtgttctggaattctgtgtgagggacaaaaattcagagcctcataggagtgttctggactcctgtgtgagggacaaatattcacaacacaacaggagtgttctggaatcccctgtaaggaataaacattcagagcctcgtggcagtgttctggagtcctatgtgagggacaaacactcagaccccagtagcagtgttctggagtcctatgtgagggacaaacgttcaaacaacagtgagagtgttccggaatgctatgttacggagaaacattcagactcttgttgcagtgttctggagttctatgtgagggagatacattcagaacccagcagcagggatctggaaccccatgtgacggccatacatgtagaccccagcagcagtgttctggaatcctatgtgagggacaaacattcagaccccagcagcagtgttttggaatcctatgtgtgtgtgacaaatattcagacccttgtagcagtgttccagaatcctatgtgagggacaaacactgagaatctagcagcagtgttctgcaaccctatatgagggacagacattcagaccacaacaggagtgttctggaatcctatatgagggacaaacattcagacaatcgtagcagtgttctggaatcctatgtgagggacaaacattcagacaatcgtagcagtgttctagagtcctaagtgagggaagaacattcagaccctcgtatcactgttctggatcctaagtgagggacaaacattcagaccacagcagagtgttctggaatccacagtgagggacaaactttcagaccctcgtggcagtgttctggaatcctatggagtggcaaacattcagacaattgtagcagggttctggaatcctgtgtgacgaaaaaaccttcagactcaagcagcagtgttctggaatcctatgtgagggacaaacattcaaacaacagcaggagtcttctggaatcctatgttacggacaaatattcagaccctcgtcgcagtcttctggaattctatgtgagggaggaacactcagaatcctgcagcattgttctggaatcccatgtgacggacatacatgtagacccctgcagccgtgttctggaatcctatgtgagggacaaatattcagaacccagcagcagtgttctggagtcccatgtgagggacaatcattcagaccatcgtagcactgttctggaattctgtgtgagggacaaacattcacactctcgtagcagtgttctggaatcctaagtgacggacaagcatttagacctcagcagaagtattctggaatcctatgtaagttacaaacattgaaacaacaacgggagtgttctggaatcctttattgcaaacaaactttcagaccctcgtcgcagtgctctggagttctatgtgagggagaaagactcagaacccagcagcagtgctctggaatcctatgtgacagacacacatgtataccccagcagcagtgttctggaatcctatgtgagggacaaacattcaaacaacagtgggagtgttctggaatcctatgttacagacaaacattcaggctctcatcacagtgttctagaatgctatgtgagggagaaacacccagaacccagcagcagtgttctgaaatcctatgtgacagacatacatgaagaccccagaagcagtgctgtggaacgctatgtgaggaatattcattcagaccccagcagcagtgttctggaatactgtgtgagggacaatcattgagaacctcgtatcagtgttctggaattctgtgtgagggacaaactttcagaccacagcaggagtgttctggaatcctatgtgatggacaaacactcagaagacagctggactattttgcaatcctatgtgagagacaatcattcagaccctcgtagcagtgttctggagtcctgtgtgaggaacaagcattcagaccacagcaggagtattctggaatcccctctgaagaacaaacattcaggctatcgtagcagtgttctggaatcctgtgtgactgacaaacattgagaccccagcagcagtgttctggagtgttatgtgagggacaaacattcagacactagtagcagtgttctggaatcctgtgtgagggacaaacactcagaacccagcagcatttttctgggtccctatatgagggacaaacactcggaacacagcttcagtgttttgcaatcctatgtgagggacaaacattcagaccctcgtagaagtgttctggaatcctatgtgagggacaaactttccgacaattataacagtgttctgcaatcctactttaaggacaaatatgcagaccctcgtagcagtgttctggaatcctatgtgagggacacacattcagacaatcgtagcagttttctggaatcctatgtgagggacaaacattcagaccccaacacaagtgttctgcaatcctacgttaaggacaaatattcagaccctcgtagcagtgttctggaatcctatgtgagggacacacattcagacaatcctagcagttttctggaatcctatgtaagggaaaaacattgaatcaacagcgggagtgttctggaatcctatgttatggacaaacattcagacgctcattgcagtgttctggaattgtacgtgagggaggaacactcagaacccagcagcagttttctggaatcctatatgatggacatacatgtagaccccagcagcagtgttctggaatcccatgtgagggacaaatattcagaccttcgtcgaattgtctggaatcctatgagaaggacaaacactcggaaaccagcagcagcattcaggaaccctatgtgagggacaaacattcagacaacagcaggattgttctggactccgatgtgagggatatacactcagaaaacagcaggagtgttttggaatcctatgtgagggacaaacattcagatcgtcgtagcagtgtcctggaattcttcatgagggataaacattcagacccccatagcagtgttctggaatcctatgtgagggacaatcattcagaccacagcaggagtgttctggaatctcctgtgaggaacagacattcagacccctaacagtgttctgaaatcctatgtgatggacaaacatttagacgccagcagtgctctggaatgcaatgtgagggacaaacattgagaccctcgtagcagtgttctggtatcctatctgagagaccaactctcagaaacaagcagcggtgttctggaaaattatgtaagggacaaagattcaggccaaagcaggtatgctctggaattctatgtgaggaacgaactctcagaatactgcaggagtgttttagtatcctatgtgagggacaaacattcagaccctcgtagcagtgttctggaatcccatgtgattgacaaacattcagaccacagcaggagtattctggaatcccctgtgaggatccaacattcagacccccataccagtgttctggaatcctatgtgagggacaaacatttagaccccagcagcaatgttctggaatcctatgtgaggaacaaacattcagaccctcgaagcagtgttctggaatcctatgtgagggacaaacattcagaaccaagcagcagtgttctggaactctgtatgagggacaaacattcagaacacggcaggattgttctgcaatcctatgtgagggagaaaccctcagaaaaccataggaatgttttggaatcctacgtgagggccaaacaatcaaaccctcgtagctgtgttccagaatcctatgtgggggcaaacactgagacaatcgtagcaattttctggaatcctttgtgagggacaaacattcattccctcatagcagtgtttgggaatcctgtatgaaggacaaacattcagaccacacagttctggaatccccactgtgggaaaaacattcagaccctcctagcagtgttctggaatcctatgtgatggacaaagatttagaccacagcagcagggttctgaaatcctatgtgaggaacaaacattcagatcctcgaagcagagttctggaatcctatgtaaggtacaaacattcagacaatagcagcagtgttatggaattctatgtgaggaacaaacgttcagacccacatagcaacgttttagattcctatgtgagggaccgacattcagacaatcgaagcagtgttctggaatcatatgtgagggacaaacattcggacaccagcagcagtgttctggaatcctatgtgagggacaaacatacaaacaagagcgagagtgttctggaatcctatgttgcggacaaacattcagacgctcgtcacaatgttctggaattctatgtgagggagaaacagtcagaacccaatagcagtgttctggaatcctatgtgacggacatacatgtagaccccagcagcagtgttttggaatcctatgtgagggacagtcattcagaccctcgtagcagtgttctggaattctgtgtcaagcacaaactttcagaccctcatagcagtgttctggaatcctatgtgagggacaatcatccaggccatagcaggagtgttctggaatcccctgtgaggaataaacgttcagacagtcgtagcagtgttctggaatgctatgtgagggacaaacattcagacaatcgtagcagtgttccgtaatcctatgtgagggacaaacattcaaacaacagcgggattgttcaggaatcctatgttatggacaaacattctagaccctcatcgcagtgttctggaattctatgtgagcgagaaacactcagaacccaaaagcagtgttctggaatcctatgtgagggacaaacattacgaccccagcgacagtgttctggaatcctatgtgagggccaatcattcagacactcgtgccagtgttctggaattctgcgtgagggacaaacattctgactcctgtagcagtgttctgtagtactgtgtgagggaaaaacattgagaccacagcaggagtgttctggaattccctgtgaggaacagacattcagaccctcttaggagggttctggaatccggtgtgatggacaaaaatctagaccctagcagcagtgttctgggatcctatgtgagggtcaaacattcagacccttgtagcagtgttctggaatcctatgtgagggagaaacactcagaacccagcagcagtgttctgaaaccctatgtgagagacaaacattctgacaacaggaggatagttctggaatcctaggtgagggacaaacactcagaaaacaacaggagtgttttggaatcctaaatgagggacagtcattcagatcgtcatagcagtgttctggaattttgtgtgagggacaaacattcacaccccagcagaagtgttgtggaattctaaatgagggacaaacattcagaccctcatagcaatgctctggaatagtgtgtgatggagaaacttttagaccccagcagcagtgttctgtaatcctttgtaagagaaaaacaatcagaccctcataggtgtgttctggaatcccatgtgatggacaaccactcagaacccagcagcagtgttctgtaactatatgtgaggggcaaacattcagaacacagcaggattgttctgtaatcccatgtgagggacaatcattcagaccctcgtggctgtgttctggaatcctaagtgagggacaaacattcagacaatcatagcagtgttctggaatcccatgtgagggaaaaacattcagaccctcccagcagtgttctggaatcctatgtgagggacaaacattcagacaaacgtagcagtgttctggaaacctatgtaagggaaaaacattcaaacaacaccgagattgttctggaatcctatgttacggacaaccattaataatctcttcacagtgttatggaattctacgtgagggagaaacacacagaacccagcagcagtgttccagaaacctatgtgagggactcacattcagaccacggcaggattgttctggaatcccatgtgagggacaaacactcggaacacagcaggagtgttttggattcctatgtgcggaacaaacattcagaacctcgtgacagtgttcgtgaatcctataggaggaactaacattcagaacacagcaggagtgttctggaatcctatgtgaagaacaaacattcagacccccgtagcaatgttttggaatcctatgtgaaggacaaacattcagacgatcgtagcagtgttctggaatccaatgtgagggacaaacatttaagctacggggagggggcgttctggaatcctatgttacggacaaacattcagaacctcgtcgcagtgttcttgaattctatgtcagggaaaaacagtcagaacccagcagcagtgttttggaatcctatgtgacagacacacatgtagaccccagcaacagtgttctaggatcctatgtgagggaaaaacattcagaccccagcagcagtgtcctcgaatcctatgtgagggacaatcattcagaccctcgtagcagtgttctggaattctgtgtgagggacaatcattcgactgtcatagcagtgttctggaatcctaagtgtaggacaaacattcagacaatcgtagcagtgatctggaaatctatgtgaggaacaaacattcacacactcttaggagggttctagaatcctatgtgagggacaaacattcagacaatagtagcagtgttctggaatcctctgtgagtgacaaacattcagaatccagcagcagtgttctggaatccaatgtgagggacaaacatttaaacaacaggcggggggttctggaatcctatgttacggacaaacattcagaacctcgtcgcagtgctatggaattctatgagagggagaaacagtcagaacccagcagcagtgttttggaatcccacgtgacggacatacatatagaccccagcagcagtgttctgggatcctatgtgagggacaaacattcagaccccagcagcagtgttcaccaatcctatgtgagggacaatcattcagaccccaagggccccaaatatccacttgcagattctactaaaagagtgtttccaaactgctcaatcaaaagaaaggttcaactctgtcagatgaatgcacacatcacgaagaattttctcagattgcttcagtctagattttatgtgaagatatttccttttctaccataggcagcaaagtgctctaaatgtccacttgcagattctacaaacagaagctttctaaatttctcaagcaaaagaaaagtttaactctgtgagatgaatgcacacatcacaaagaagtttctcagattgcttctgtctagattttatgtgaatatatttccttttctaccacaggcggcaaagcgctccaagtgtccacttgcagattccacaaaaagagagtttccaaactgctcaataaaagaaaggttcaactctgtgagatgaactcacacatcacaagaagtttctcagaattcttctgtctagtttttatgggaagttatttccttttagagcttaggcctcaaagcgctccatatgtccacttgcagtttctacgaaaagagagtttcaaaactactcaatcaaaagaaagttttgcttctctctagattttatgtgaagacaattccttttctaccataggctgcaaagcgcttcaaatgttcacttgcagattctacaaaaagagtgtttccaaactgctcaatcaaaagaaaggttcaactctgtgagatgaatgcacacataacaaagaagtttctcagattgcttctgtccagtttttatctgaagatatttccttgccaccataggcctcaaaggctaaaaatgtccacgtgcagattctacaaaaagagtttcaaaactgctcaatcaaaagaaaggtttaacattgtgagatgaatgcacacatcacaaagaagtttctcagaattattctgtctagtttttatgtgaagatatttcattttccaccataggcctcaaagcgttccaaatgtactcttgcagattctgcaaaaagagagtttcaaaactgctcaatcaaaagaaaggtttaactccacgagatgaatgcacaagtcacaaagaagtttctcagatagcttctgtctagattttatgtgaagataattccttttctaccataggccacaaagcactccaaatgtccatttgcaggttctacaaaaacagtgtttccacactgctcaattgaaagaaaggttcaactctgtgagacaaacgcacacatcacaaagaactttctcagaattcttctgtccagtttttatgtgaagatatttcctttccaccataggcctcaaagcgctaaaaatgtccacttgcagattctacaaaaagagttttgaaactgctcaatcaaaagaaaggtttaactctgtgacatgagttcacacatcacaaagaaatttctcagaatttttctgtctagtttttatgtgaagatatttccttttccaccataggcctcgaagcgttccaaatgtactcttgtagattgtacaaaaagagtttcaaagctgttcaatcaaaagaaaggtttaactctgtgagatgaatgcacacattgcaaagaagtttctcagattgcttctgtctacattttatatgaagatatatccttttctaccgtaggcctcaaagtgcaccaaatgtccacttgcagtttctacaaaaagagtgtttccaaactgctcaatcaaaagaaaagttgaactctgtgagatgaatgcacacatcacagggaagtttctcagattgtttctgtctagattttatgtgaagatatttccttttctaccgtaggctgcaaagcgctccaaatgtccacttgtagattcaacaaaaagagtgtttccaaactgctcaatcaaaagtcatgttcaactctgatcaatgaatgcacgcatcacaaaaaaagtttctccaaattcttcagtctagtttttgtgtgatgatatttcctttttaatcataagactcaaagcactccaaatgtccactaccacattctacaaaaagagagtttcaaaactgctcaatcaagatgaagttttaactctattagatgaatgcacacatcacaaagaagtttctcaggttgcttctgtgcagattttatgtgaagatatttccttttctaccacaggccgcaacgtgctccaaatatctacctgcagattctacaaaaagagtgtttccaaattgctcaatcaaaagaaatgttgaactctgtgagacgaatgcatgcatcacaaagaagtttctcagattgcttctgtctagattctatgtgaagatatttccttttctagcaaaggctgcaaagcactccaaatgtccacttgcagattttacaaaaagagtgttttcaaactgctcaatcaaaagaaaggctcaagtctgtgagatgaatgcacacatcacaaagaattttctcagaattcttctgtctagtttttaagtgaagatatttcctttccaccataggcctgaagacgctccaaatgtccacttgcagattccacaaaaagagagtttcaaaacgcctcaatcaaaaggaagggttaactctgtgagatgaatgcacacatcacaaagaagtttttcagattgcttctgtctggattttatgtgaagatgtttccttttctacagtaggccacaaatcgctctaactgtccagttgcagattctacaaaaagcgtgtttccaatctgcttaataaaaagaaagcttcaactctgtgagatgaacgcacatatcacaatgaagtttctcagaattcttctgtctagttttacatgaagatatttccttttccagctgaggcctccaagtgttcagattgtccacttacagatactacaaaaagagagtttcaaaactggtcagtcaaaagaaaggcttaactctgtgagatgaatgcacacatcacaaagaagtttcacagattgcttctttctagattttatgtgaagatatttccttttctactataggctgcaaagcgttccaaatatccacttgcagattctacaaacagaggctttccaaactgctcaataaaaagaaaagtttaactctgtgagatgaatgcacaaatcacaaagaagtttctcagaattcttctgtctagtttttatgtgaagatatttccttttccaccataggcctcaaagcgctccaaatgtccacttgcagtttctacaaaaagagagtttcaaaactgctcaatcaaaagaaaggtttaactctatgagatgaatgcacacatcataaagaagtttctcagattgcttctgtctagatgtgatatgaagatatttccctttctacaacaggccgcaaagcactccaaatgtccacttgcagattctacaaaaagagtgattccaaactgctcaatcaaaagaaaggctcaactctgtgagacgaattcacatatcacaaagaagtttctcagaattcttctgtccagtttttatgtgaagatatttacttttccaccataggcctcaaaccgctccaaatgtccacttgaagattctacagaaagagtttcagaactgctcaatcaaaagaaaggtttaactctgtgagttgaatacacatatcacaaagaagtttctcagattgcttctgtctaggttttatgtgaaggtatttccttttctactgtaggccacagagtgcaccaaatgtacacttgcaggttgtacaaaaagagtgtttccaaactgctcaatcaaaagaaaagttcaactctgtgagatgaacacacgtatcacaaagaagtttctcataattcttctgtctagtttttatgtgaagatatttccttttccaccataggcctcaaagggctccaactgtccacttgcagattctgcaaaaagagagtttcaaaactcctcaatcaaaagaaatgtttaactctgtgagatgaatgcacatgtcagagagaagtttctcagattgtttctgtctagactttatgtgaagatatttccttttcttccacaggctgcaaagtgctccaactgtcaacttgcagattctacaaaaagagtgtttccaaactgttgaatcaaaagaaattttcaaatctgtgagatgaaagcacacatcacaaagaagtttgtcagaattcttctgtctagtttttatgtgcagatatttcctttccaccttaggcctcaaagcgctccaaatgtccacttgcagattctaaaaaaggagagtttcaaaactcctcaatcaaaaggaaagtttaactctgtgagatgaatgcacacatcacaaagaagtttctcagattgcttctgtctagatgttttatgtgaagatatttctgtttcaaccataggccgcaaagcattgcaaatgtccacttgcagattctacaaaaagagtttccaaactgctcaatcaaaagaaaatttcagctttgtgagatgaacgcacacatcgcaaagaagattatcagaattcttctgtctagtttttatgtgaagatatttccttttccaccataggcctctaagcgctccaaatgtccacttcgagattctacaaaaagagtgtttccaaactgctcaatcaaaaaaaaggtttaactctgtgagataaatgcacacatcacaaagaagtttctcagatggcttctgtctagattttatgtgacgatatttccttttctaccatatgccacaaagttctccaaatgtccacttgcatattctacagaaagagtgtttcccaacggttcaatcaaaagataggttcaaatctgtgagatgaatgcacacgtcccaaagaagtttctcagaattcttctgtctagtttttatgtgcagatatttccttttccactgttggcctcaaagagctccaaatatccacttgcggattctacaaaaagagagcttcaagactgctcaatcaaaagaaaagtttaactccatgagatgaatgcacacatcacaaagaagtttatcagattgcttcagtctagactttatgtgaagatatttccttttctactacaggccacaaagcgctccgaatgtgcacttgcagattctacaaaagagggtttccaacctgctgtatcaaaataaagtttcaactatgagagatgaaagcacgcatcacaaagaagtttttcagaattcttctgtctagtttttatgtgaagagatttccttttctaccacaggcctaaaagggctccaaatgtccacttgcagatactacaaaaagagagtttcaaaactgctcaataaaaagaaaggtttaactctgtgagatgaatgaacacatcacaaagaagtttgtcagattgcttctgtctagattttatgtgaagatatttcattttctaccataggccgcaaagcgctaaaattgtccacatgtagattctgcaaaaagagtgtttccaaacagcccaatgaaaagaaactttcaactctgtgtgatgaacgcacgcatcacaaagtgatttcacagtattcttctgtctagtttttatgtgaagatatttccttttccaccacagttctcaaagagcttcaaatgtcgacttgcagattgttcaaaaagtgtttccaaactgctcgatcaaaaaaagtttaactctgtaagatgaacgcacacgtcacatagatgtttctcagttttcttctgtctagtttttatgtgaatgtatttcattttccacagtaggcctcaaggggcttgaaatgtccacttgcagattccacaaaaagagtaataaataactggac

SEQ ID NO: 1979 - DNA, 1062 bp, Homo sapiens
gtttcaaaactgctctatgaaaagatatgttcaactctgtgaattgaatgcaaacatcacaaagatgttttggagagtttttctgtctagtttttatatgaagatatttccttttccaccacaggcctcaaatctctccaaatgtccacttgcagaatctacaaaaagagtgtttcaaacctgctctgtcaaaagaaaagatcaactctgtgagttgaatgcacacatcaataagaaatttctgagaatgcttctgtctagtgtttatgtgaagatattcctgtttccaacgaagacctcaaagcggtccaaatatccacttgcagattccactaaaagagagtttcaaaactgctccatgataaggcctcaaatctctccaaatgtccacttgcaggttctacaaaaagagtgtttcaaacctgctctatcaaaagaaaagttcaactctgtgagttgaatgcacacatcacaaagaagtttctcagaatgcttctgtctagtgtttatgtgaagatactcccattttcaaagaaggcctcaatgcagtccaaatatccacttgcagattccactaaaagagggtttcagaactactctatgataaggtatgttcaactctgtgacttgaatgcacacatcacaaagaagtttctgagaatgcttctgtctaatgtttatgtgaagttatacccgtttccaatgaagtcctcaaagcagtccaaatatccacttgcagatactatgaaaagagtgtttcaaaactggtctatgaaaatgaaagttcaactctgtgagtttaatgcaaacatcataaagaagtttctgagtatgcttctgtctagttttgatatgaagatatttcctttcccaccatagtcctcaaagctctccaaatgtccacttgcagattctacaaaatgagtgtttcaaacgtgctctatctaataaacgttcaactctgtgagttgaatgcacacatcacaaagaagtttctgagaatgcttctgtcgagtgtttatgtgaagatgttcccatttccaacgaaggcctcaaagcggt

SEQ ID NO: 1980 - DNA, 10768 bp, Homo sapiens
caacggaagcctgaaagctgtcctaatatccacttgtaaattctacaagaagtgtgtttcaagactgctctatcaaagaaagttttaactctgtgagctgagtgcacacttcacaaagaagtttctgagaatgcttctgtctagtttttatgtgaagatatttcctttttcaccttaggcctcaaagcgctccaaatgtcctcagacagattccacaaaaagagtgtataaaaactgctctatgaaaaggaatcttcaactctgtgagttgaatgcaaacatcgcaaagaagtttctgaaaatgcttctgtctagtttttatgtgaagatattcccatttccaacgaaaacctcaaagctgtccaaatatccatcagcacattctacaaagagagtgtttcaaaactgctttatcaaaagaaaagttcaactctgtgagttgaatgcaaacctcacaaagaagtttctgagaatgcttctttctagtttttatgtgaagatattcccgtttccaaagaatgcctcaaagcgctccaaatatccacttgcaggattcacaaagtgtttcaaaactgctctatcaaatgaaaagttcaactctgtgagtttagtgtacacatgacaaataagtttcttagaatgctcctgtctagttttcatgtgaagatatttccttttttaccacaggcctcaaagctctccaaaggtccacttgcagattctacaaaaagagtgtttcaaaactgctctatgaaaaagaatgatgaactctgagagttgaagacaaacatcacagagaagtttctgagaatgcttctgtctagtttttatgagaagatattcccgtttccaacgaaagactcaaagctgtccaaatatacacctgcagattctacaagggagtgtttcaaaactgttctatcaaaagaaatgttcaactctgtgagttgagtacacacatcacaaagaagtgtctgagaatgattctgtctagtttttatgcgaagatatttcatttttcaccacaggcctcaagtcactccaaatgtccacttgcagattctacaaaaagagtgtttcaaaacagctctatgcaaaggaatgttcaactctttgagttgaatgcaaacctcgcaaggaagtttctgagtatccttccgtctagtttttatgtgaagatactcccgtttccagcgaaggcttcaaagctgtccaaatatccacttgcaaattttacaaaaagtttgtttcaaagctgctctatcaaaagaaagtttcaactctgtgagatgaatgcgcataaaacaaagatgttcctgataattcttctgtctggtttttatgtgaagacattcccgtttccaacaaaagtgtcaaagctgtcctaatatccacttataaattctacaagaagagtgtttcaaaactgctctatcaaaagaaaggtttaactgagtcagttgagtacacacatcaaaaagaagtttctgagaatgcttctgtctagtttttatgttaagataattcctttttctccataggcctcaaagcacaccagatgtccacttgcagattctccaatgagagtgtttcaaaactgctctatcaaaagaagggttcaactatgggagttgaaagcacatatcccaaagtagtttctgataaagcttctgtctagtttttatgggaagatattcccgtttcgaatgaaggccccaaagcattccaaatgtccattggagattctacaaaaagagagattcaaaactgctgtatgaaaaagattgttcaaccctgtgagttgaatgcacacatcacaaagaagttcctgagaatgcttctgtctagtttttatgtgaagacatttcctttttcaccataggcctcaaagcgctccaaatgtccacttgcagatactacaaaaagagtgtttcaaaactgatgtatgaagaggaatgttcaaatctgtgagttgaatgcaaacatcacaaaagtttctgagaatgcttctgtctagtttctatgtgatgatattccagtttccaacaaaagcctcaaaactgtccaaatatccatttgcagattctacaaggagagtgtttcaaaactgctctatacaaagaaaggttctactctgtgagtggagtacacacatcacaaagaagtttctgagaatgcctctgtctagtttttatgtgaaaatatttcattttccaaaataggcctcaaagtgctccaaatatccacttgcagatactacaaaaagagtgcatcaaaactgctctatgaaaaggaatcgtcaactctgtgagttgaatgcaaacatcacaaagaagtttctgtgaatgcttctgtgtagtttttatgtgaagatattcccgtttccaacgaaagcctcaaagctgtccaaatatccgttaacagattctacaaagagagtgtttcaaaacttctctatcaaaagaaaagttcaactctgtgagttgagtacacacatcaaaaagaagtttttgagaatgcttctgtctagtttttatgtgaagatattcctgtttctaaggcctcaaagcactccaagtctccacttgcagatattacaaaaagagtgttgcaaaactgctctatgaaaaggaacgttcaactctgtgagttgaatgcaaacatcaaaaagaagtttcctagaatgcttctgtctagttttatgtgaagatactcccatttccagcgaaggcttcaaagctgtccaaatatccccttgaaaattctacaaaaagagtgtttcaaacctgctctatcaaaggaaagtttcaactcagtgagttgaacgcacaaatcacaaagaagtttctgtgaaagcttctgtctggtttttatttgaagatattcccatttccaacgaaagccacaaagctgtccaaatatccacttgtaaattctacaagaagagtgtttcaaaactgctctatcaaaagaaaggtttaacactgtgagtggagtacacacatcacaaagaagtttctgagaatgcttctgtctagtttttatgtgaaaatatttcctttttcaccataggcctcaagcgctccaaatgtctacttgcacatactacaaaaagattttttcaaacttctctatgaaaaggaatattcaaccctgttagttgaatgcaaacatcacaaagaagtttctgagaatgctttgtctagtttttatgtgaagatacccccgtttccagcgaaggcttcaaagctgtccaaatatccacttgcaaattctttaaaaagagtgtttcaaagctgctttatcaaaggaaatttcaactctgtgagttgaatgcacacatcacaaagaagtttctgagaatgcttctgtctggttttaatgtgaagatattcccgtttccaatgaaagcctcaaagctgtcctaatatccacctgtaaattctacaagaatagtgtttcaaaactgctctatcaaaggaaaggtttacctttctaagttgagtacacacattacaaagaagtttctgagaatgtttctgtctggtttttatgtggagataatcccgtttccagtgaaggcctcaaagctgttcaaatatccacttgcaaattctacaaaaagagtgtttccaatctgctatatcaaaatagagtttcaacactgtgggttgaatgcacacatcacaaagaagattctgagaatgcttctatttttcacatgaagacaatcccgtttccaatgaaagcctcaaagctgtctaatatccacttgcaaattctacaaaaatagtgtttcaaaactgctctatcaaatgagtggttcaactctgggagttgaatacactcatcacaaagaagtttctgagaatgcttctctctagtttttatgtgaagatatttcctttttcaccataggcctcaaagagctccaaatatccagttgcagattctacaaacggtgtgtttcaaaactgctctatgaaaaggcatgttcaactctgtgagttgaatggaaacatcacaaagaaatttctgagaatgcttctgtctagtttttatgtgaagctactcgcgtttccagcgaaggcttcaaagctgtccaaatatccacttgtaaattctgcaaaaagagtgtttcaaagctgctctaacaaagtaaagattcaactctttgagttgaatgcgcaaatcacaaagaagtttctgtgaatgcttctgtctggcttttatgtgaggatattcccgtttccagcgaaagcctcaaagctgtccaaatatccagcttgaaaattctacaagaagagtgtttcaaaactgctccatcaaaacaaagtttaactctgtgagttgagtacacatatcaaaaagaagtttctgagaatgcttctgtctagtttttatacgaagatatttccttttccaccataggcctcaaagcgctccaaatgtcaacttgcagattctacaaaaagagagtttcaaacctgctctatcaaagaaatattcaaatatgtgaggtgaatgcacacagccaaaggaagtttctgagaaaacttctgtgtcgtgatcatgtgaaggtactcccgtttccaatgatgtcctcaaagtggcccaaataaccacttggagatactactaaaagagtgtttcaaaactgctctaggataaagtatgttcaactctgagaattgaaggcaaacatcacaaagaagtttctgagaatgctgctgtttagttttaatgtgaagatatttccttttccaccatagacatcaaatcgctcataatgtccacttgcagattctgcaaaaagagtattaaacctgctctatcaatagaagggtcaactctctgagttgaatgcacacatcaaaatgaattttcctagaatgcttctgtctagtttttatgtgaagaaactcccgtttccagggaaggcctcaaagctgtccaaatatccacttgcaaattctacaaaaagagtgtttcaaatctgctccatcaaaagaaaatttcaaatctgtgagttgaatgcacacagcacaaagacgtttttgagaaagcttcattgtgtgaagatactcccgtttccaacgaaagcctcaaagccgtccaattatacacttgcagatactactaaaagagtgtttcaaaactgatctatgataaagtatgttaaactctgagagttgaatgcaaacgtcacaaataagtttatgagaatgcttctgtctagtttttatgtgaagatatttccttttcctccataggccacaaagcgctcctaatgtccacttgtagattccgcaaaagagtgtttcaaacctgctctataaaaagaaaggttcaactctgtgagttgaatacacacagcacaaagaaatttctgagaaagcatcattatgtaaagatactcccgtttccaatgaactcaaagccctccaattatccacttgcagatactactaaaagagtgtttcaaaactgctctatgataaagtatgttagactctgagaggtgaatgcaaacgtcacaaataagtttatgagaatgcttctgtctagtttttatgtgaggatatatccttttccaccatatgccaaaaagagctccaaatgtccacttgcggatcctgcaaaaagagtgtttcaaccctgctctacgaaaaggaaggttcaactctgtgagttgaatggacacatcacaaagtagtttctgagaatgcttctgtctagtttttatgtgaagatattcccgtttccaacgaaggcctcaaagtggtccaaatatccacttgcagattctacgaaaatagtgtttcaaaactactctatgaaaagggaggttcaactctgtgagttgaatgcaaacatcacaaagaagtttctgacaatgcttctgtctagtttttatttatagatatttccttttccaccataggcctccaagctctccaaatgtctgcttgcagattctacaaaaaaagtgcttcaaacctgctctatcaaaagaaaggttcaattctgtgagtgaaatgaacacatcacaaagaagtttctgagaatgattctgtctagtgtttatgtgaagatatccccttttccaacgaaggcctcaaagtggttcaaatatccacttgcagattctacaaaaagagtgtttcaaacctgctttattaaaggaaagcttcaactctgtgagttgaacgcacacatcacaaagaagtttctgagaatgcttctatctagtgtttatttgaagatattcccgtttccaatgaaggcttcaaagcgttccaaatatccacttgcagattctgcaaaaagagtgcttcaaaactgctctatgaagaggcctcaaagctcgccatttgtccacttgaagattctacaaaaagagggcttcaaacctgctctatgaaaagaaaggctcaactctgttagttgaatgcacacatcacaaagaagttcctgagaatgcttctgtctagtgtttatgtgaagataatcccgttgccaatgaaggcctcaaagcagtgcaaatatccacttgcagattctacaaaaagagtgtttcaaaagtactctatgataaggtatgtccaaccttgtgatttgaatgcacacatcataagaagtttctgagaatgcctctgtctagtttttaatgggaagatatttccttttccaccataggcctcaaagcgctccaaatgtccacttgcagattctagaaaaagagtgtttcaaacctgctctatcaaaagaaaagttcaaatctgtcagttgaatgcacacagttcaaaaaagtttttgagaaagcttctgtctagtgattatgtgaagatattcccgtttccaacaaaggcctcaaagcggtccaaatgttcacttgcagattctacaaaaagagtgtttcaaaactgctctatcaaaagaaaggtacaactctgtgagtagaatgcacacatcacaaagtagtttctgagaatgcttctctctagtttatatgtgagatatttacttttccacgataggcctcaatgctctccaaatgtccacttgcagattctacaaaaagagtgtttcaaacatgctctatgaaaagaaagtttcaactcttggggttgaatgcacacatcacaaagaagtttctgagaatgcttctgcctgtttttgtgtgaacatattcccgtttccaacaaaggcctcaaagcgtttcaaatatccacttgcatattctacaaaaagagtgtttcaaaactgctctatgaaaaggtatcttcaaatctgtgagttgaatgcaaacatcgtaaagaattttctgagaattcttctctcttatttttatatgaagatataaccttttccaccataggcctcaaagctctccaaatgtcaacttgcagattctacaaaaagagtgtttcaaagctgctctatgaaaagaaaggttcaactctttgagtttaatgcacacctgaaaaagaagtttttgagaatgcttctgtctagtgtttatgtgaagacattcccgtttccaacgaaggcctcatagcggtccaaatatccgcttgcagattctataaaaagagtgtctaaaaactgctccaaggaaaggtatcttcaactctgtgagttgaatgcaaacatcacaaagacgtttctgagaacgcttctgtctaatttttgtgtgaagatatttccttttccaccataggactcaaagctctccaaatatccacttgcagatactaagaaaagaatgtttcaaacctgctctatgaaaagagaggttcaactctgtgagttgaatgcacacaccacaaagaagtttctgagaacgcttctctctagtttttatgtgaagatacttccttttccaccataggcctcaaagctctccaaatgtgcacttcagattctacaaaatgaatgtttcaaacctgctctatcaaaagaaaggttcaactctgtgagttgaatgcacacatcacaaataagtttatgagaatgcttccgtctagtttttatgtgaagatatatcctttttcaccataggcctcaaagagctccaaatatccacttgcagatcctgcaaaaagagtgtttcaaccctgctctatgaaaagaaaggttcaactctgtgaggtgaatgcatacatcaaaagtagtttctgagaatgcttctgtctagtttttatgtgaagatattcctgtttccaacgaaggcctcaaacagtccaaatatccacttgcagattataagagaagagtgtttcaaaattgctctatgaaaagggaggtttaactctgtgagttgaatgcaaacatcacagagaagtttctgagaatgcttctgtctagtttttatttatagatatttccttttccaccataggcctcaaagctctccaacagtcaacttgcagattctacaaaaaaagtgtttcaaacctgctctatcaaaagaaaggttcaattctgtgagtggaatgcacacatcacaaagaagtttctgagaacgattctgtctagtgtttatgtgaagatatctccttttccaatgaaggcctcaaagttgttcaaatatccacttgcagattctacaaaaagagtgtttcaaacctgctctatcaaaagaaagcttcaactctgtgagttgaatgcacacatcacaaagaagtttctgaaatgcttctatctagtgtttatttgaagatattcccgtttccaacgaaggcttcaaagcattccaaatatccacttgcagattctgcaaaaagagtgcttcaaaactgctctatgaagaggcctcaaagcttgccatatgtccacttgaagattctgcaaaaagacggtttcaaacctgctctatgaaaagaaaggttcaactctgtgagttgaatgcacacatcacaaaggagttgttgagaatgcttctgtctagtgtttatgtgaagataatcccgttgccaaggaaggcctcaaagcagtgcaaatatccactctcagattctactaaaagagtgtttcaaaagtgctctatgataaggtatgttcaactctgtaaattgaatgcacacatcataagaactttctgagaatgcttctgtctggtttttatgggaagatatttccttttccaccataggcctcaaagcactccaaatgtccacttgtagattctggaaaaagagtgtttcaaacctgctccatcaaaagaaaggtacaactccgtgagttgaatgcacacagtacaaaaaagtttttgagaaagcttctatctagtgattatgtgaagatattcccgtttccaatgaaggcctcaaagcggtccaaatattcacttgcagattctacaaaaagagtgtttcaacactgctctatcaaaaggcctcatagctctaaaaatgtccggtgccgattctacaaaaagagtgtttcaaacatgctctatcaaaagaaagtttcaactctttgagttgaatgcacacatcacaaagatgtttctgagaatgcttctgcccgtttttgtgtgaacataatcccgtttccaacgaaggcctcaaagcgttccaaatatccacttgcagaatctaggaaaagagtgtttcaaaactgttctatgaaaaggtacgttcaactctgagttgaatgcaaacatcacaaagaagtttctgagaattcttctctctaatttttatatgaagatataaccttttacaccataggcctcaaagctctccagatgtccacttgcagattctactaaaagagtatttcaaagctactctatcaaaagaaaggttcaactctttgagtttaatgcacgcatgacaaagaagtttttgagaatgcttctgtctagtgtttatgagaagatatttccatttctaaagaaggcctcatagcagtccaattatccacttgcagattctacaaaaagagtgtctcaaaactgctccatggaaaggtatcttcaactttgtgagttgaatgcaaacaccacaaagacgtttctgagaatgcttctgtctagtttttgtgtgaagatatttccttttccaccataggcctcaaagctctccaaatgtccatttgcagattctacaaaaagagtatttcaaacctgctatatcaaaagaaaccttcaactctttgtgttgaatgaacacatcacaaagttgtttctgagaatgcttctgtctagtttttatgagaaaataattccttttccaccataggcctcaaagctctccaaatgtccacttgcagattctacaaaaagagtgtttcaaacctgctctattaaaagaaaggttcaaatctttatgttgaatacacacatcacaaagaagtttctgagaatgcatctgtctagtttttatgtgaagatattcccgtttccaatgaaggcctcaaagcggtccaaatatccacttgcagattctactaaaagagtgcttcaaaactgctctatgacaaagtatgttcaactcggtgagttgaatgcacgcatgacaaagaagtttttgagaatgcttctgtctagtgtttatgagaagatatttccatttctaacgaaggcctcatagcggtccaaatatccacttgcagattctacaaaaagagtgtctcaaaactgctccatggaaaggtatcttcaactttgtgagttgaatgcaaacaccacaaagacgtttctgagaatgcttctgtctagtttttgtgtgaagatatttccttttccaccataggcctc

SEQ ID NO: 1981 - DNA, 4081 bp, Homo sapiens
atcaaatctgtgagttgaatgcaaacatcacaaagaagtttcggagaatgcttctgtctagtttttatgtgaagatattcccgtttttaaggaaagcttgaaaggtgtcctaatatccacttttaaattttacaaaaagagtgtttcaaaactgctctatcaaaagaaagctttatctctgtgagttcagtacacacattacaaaccagtttctgagaatgcttctgtctagtttttatgtgaagatatttcctttttcaccataatcctcaaagcgctccaaatgtccacttccagatattacaaaaagagtgtttcaaaactgctctatgaaaaaaaatgttcaactctgagagttgaatgcagacatcacaaagaagtttctgagaatgcttctgtctagtttttatgtgaagatatttcctttttcaacataggcctcaaagcacaacaaatgtccacctgccgattctacaaagagagtgtttcaaagcttctctatcaaaagaaggtttcaactctgtgagttgaatgcacacttcacaaaggtgtttctgacaatgcttctgcctagtttttatgtgaagatattcccgattcgaacaaaggcctcaaagcgctacaattgaccacttccagattctacaaaaagagtgtttcaaatctgctctatgaaaagcaatgttcaattctgtgagttgaatgcaaacatcacaaaaattttctgagaattcttctgtttagtttttatatgacgatatttcctttttcaccatagacctcaaagggctccaagtgtccacttacagattctacaaaaagagagtttcaaaactgctctatgaaaagtaatgttcaactctgtgggttgaatgcaaacatcacaaagtagtttctgagaatgcttctgtctagtttttatgtgaaaatattcccatttccagcgaaggcctcaaagctgtccaaatatccacttgcaaattctataaaaagagtgtttcaaatctgctctatcaaaggaaagtttcaactctgtgagttgaatgcgcacatcacaaagaagtttctgagaatgcttctctctgctttttatgtgaagatattcccgtttccaacgaaagcctcaaagctgacctaatatccacttgtaaattctacaaaaagtgtgtttcagcactgctctatcaaaagaaagcttttactctgtgagttgagtacacacatagcaaagtagtttctgagaatgcttctggctactttttatgtgtagacatttcttttttcaccataggcctcaaatcgttccaaatgtccacttgcagattctacaaaaagagtgtttcaaaactcctctatgaaaaggaatggtcaactctgtgagttgaatgcaaacatcacaaagatgtttctgagaatgcttctgcctagtttttatgtgaaaatattccgtttccaatgaaagcctcaaagctgtccaagtattcccttgtagatcctacaaagagagtgtttcaaaactgatctatgaaaaagaaacgttaaactctgtgagtagaggacacacatcacaaagaagtttcttagaatgcttctgtcttgtttttatgtgaagatattcctgtttccagtgaaggcctcgaagctgtccaaatatcaacttgcaaattctacaaaaagagtttttccaatctgctctatgaaaagaaaagttcaactctgtgagtttaatgcacacgtttcaaagaagtttctgagaatgtttccatctggtttttatgagaagatatttcatttttcaccataggcctcaaagcgctccaaatgtccacttccagatgttacaaaaagagtgtttcaaacctgctctgtgaaaaggaatgttcaactcggtgaaatgaatgcaaacatcacaaagaagtttctgagaattcttctgtctatttttttgtgtgaagatatttctttcccaccatactcctcaaagctctccaaatgtccactttcagattccacaaaaagggagtttcaaaactgctctgtcaaaagaaaggttcaactctgtgagttgagtgcacacatcacaaacaagcttatgagaatgcttctgactagtttttattttaagatatttcctttttcaccataggcctcaaagcacaccaaatgtccacttgcagattctacaaagacagtgtttcaaaactgctgtatcaaaggagcggctcaactctgtgagttgaaggcacacatcacaaagatgattctgataatgattctgtctagcttttctgtgaagatattccctttttgaacgaaggcctcaaagcgctccaaatgaccacttgcacattctacaaaaagagtgtttcaaaactgctctatgaaaaggaatgttcaactctgtgagttgaatgcaaacatcacaaagaagtttctgagacagcttctgacttgtttttatgtgaaaatattcccgttaccaatgagagcctcaaatctctccaaatatcaacttgcagatcgtacaaagagtgtttcaaaatttccctatcaaaagaaatgttccactctgtgagttgaggacacacatcacgaagaagtttcttagaatgcttctgtcttgtttttatgtgaagatattcccgtttcctgtgaaggcctcaaatttgtccaaatacccacttgtaaatactacaaaaagagtgtttccaatctgctctatcaaaagaaaggtttaactctgtgagttgactgcacacatctcaaagaagtttctgagaatgcttctgtctagttttcatatgaagacatttcctttttcactgtaggtctcatagcacaacaaatgtccacttgcagattctacaaagagagtgtttcaaaactgctctataaaaagaaaggttcatctctctgacttcactacacacatcacaaagaagtttccgaggatgcttctgtctagttttcatgtgaaggtatttcctttttcgccataggcctcaaagccccccaaatatccacttccagatactacaaaagagtgtttcaaaactgctctatgaagaggaatgttcaattctgtgagttgaatgtaagcatcacaaaaagttactgagaatgcttctgtctagtttttttgttaagatatttctttttcaccgtagacctcaaagcacaccaaatgtccacttgcagatctacaaagagagtgtttcaaaactgctctatcaaaagaagggttcaactctgtgagttggatgcacacatcagaaagatgtttctgataatgattctgtctaatgtttatgtgacgatatttcctttttcaccttaggcctcaaagcgctccaaatgtccccttccagatactacaaaaagagtgtttcaaaactgctctatcaaaagaaaggttcaactctgtgagttgagtgcacacatcacaaacaagtttttgagaatgcttctgtctagtttttatgtgaagatattcccgtttccaatgaaagcctcaaacctgtccaaatattcatttgcagtttccacaaagacagtgtttcaaaactgctttatcaaaagaaagattcaactctgtgagttgagtacacacatcacaaagaggtttctgagaatgattctgtacagtttttatgtgaagatattcccgtttccaacgaagacttcaaagcgttccaaatgtccacttgcagattctacaaaaagactgtttaaaaacgctccatcaaagaaaattttcaactctttttgttgagtgcgcacatcacaaagatgtttctgataatgattctgtctggtttttatgtgaagatatttcctttttctccagaggcctaaaagtgctccaaatgtccactagcagatactacaaacagagtgtttcaatactgctctattgaaaggaatgttcaactatgtgagttgaatgtaaacatcacaaagatgtttttgagaatacttccgtctagtttttatgtgaagataccccggtttccagcgaaggcgacaaagctgtccaaatatccacttgcaatttctacaaaaagagtgtttcaaatctgct

SEQ ID NO: 1982 - DNA, 3915 bp, Homo sapiens
gcagttttgaaacattatttttgtgcaatctgcacctggacattaggagcactttgtggccttcgttggaaacgagaatatcttcacataaaaactagaaagaagcattctcagaaacttcattgtgatatttgcattcaactcacagagttgaacattccttgtcatagagcagttttgaaacactctttttgcagaatctacagtggtcctttggagcactttgaggccttcgttcgaaacaggaatatcttcatttaaaaactagacagaattattatcagcaacatctttgtgatttctgcattcaactcagagaattgaactcttcttttgatagagcagttttgaaacactctctttgtagaatctgcaagtggacttttggtgtgctttgaggcttgtggtgaaaacggaaatatgttaacatgaaaactagacagacgcattctccgaaacttatttgtgatgtgtgcactcagctcacatagttgaacctttcttttgagagagaaattttgaaaccctctttttgtggaatctgcaagcgcacatttggaacgctttgtggcctacgttggaaacgggaatatcttcacataaaaactagacagaagcattctcagaaacttctttgtgatgttgacattcaactcacagagttgaacattccctttcatagagcagttttgaaacactctttttgtagaatctggaagtggacgtttggagcgctttgaggccaatggtgaaaagaaatatcttcacataaaaactagacagaagcattctcagaaacttctttgtgatatgtgtactcaactcacagatttaaatctttcctttgatagagcagttttgaaacactcttcttgtagaatttgcaagtggatattaggacagctttgaggctttcgttggaaatggtaatatcttcacataaaaaccagacagaagcattctcagaaacttctttgtgaggtttgcattcaactcacagagttgaacatttcttttcatagagcagttttgaagcactcttttcgcagaatctgcaagttgtcatttgtagcactttgaggccttcgttcgaaacgggaatatctccacataaaaactagacagaatcattatcagaaacatctttgtgatgtgtgcattcaactcacagagttgaacctttcttttgatacagcagttttgaaacactctgtagaatgtgcaagtggacatttggtgtgctttgtggcctattgtgaaacaggaaataatataaaaactaggacagaagcattctcagaaacttatttgtgaagtctgcactcaactcacatatttgaacctttcttttcttagagaagttttgaaacactctttttgtggaatctgcaagtgcacatttgacgcgctttgtggcttttgttggaaacggaaatatcttcacacaaaaactcgacagaaccattctcagaaacttctttgtgatgtttgcattcaactcacagagttaaactttccccttcatagagcagttttgaaacactctttttgtagtacctggaaacggacatttggagcgctttgaggcctatgctgaaaaaggaaatatcttcatataaaaactacacagaagcattctcagaaacttctttgtgatgtgtgtactcaaatcatggagttgaacctttcttttgatacagcagtttggaaacagtctatttgtagaatctgaaagtggatatttgggtagctttgaggctttcgttggaaacgggaatgtcttcacataaaaactagacagaagcattctcagaaacttttttgtgattcttttattcaactcacagagttgaacattccttttcatagagcagatttgaaacactctttttgaagcatctgtaagtggaaaattggagctctttgaggcatatgctgaaaaaggaaatatcttccaataaaaattagacagaagaattctcagaaacttccttgtgatgtgtgtactcaactcacagagttgaacctttcttttgatagagcagttttgaagcactctttttgtagaatctgcaagtggatatttggatagctttgaggctttcgttggaaacgggaatgtcttcacataaaaaccagacagaagcattctcagaaactttttttgatgcttgtattcaactcacagagttgaacattccttttcatagagcagttttgaaacactctttttgaagaatctgtaagtggaaacatggagttctttgaggcatatgctgaaaaaggaaatatcttctaataaaaactagacagaagaattctcagaaacttctttgtgatgagtgtactcaactcacagatttgaacttttcttttgatagagcagttttgaaacactctttttgtagggtgtgcaagtggatatttggatagctttgaggatttcgttggaaaagggaatatcttcacataaaaaccagagagaagcattctcagaaacttatttgtgatgcttgcattcatctcacagagttcaaaattcctattcatagagcagttttgaaacactctttttatggaatctacaagtggacatttggagcgatttgagacctatggtgaaaaaggaagtatcttcacataaaaagtagacagaagtattctcagaaactattttgtgatgtgcgtactcaactcacagagttaaacctttcctttgatacagcagttttgaaacactcttcttgtggaatttacaagtgcatataaggacagcataaaggatttcgttggaaacggggatatctgcacataaaactagagagaagaattctcagaaacttctttgtgatgtgtgcattcaactcacacagatgaaattttcctttggtagagcaggttggaaacactctttttgtagaatttgcaagtggatatttggacagctttggggcctttgctggaattgggtatatcttcacataaaaactagacagaagcattttcagaaactactttttgatgcatgcattcaactcgcagaattgatcattccttttcatagagcggttttgaaacactctttttgtagaatctgtaagtggaaacttggagcactttgaggcctatggtgaaaaaggaaatatcttcccataacaactagacagaagaattctcagaaacttccttgtgatgtgtgtactcaactcacagatttgaacatttcttttaatggagctgttttgaaacactctttttgtagaatctgcaagtggatatttggacagctttgaggctttcgttggaaacggaaatatcttcatataaaaactagacagaagcattctcagaaaattctttgtcatgtgagtcctcaactcacagagttcaacttttcttttgatagagcagatttgaaacactctttttgtagcatctgcaagtggatatttggatagctttgaggatttcgttgataaagtgaatatcttcacataaaaactagagagaagcgttctcagaaatgtctttgtgatgtttgcattcatctcacagagttgaacattccctttcatagagcatttttgaaacactcttttcgtagtatctgcaagtggacatttggagcgctttgggtcctacagtgaaaaaggaattatcttcacataaaaaggagacagaagcattctcagaaacttcttggtcatgtgtgtactcaactcacagagttgaacctttcttttcatacagcagttttgaaaaactctttctgtaggatctgcaagtagatatttggatagctttaagggtttcgttggaaacgggaatatcttctcataaaaactaatcagaagcattctcagaaacttctttgtgatgcttgcattcagctcacagagtttaacgttccttttc

SEQ ID NO: 1983 - DNA, 4205 bp, Homo sapiens
gaatgttggcctgccttgctagattggggaagttctcctggataatatcctgcagagtgttttccaacttggttccattcttcccatcactttcagtgagatgaacccggtacctcagatggaaatgcagaaatcatccatcttctgcgtcgctcatgctgggagctgtagaccagagctcttcctattcggccatctacacacacatcacaaagaagtttctgagaatgcttctgtctagtttctatgtgaggatatttcctttttcaccataggcctccaagtgctgcaagtgtccactaccagatacaacaaaaagagtgtttcaaagcttctctatgaaaaggaatgttcaactctgtgagttgaatgcaaacatcacaaaatagtttctgagaatgcttctgtctggtttttatgtgaagataatccagtttccaatgaaatcctcaaagctatccaaatatccacttccagattctacgaaaagagtgtttcaaaactgctctatcaatagaagagtacaactctgtgagttgagtacacacatcccaaggaagtttctgagaattcttctgtctagtttttatgcgaagatatttccttttacaccataggcctctaagcgctccaaatgttcacttacagattctacaaaaagagtgtttcaaaactgctctatgaaacggaatgttcaactctgtgatttgaatgcaaacatcacaaagaagtttctgggactgcttctgtctagtttttaagtgaaggtattctcgtttccaacgaaatcctcatagcattctaaatatccacttgcagattctacaaaaagggtgtttcaaaacagctctatcaaaagaaaagttcaactctgagagttgagtacacatatcacaaagaagtttctgagaattcttctgtctagtttttatgggaagatatttcctttttcaccataggcctcaaagggctccaagtttccacttacagattctacaaaaagagtgtttcaaaactgctctaggaaaacgaatgttcaactctgtgagttgaatgcaagcatcacaaagtagtttctgacaatgcttctgtctagtttttatgtgaagagatacctgtttccaacgaaggcctcaaagctgtccaaatatccacttgcaaatactacaacaaaagtgtttccaatctgctctatcaaaagaaagattcaactctgtgagttgaatgcacacatcacaaagaattttctgagaatgcttctgtatagtttttaattgaagatattcctgtttccagtgaaatcctcaaagctatccaaatatccactttcagattctacaaaaagagtgtttcaaaactcctgtctcaaaagaaatgttcaactctgtgagttgagtgcacacatcacaaagaagtttctgggaatgcttctgtctaatttttatatgaagatgtttcctttttcaccataaggcacaaatcgctccaattgtccacttccagatacgacaaaaagagtgtttcaaaactgctccatgaaaaggaatgttcatctctgtgagttgaatgcaaacatcacaaagaagtttctgagaatgcttctctctagtttttatgtgaagatattcccgcttccaatgaaatacccaaagctatccaattatccattttgagtttctccaaaaagagtgtttcaaaactgctgtattaaggaaaggttcaactctctttgttgagtacacacatcataaagaaatttctgagaatgcttctgtctagtttttatgtgaagatatttcctttttcaccatagacctcaaagcgctcaaaatgtacacttccagatactacaaaaagagtgtttcaaaactgttctatgaaaaggaatgttcaacactgtgagttgattgcgagcgtcacaaagaagtttctgacaatgcttctgtctagtttttctgtgaagatattcccgttgccaacaaaagcctcatagctatccgaatatccacttgcagattctacaaaaagagtgtttcaaaactgctgtatcaaaaaaaatgttcaactatgtaagttgagtacacacatcacgaagcagtttctgagaatacttctgtctagttttctgtgaagatatttcctttttaaccaaaggcctcaaagcgctgcaaatctctactttcagatactacaaaaagagtgtttcaaaactgctctatgaaagggaatgttcatctctgtgagttgaatgcaaatatcacaaattagtttcttagaatgtttctgtctcgtttttatgtgaagatattcccacttccaaggaaatactcaaagcgatccatatacccacttgcaaaccctacaaaaagagtgtttcaaaactgctctttcaaaagaaaagttcaaccctataaagttgagtacacacatcacaaagaagtttctgagaattcttctgtctagtttttatggtaagatattttcaacatagccctcaaagcgctccaagtttccactgacaggttcttcaaaaagagtgtttcaaaactgctctatgaaaaggaacgttaaactctgtgagctgaatgcaagcatcacaaagaagtttctgagaatgcttctgattagtttttatgagaagatattcccgtttccaacgaaacccttaaagctatccaaatatctacttgcagatcctacagaaagagtttttcaaaactgctgtatgaaaagaaaggttcaactctgtgagttgagtacacacatgaccaagaagtttctgagaatgcttctgtctcctttttatgtgaagataattcctttttcactgtaggacccaaagcgctccaaatgtccacttgcagatactacgaaaagagtgtttcaaaaatgctctatgaaagggaatgttcaactctgtgagatgaatgcaaacatcacaaagacatttctgagaacgcttctctctagtttttatgtgaagatattcactttatcaacgaaatcctcaaagctatccaaatatccacttgcagatgctacaaaaagagtgtttcaaatctgctctatcaaaagaaaagttgaactctgtgagttgaggactcacatgacaaagaattttctgagaatgcttctgtctagtttttatatgaagatatttccgtttccaacgaaagcctcaaagctgtccaaatatccacttgcagattctacaaaaagagtgtttcaaaacagctccattaaaagaaatgttcaaatctgtgagttgagtacacacatcacaaggaagtttctgagaattcttctgtctagttgttatgggaagatatttcctttttcaccataggcctcaaagtgctccaagtttccacttacagattctacaaaaagagtgtttcaaaaccgctctatgaaaaggaatgatcaattctgcgagttgaatgcatgcatcaaaaagtagtttctgaaaatgcttctgtctagtttttatgtgaagatatacccaattccagcaaaggccccaaagctgtccaaatatccacttgcaaattctacaaaaagagtgtttccaacctgctctaccaaaggaaaatttcatctgtgtgagttgaatgcacacatcacaaagaagtttctgagaattcttctctctagttttatgtgcagatatccccgtttccaacgaaatcctttatgctgtccttatatgcacttgtaaattccacaagaagagtgtttcaaaactgctgtatcaaaggaaaggtttaactctgtgagttgagtacgcacatcacaaaatagtttctgagaatacttctgtctactttttatgtgaagatacttcctttttcaccataggtctcaaatcgctccaaatgtccacttgtagattccataaaaagagtgtttcaaaactgctctatgaataggaattttgaactctgtgagatgaatgcaagcatcacaaataagtttctgagaatgcttctctctggtttttatgtgaagatattcccttttccaacgaaatcctcaaagctatccaaatatccacttgcacaccctacaaaaagagtgtttcaaaactgctctatcaaaagaaaagttcaaatctgtgagttgagtacactcatcacaaagaagtttctgagaattcttctgtctagtttttattagaagatatttcctttttcagcatatgcctc

SEQ ID NO: 1984 - DNA, 17954 bp, Homo sapiens
ctttgtggttttatctacttgtggtctctgatgatggtgatgtacagatgggtttttggtgtggatgtcctttctgtttgttagttttccttctaacagacaggaccttcagctgcaggtctgttggagtttgctacacgtccactccagaccctgtttgcctgggtaacagcagtgttggctgcagaacagtggattttcatgaaccgcgaatgctgctgtctgatcgttcctctggaaattttgtctcagtggattgcccagccatatgaggtgtctgtctgcccctactgggggttgcctccctgttaggctgctagagggtcaggggtcagggacccacttgaggaggcagtctgcccattctcagatctccagctgcgtgttgtgagaaccactgctctcttcaaagctgtcagacagggacatttaagtctgcagaggttactgctgtctttttgtttgtctgtgccctgcccccagaggtggagcctacagaggcaggcaggcctctttgaggtgtggtgggctccacccagtttgagcttcctggctgctttgtttacctaagcaagcctgggcaatggtggacgcccctcctgcagcctcgctgctgccttgcagcttgaactcagactgctgtgctagcaatcagccatactccatagccataggaccctccgagccaggtgcgggatataatctcctgttgcaccggtttttaagcctgtcagaaaagcgcagtgttcaggagagggtgacccgattttccaggtgccatctgtcacccctttctttgactaggaaagggaactccctgaccccttgcacttcctgagtgaggcaatgcctcaccctgcttcagctcctgcacagtgcactgcacccactctcctgcacccactgtagggctggcacttcctagtgagatgaacccagtacctcagacggaaatgcacaaatcatccatcttctgtgtcgctcacgctgggagctgtagaccagagctgttcctattcggccatcttggctgccttccagtgttctggaatcccatgtgatgggcaaacattcagacaatcgtagcagtgttctggaattctatgtgatgcacaaacattcggaacctcatcacagagtgctggaattctatgtgaggtagaaacattcaaacccttgtagcagtgttctggaatcctgtgtgagggacacacatgtataccccagcagcagtgttctggaatcctatgtgagggacaaacattcaaacaacagtgggagtgttctggaatcctatgttacagacaaacattcaggctctcatcacagtgttctagaatgctatgtgagggagaaacacccagaacccagcagcagtgttctgaaatcctatgtgacagacatacatgaagaccccagaagcagtgctgtggaacgctatgtgaggaatattcattcagaccccagcagcagtgttctggaatactgtgtgagggacaatcattgagaacctcgtatcagtgttctggaattctgtgtgagggacaaactttcagaccacagcaggagtgttctggaatcctatgtgatggacaaacactcagaagacagctggactattttgcaatcctatgtgagagacaatcattcagaccctcgtagcagtgttctggagtcctgtgtgaggaacaagcattcagaccacagcaggagtattctggaatcccctctgaagaacaaacattcaggctatcgtagcagtgttctggaatcctgtgtgactgacaaacattgagaccccagcagcagtgttctggagtgttatgtgagggacaaacattcagacactagtagcagtgttctggaatcctgtgtgagggacaaacactcagaacccagcagcatttttctgggtccctatatgagggacaaacactcggaacacagcttcagtgttttgcaatcctatgtgagggacaaacattcagaccctcgtagaagtgttctggaatcctatgtgagggacaaactttccgacaattataacagtgttctgcaatcctactttaaggacaaatatgcagaccctcgtagcagtgttctggaatcctatgtgagggacacacattcagacaatcgtagcagttttctggaatcctatgtgagggacaaacattcagaccccaacacaagtgttctgcaatcctacgttaaggacaaatattcagaccctcgtagcagtgttctggaatcctatgtgagggacacacattcagacaatcctagcagttttctggaatcctatgtaagggaaaaacattgaatcaacagcgggagtgttctggaatcctatgttatggacaaacattcagacgctcattgcagtgttctggaattgtacgtgagggaggaacactcagaacccagcagcagttttctggaatcctatatgatggacatacatgtagaccccagcagcagtgttctggaatcccatgtgagggacaaatattcagaccttcgtcgaattgtctggaatcctatgagaaggacaaacactcggaaaccagcagcagcattcaggaaccctatgtgagggacaaacattcagacaacagcaggattgttctggactccgatgtgagggatatacactcagaaaacagcaggagtgttttggaatcctatgtgagggacaaacattcagatcgtcgtagcagtgtcctggaattcttcatgagggataaacattcagacccccatagcagtgttctggaatcctatgtgagggacaatcattcagaccacagcaggagtgttctggaatctcctgtgaggaacagacattcagacccctaacagtgttctgaaatcctatgtgatggacaaacatttagacgccagcagtgctctggaatgcaatgtgagggacaaacattgagaccctcgtagcagtgttctggtatcctatctgagagaccaactctcagaaacaagcagcggtgttctggaaaattatgtaagggacaaagattcaggccaaagcaggtatgctctggaattctatgtgaggaacgaactctcagaatactgcaggagtgttttagtatcctatgtgagggacaaacattcagaccctcgtagcagtgttctggaatcccatgtgattgacaaacattcagaccacagcaggagtattctggaatcccctgtgaggatccaacattcagacccccataccagtgttctggaatcctatgtgagggacaaacatttagaccccagcagcaatgttctggaatcctatgtgaggaacaaacattcagaccctcgaagcagtgttctggaatcctatgtgagggacaaacattcagaaccaagcagcagtgttctggaactctgtatgagggacaaacattcagaacacggcaggattgttctgcaatcctatgtgagggagaaaccctcagaaaaccataggaatgttttggaatcctacgtgagggccaaacaatcaaaccctcgtagctgtgttccagaatcctatgtgggggcaaacactgagacaatcgtagcaattttctggaatcctttgtgagggacaaacattcattccctcatagcagtgtttgggaatcctgtatgaaggacaaacattcagaccacacagttctggaatccccactgtgggaaaaacattcagaccctcctagcagtgttctggaatcctatgtgatggacaaagatttagaccacagcagcagggttctgaaatcctatgtgaggaacaaacattcagatcctcgaagcagagttctggaatcctatgtaaggtacaaacattcagacaatagcagcagtgttatggaattctatgtgaggaacaaacgttcagacccacatagcaacgttttagattcctatgtgagggaccgacattcagacaatcgaagcagtgttctggaatcatatgtgagggacaaacattcggacaccagcagcagtgttctggaatcctatgtgagggacaaacatacaaacaagagcgagagtgttctggaatcctatgttgcggacaaacattcagacgctcgtcacaatgttctggaattctatgtgagggagaaacagtcagaacccaatagcagtgttctggaatcctatgtgacggacatacatgtagaccccagcagcagtgttttggaatcctatgtgagggacagtcattcagaccctcgtagcagtgttctggaattctgtgtcaagcacaaactttcagaccctcatagcagtgttctggaatcctatgtgagggacaatcatccaggccatagcaggagtgttctggaatcccctgtgaggaataaacgttcagacagtcgtagcagtgttctggaatgctatgtgagggacaaacattcagacaatcgtagcagtgttccgtaatcctatgtgagggacaaacattcaaacaacagcgggattgttcaggaatcctatgttatggacaaacattctagaccctcatcgcagtgttctggaattctatgtgagcgagaaacactcagaacccaaaagcagtgttctggaatcctatgtgagggacaaacattacgaccccagcgacagtgttctggaatcctatgtgagggccaatcattcagacactcgtgccagtgttctggaattctgcgtgagggacaaacattctgactcctgtagcagtgttctgtagtactgtgtgagggaaaaacattgagaccacagcaggagtgttctggaattccctgtgaggaacagacattcagaccctcttaggagggttctggaatccggtgtgatggacaaaaatctagaccctagcagcagtgttctgggatcctatgtgagggtcaaacattcagacccttgtagcagtgttctggaatcctatgtgagggagaaacactcagaacccagcagcagtgttctgaaaccctatgtgagagacaaacattctgacaacaggaggatagttctggaatcctaggtgagggacaaacactcagaaaacaacaggagtgttttggaatcctaaatgagggacagtcattcagatcgtcatagcagtgttctggaattttgtgtgagggacaaacattcacaccccagcagaagtgttgtggaattctaaatgagggacaaacattcagaccctcatagcaatgctctggaatagtgtgtgatggagaaacttttagaccccagcagcagtgttctgtaatcctttgtaagagaaaaacaatcagaccctcataggtgtgttctggaatcccatgtgatggacaaccactcagaacccagcagcagtgttctgtaactatatgtgaggggcaaacattcagaacacagcaggattgttctgtaatcccatgtgagggacaatcattcagaccctcgtggctgtgttctggaatcctaagtgagggacaaacattcagacaatcatagcagtgttctggaatcccatgtgagggaaaaacattcagaccctcccagcagtgttctggaatcctatgtgagggacaaacattcagacaaacgtagcagtgttctggaaacctatgtaagggaaaaacattcaaacaacaccgagattgttctggaatcctatgttacggacaaccattaataatctcttcacagtgttatggaattctacgtgagggagaaacacacagaacccagcagcagtgttccagaaacctatgtgagggactcacattcagaccacggcaggattgttctggaatcccatgtgagggacaaacactcggaacacagcaggagtgttttggattcctatgtgcggaacaaacattcagaacctcgtgacagtgttcgtgaatcctataggaggaactaacattcagaacacagcaggagtgttctggaatcctatgtgaagaacaaacattcagacccccgtagcaatgttttggaatcctatgtgaaggacaaacattcagacgatcgtagcagtgttctggaatccaatgtgagggacaaacatttaagctacggggagggggcgttctggaatcctatgttacggacaaacattcagaacctcgtcgcagtgttcttgaattctatgtcagggaaaaacagtcagaacccagcagcagtgttttggaatcctatgtgacagacacacatgtagaccccagcaacagtgttctaggatcctatgtgagggaaaaacattcagaccccagcagcagtgtcctcgaatcctatgtgagggacaatcattcagaccctcgtagcagtgttctggaattctgtgtgagggacaatcattcgactgtcatagcagtgttctggaatcctaagtgtaggacaaacattcagacaatcgtagcagtgatctggaaatctatgtgaggaacaaacattcacacactcttaggagggttctagaatcctatgtgagggacaaacattcagacaatagtagcagtgttctggaatcctctgtgagtgacaaacattcagaatccagcagcagtgttctggaatccaatgtgagggacaaacatttaaacaacaggcggggggttctggaatcctatgttacggacaaacattcagaacctcgtcgcagtgctatggaattctatgagagggagaaacagtcagaacccagcagcagtgttttggaatcccacgtgacggacatacatatagaccccagcagcagtgttctgggatcctatgtgagggacaaacattcagaccccagcagcagtgttcaccaatcctatgtgagggacaatcattcagaccccaagggccccaaatatccacttgcagattctactaaaagagtgtttccaaactgctcaatcaaaagaaaggttcaactctgtcagatgaatgcacacatcacgaagaattttctcagattgcttcagtctagattttatgtgaagatatttccttttctaccataggcagcaaagtgctctaaatgtccacttgcagattctacaaacagaagctttctaaatttctcaagcaaaagaaaagtttaactctgtgagatgaatgcacacatcacaaagaagtttctcagattgcttctgtctagattttatgtgaatatatttccttttctaccacaggcggcaaagcgctccaagtgtccacttgcagattccacaaaaagagagtttccaaactgctcaataaaagaaaggttcaactctgtgagatgaactcacacatcacaagaagtttctcagaattcttctgtctagtttttatgggaagttatttccttttagagcttaggcctcaaagcgctccatatgtccacttgcagtttctacgaaaagagagtttcaaaactactcaatcaaaagaaagttttgcttctctctagattttatgtgaagacaattccttttctaccataggctgcaaagcgcttcaaatgttcacttgcagattctacaaaaagagtgtttccaaactgctcaatcaaaagaaaggttcaactctgtgagatgaatgcacacataacaaagaagtttctcagattgcttctgtccagtttttatctgaagatatttccttgccaccataggcctcaaaggctaaaaatgtccacgtgcagattctacaaaaagagtttcaaaactgctcaatcaaaagaaaggtttaacattgtgagatgaatgcacacatcacaaagaagtttctcagaattattctgtctagtttttatgtgaagatatttcattttccaccataggcctcaaagcgttccaaatgtactcttgcagattctgcaaaaagagagtttcaaaactgctcaatcaaaagaaaggtttaactccacgagatgaatgcacaagtcacaaagaagtttctcagatagcttctgtctagattttatgtgaagataattccttttctaccataggccacaaagcactccaaatgtccatttgcaggttctacaaaaacagtgtttccacactgctcaattgaaagaaaggttcaactctgtgagacaaacgcacacatcacaaagaactttctcagaattcttctgtccagtttttatgtgaagatatttcctttccaccataggcctcaaagcgctaaaaatgtccacttgcagattctacaaaaagagttttgaaactgctcaatcaaaagaaaggtttaactctgtgacatgagttcacacatcacaaagaaatttctcagaatttttctgtctagtttttatgtgaagatatttccttttccaccataggcctcgaagcgttccaaatgtactcttgtagattgtacaaaaagagtttcaaagctgttcaatcaaaagaaaggtttaactctgtgagatgaatgcacacattgcaaagaagtttctcagattgcttctgtctacattttatatgaagatatatccttttctaccgtaggcctcaaagtgcaccaaatgtccacttgcagtttctacaaaaagagtgtttccaaactgctcaatcaaaagaaaagttgaactctgtgagatgaatgcacacatcacagggaagtttctcagattgtttctgtctagattttatgtgaagatatttccttttctaccgtaggctgcaaagcgctccaaatgtccacttgtagattcaacaaaaagagtgtttccaaactgctcaatcaaaagtcatgttcaactctgatcaatgaatgcacgcatcacaaaaaaagtttctccaaattcttcagtctagtttttgtgtgatgatatttcctttttaatcataagactcaaagcactccaaatgtccactaccacattctacaaaaagagagtttcaaaactgctcaatcaagatgaagttttaactctattagatgaatgcacacatcacaaagaagtttctcaggttgcttctgtgcagattttatgtgaagatatttccttttctaccacaggccgcaacgtgctccaaatatctacctgcagattctacaaaaagagtgtttccaaattgctcaatcaaaagaaatgttgaactctgtgagacgaatgcatgcatcacaaagaagtttctcagattgcttctgtctagattctatgtgaagatatttccttttctagcaaaggctgcaaagcactccaaatgtccacttgcagattttacaaaaagagtgttttcaaactgctcaatcaaaagaaaggctcaagtctgtgagatgaatgcacacatcacaaagaattttctcagaattcttctgtctagtttttaagtgaagatatttcctttccaccataggcctgaagacgctccaaatgtccacttgcagattccacaaaaagagagtttcaaaacgcctcaatcaaaaggaagggttaactctgtgagatgaatgcacacatcacaaagaagtttttcagattgcttctgtctggattttatgtgaagatgtttccttttctacagtaggccacaaatcgctctaactgtccagttgcagattctacaaaaagcgtgtttccaatctgcttaataaaaagaaagcttcaactctgtgagatgaacgcacatatcacaatgaagtttctcagaattcttctgtctagttttacatgaagatatttccttttccagctgaggcctccaagtgttcagattgtccacttacagatactacaaaaagagagtttcaaaactggtcagtcaaaagaaaggcttaactctgtgagatgaatgcacacatcacaaagaagtttcacagattgcttctttctagattttatgtgaagatatttccttttctactataggctgcaaagcgttccaaatatccacttgcagattctacaaacagaggctttccaaactgctcaataaaaagaaaagtttaactctgtgagatgaatgcacaaatcacaaagaagtttctcagaattcttctgtctagtttttatgtgaagatatttccttttccaccataggcctcaaagcgctccaaatgtccacttgcagtttctacaaaaagagagtttcaaaactgctcaatcaaaagaaaggtttaactctatgagatgaatgcacacatcataaagaagtttctcagattgcttctgtctagatgtgatatgaagatatttccctttctacaacaggccgcaaagcactccaaatgtccacttgcagattctacaaaaagagtgattccaaactgctcaatcaaaagaaaggctcaactctgtgagacgaattcacatatcacaaagaagtttctcagaattcttctgtccagtttttatgtgaagatatttacttttccaccataggcctcaaaccgctccaaatgtccacttgaagattctacagaaagagtttcagaactgctcaatcaaaagaaaggtttaactctgtgagttgaatacacatatcacaaagaagtttctcagattgcttctgtctaggttttatgtgaaggtatttccttttctactgtaggccacagagtgcaccaaatgtacacttgcaggttgtacaaaaagagtgtttccaaactgctcaatcaaaagaaaagttcaactctgtgagatgaacacacgtatcacaaagaagtttctcataattcttctgtctagtttttatgtgaagatatttccttttccaccataggcctcaaagggctccaactgtccacttgcagattctgcaaaaagagagtttcaaaactcctcaatcaaaagaaatgtttaactctgtgagatgaatgcacatgtcagagagaagtttctcagattgtttctgtctagactttatgtgaagatatttccttttcttccacaggctgcaaagtgctccaactgtcaacttgcagattctacaaaaagagtgtttccaaactgttgaatcaaaagaaattttcaaatctgtgagatgaaagcacacatcacaaagaagtttgtcagaattcttctgtctagtttttatgtgcagatatttcctttccaccttaggcctcaaagcgctccaaatgtccacttgcagattctaaaaaaggagagtttcaaaactcctcaatcaaaaggaaagtttaactctgtgagatgaatgcacacatcacaaagaagtttctcagattgcttctgtctagatgttatgtgaagatatttcctttctactataggctgcaaagcgctctaaatttccacttgcaaatactaaaaaaagagtgtttccaaactgctcaatcaaaagaaaggttcaactgtgatcgatgaatgcacgcatcacaaaaaaagtttctccaatttctttagtctagtttttatgtgatgatatttcctttttaatcataagactcaaagcactccaaatgtccattagcagactctacaaaaagagagtttcaaaactgctcaatcaagagaaagttttaactctattagatgaatgcacacatcacaaagaagtttctcaggttgcttctgtgcagattttatgtgaagatatttccttttctaccacaggccacaaagtgctccaaatgtctacttgcagattctacaaaaagagtgtttccaaactgctcaatcaaaagaaatgttgaactctgtgagatgaatgcacgcatcacaaagaagtttctcagattgcttctgtctagattttatgtgaagatatttccttttctaccaaaggctgcaaagcactccaaatgtccacttgcagattttacaaaaagagtgttttcaaactgctcaatcaaaagaaaggctcaagtctgtgagatgaatgcacacatcacaaagaattttctcagaattctcctgtctagtttttaagtaaagatatttcctttccaccataggcctgaaggcgctccaaatgtccatttgcagattctacaaaaagagtgtttccaaactgcttaataaaaagaaaggttcaactctgtgagatgaatgcacatatcacagtgaagtttctcagaattcttctgtctagttttacatgaagatatttccttttccagctgaggcctcaaagtgctcaaattgtccacttgcagatactacaaaaagagagtttcaaaactgctcagtcaaaagaaaggcttaactctgtgagatgaatgtacacatcacaaggaagtttcacagattgcttctttctagattttatgtgaagatatttccttttctaccataggctgcaaagcgttccaaatacccacttgcagattctacaaacagaggctttccaaactgctcaataaaaagaaaagtttaactctgtgagatgaatgcacacatcacaaagaagtttctcagaattcttctgtccaatttttatgtgaagatatttccctttccaccataagcctcaaagcgctccaaatgtccacttgcagattctacaaaaagagaggttcaaaactgctcaatcaaaagaaaggtttaactctatgagatgaatgcacacatcataaagaagtttctcagattgcttctctctagatttgatgggaagatatttccctttctaccataggccccaaagtgctccaaatgtctacttgcagattctacaaaaagagtgtttccaaacagctcagtcaaaagaaaggcttaactctgtgagacgaacacacacatcacaaagaagtttctcagaattcttctgtccagttttagtgtgaagatatttacttttccaccataggcctcaaaccactccaaatgtccgcttgaagattctacagaaagagtttcagaactgctcaataaaaagtaaggtttaactctgtgagttgaatgcacacatcacaaagaattttctcagattgcttctgtctagattttatgtgaaggtatttccttttctactgtaggccacagagcgccccaaatgtacacttgcagtttgtacaaaaagagtgtttccaaactgctcaatcaaaagaaaagttcaactctgtgagatgaacacacatatcacaaagaagtttctcagaattcttctgtctagtttttatgtgaagatatttccttttccaccataggcctcaaagggctccaaatgtccacttgcagattctgcaaaaagagagtttcaaaactcctcaatcaaaagaaatgtttaactctgtgagatgaatgcacacgtcacagagaagtttctcagattgtttctgtctagattttatgtgaagatatttacttttcttccataggctgcaaagtgctccaaatgtcaacttgcagattctacaaaaagagtgtttccaaactgttgaatcaaaagaaattttcaaatctgtgagatgaaagcacacatcacaaagaattttgtcaaaattcttctgtctagtttttatgtgcagatatttcctttccaccttaggcctcaaagtgctccaaatgtccacttgcagattctaaaaaaggagagtttcaaaactcctcaatcaaaaggaaggtttaactctgtgagatgaatgcacacatcccaaagaagtttctcagattgcttctgtgtagattttatgtgaagatatttccctttctaccgtaggccacaacgtgctccaaatatccacttgcagattctacaaatagagtgtttctaaactgctcaatcaaaggaaaggttcaaatctgtgagatgaacaaacacatcacaaacaagtttctcagaatgcttctgtctagtttttatgtgaagatatttcattttccaccatagactcaagacgctcgaaatgtccacttgcagattctacaaaaagagtattttaaagctggtccaacaaaagaaaggttcaactctgggagatgaatgcacacatcacaaagaagtttctcagattgcttctgtctagattttatgtgaagatatttcgttttctaccacaggccacaaagcactcgaaatgtccacttgcagattctacaaaaagagtgtctccaaactgctcaatcaaaagaaagtttcaaatctgtgagatgaacacatacatcacaaagaagtttctcagaattcttctgtctagtttttatgtgaagatatttccttttccacattagacctctaagcactccaaatgtccatttgcagtttctagaaaaagagaggttcaaaactgctcaatcaaaagaaacgtttaactctgggagatgaaggcacacatccaaagacgtttctcagaatgcttccgtctagtttttatgtgaagttatttcctttccaccataggcctcaaagtgctaaaaatgtccgcttgcagattctacaaaaagagtttcaaaactgctcaatcagaagaaaggtttaactctgtgagatgactgcacacatcacaaagaaatttctcagaattcttttgtctactttttatgtgacgatatttccttttcgaccatagacgtcaaagcgctaaaaatgtccacttgcagattctacaaaaagagagtttcaaaacttctctatcagaagaaaggcttaactgtgtgagatgaatacacacatcacaaagaagtttctcagattgcttctgtctagattgtatgtgaaggtatttccttttctactgtaggcctcaaagcacacaaaatgtccacttgcagtttccacaaaaagagtgtttccaaactgctcaatgaaaagaaaagttgaactctgtgagatgaaagcacatatcacaaagaagtttctcagaattcttctgtctactttttatatgaagatatttccttttccaccttaggcatcaaagcattaaaaatgtccacttgcagattctacaaaaagagagtttcaaaactcctcaataaaaagaaatgtttatctctgtgaggtgaatgcacacatcacagagaagtttctcagattgtttctgtctagattttatgtgaagatacttcattttcttccataggacaaaaagtgctccagatgtccatttgtagattcaacaaaaagagtgtttccaaactgatgaatcaaaagaaattttcaaatctgtgagatgacagcacacatcacaaagaagtttgtcagaattcttctgtctagtttttatgtgaagatatttcctttccaccgtaggcgtcaaagcgctccaaatgtctacttgcagattctacaaaaagagagtttcaaaactcctcaatcaaaatgaaggtttaactctatgggaagaatgcacacatcacaaagaagtttctcagattgcttctgtctagatgttatgtgaagatatttccttttctaccataggctgcaaagcgctctaaatgtccacttgcagattaaaaaaaaaagtgtttccaaactgctcaatcaaaagaaaggttcaactctgagcgatgaatgcacacattacaaagaagtttctccaaattcttcagtctagtttttgtgtgatgatatttcctttttaatcataagactcaaagcactccaaatgtccactagcagattctacaaaaagagagtttcaaaattgctcaatcaagataaagttttaactctatgagatgaatgcacacatcacaaagaagcttctcagattgcttctgtccagattttatgtgaagatatttccttttctaccagaggctgcaaagttctccaaatgtctacttgcagattctacaaaaagagtgtttccaaactgctcaatcaaaagaaatgttgaactctgtgagatgaatgcacgcatcacaaagaagtttctcagattgcttctgtctagattttatgtgaagatatttccttttctaacataggccactaagcactccaaatgtccacttgcagattctacaaaaaagagtgtttccaaactgctcaatcaaaagaaaggtttaactctgtcagttgagtgcacacatcacaaagtaatttctcagaattcttctgtctgttttttatgggaagatatttccttttccaccataggtgtcaaagcgccccaaatgtccacttgcagatcctacaaaaagagagtttcaaaactgctcaatgaacagaaacgttaaactctgagagacaaatgcacacatgacaaagaagtttctcagaattcttctgtctagtttttatgtgaagatatttccttttctaccataggaagcaaagcacaccaaatttccacttgcagattctgcaaaaacagtgtttccatcccggtcaatcaaaagagacgttcaactctgtgcaaagaaggcacccatcacaaagaagtttctcagaattcttctgtctaatttttatgtgaagatatttcattttccaccataggcctcaaagtactcaaaatgtccacttgcagatactacaaaaggagtatttcaaggctgctccatcaaaagaaatattcaactctgggagatgaatgcacacatcacaaagaagtttctcagaatgcttccatctagtttttatttgaagataattccatttccaccataggcctcaaagcactacaaatgtccacttgtagactctacaaaaagagagtctcaaaactgctcaatcaagagaaagagttaacactgtgagatgaatgcacacatcacaaagaagtttctcagattgcttctgtctagattttatgtgaagatatttgcttttcttccattggttgcaaagcgctgcaaatctccacttgcatattctacaaaaagagtgtttccagactgctgaatcgaaagaaaggttcaactctgtgagatgaatgcacacatcacaaggacgtttctcagaattcttctgtctagtttttatatgaagatatttccttttttaccataggtctcaaagcgctacaaatgtccacttgtagattatacaaaaagagagcttcaacactgctctatcaaaagaaacgtttaactctgtgagatgaatgcacacatcacaaagaaatttctcagactgcttctgtctagatattatttgaagatatttccttttctactgtaggccacaaagagctccaatttccacttgtagattgtacaaaaagtgtgtttccaaactgctcaatccaaagaaagattcaactctgtgagatgagcacatgcatcacaaagaagtttctcagaaatcttctgtctagtttttaagtgaagatatttcgttgtccaacatagacctcagaacgctccaaatgtccacttgcggatactccaaaaggagtgtttcaaaactgttcaatccaaagaaagttttacctctgtgagatgaatgtacagtactccaaatgtcctcttgcagattctacaaaaagagtgtttccaaactgcttaatcaaaagaaaggttcaactgtgtgagatgaatgcacacatcacaaagaagtttgtcagaattcttctgtctagttttcatgtgaagatattaactttttcaccataggccacaaattgatccaaatgtccacttgcagattctacaacaagagagtttcaaaactcctctatcaaaagaaaggtttaatacagtgaggtgaatgcacatatcataaagaagtttctgagattgcttctgtctagatattatgtgaagatattttgttctctaccataggcttcaaagcgctccaaatgtccactgacagattctacaaaaggagtatttccaaactgctcaaagaaagtttcaactatgagatgaatgcacacatcacaaagatgttgttcagaattcttctgtctagtttttatgtgaagatattgccttttccaccacaggcctcaaactgctccaaatgtccacttccagatcctacaaaaaaagagtttcaaaactgctcaatcaaaagaaagatttaacgctgtgagatgaatgcacatataagatagaagtttctcagattgcttttgtctagattttatgtgaagatatttccttttctaccttaggc

SEQ ID NO: 1985 - DNA, 21783 bp, Homo sapiens
aggcctatggtggaaaaggaaatatcttcacataaaaactagacagaagaattctgagaaacttctttgtgatatgtgtgttcatctcacagagttgaacttttcttttgattgagcagtttggaaacactctttttgtacaaactgcaagtgtacatttggggcgctctgtggcctacagtagaaaaggaaataccttcacataaaatctagacagaagcaatctgagaaaattctttgtgatgtgtgcattcaactcacagagttaaaccttactttttattgagcagttctgaaactctttctgtagaatcttcaagcggacatttggagtggtttgaggcctatggtggaaaagtaaatatcttcacactaaaactggacagaagaattctgagaaacttctttgtgatgtgtgtgttcgtctcacagagttaagcctttcttttgactgagctgtttggaaacactctttttgtagaatctgcaagtagacatttggagcactttggggcctatggtagaaagggaaatatcttcccatcaaatctagagagaagcaatctgagaaacttctttatgatgtgtgcattcatctcatagagttaaacctttcttttgattgagcagttttgaacctctctttttgtagaatctgcaagtggacatttggagcgctttgaggcttatggtggaaagggaaatatcttcacataaaaattggacagaagaattctgagaaacttctttgtgatgtgtgcattcatctcacagagttaaacttttctttttattgagcagtttggaaagcctctgtttgtagaatctgcaagtgggtatttggaacgctttgcagcctatggtagaaaaggaaatatcttcacataaaatctagaaagaagcaatctgtgaaacttccttgtgatgtgtacattcatctcacagagttaagcctttcttttgactgagcagttttgaaactctctttttgtagtatctgcaagtggacaatttgagcactttgaggcctcagctggaaaaggaaatatcttcatgtaaaactagacagaagaattctgagaaacttcactgtgatatgtgcattcatctcacagagttgaacctttctttttattaagcagtttggaaacactctttttgtagaatctgcaaatggacatttggagcgccttcaggcctatggtggaaaggaaatatctttacttaaaaactagacaggagaattctgagaaaattctttgtgatgtgtgcattcatctcacagacttgagcctttcttttgattgagcagtttgaaaacactctttttgtaaaatctgcaagtggacatttggagtgctttgcagcctttggtagaaaaggaaatatcttcacataaaatctagacagaagcaatctgagaaacttctttgtgatgcgtgcattcatctcacagagttcaacatttcttttgattgagcagtttggaaacactctttttgtagaatctgcaagtagacatttggagcactttgtggcctgtggtagaaaaggaaatatcttcacataaaatctgcacagaagcaacctgagaaacttctttgtgatgtgtgcattcatctaatagagttaaaactttctcttgattgagcagttttgaaactctctttttgtagagtctgctaatggacatttggagtgctttgagtcttatgattaaaaaggaaatatcatcacataaaaactagactaaagaaattggagaaactttttttgtgatgcgtgcattcatcgatcacagttgaacctttcttttgattgagcagtttggaaacactctttttttagtatttgcaagtggaaatttagagcgctttgcagcctatagtagaaaggaaatatcttcacataacatctagacagaagcaatctgagaaacttctttgtgatgtgtgcattcatctcacagagttaaactttccttttgattgaggagttttgaaactctccttttttagaatctgcaagtggacatttggagcgctttgaggcctaaggtggaaaggaaatatctgcacataaaaactagacagaagaattctgacaaacttctttgtgatgtgtgctttcatctcacagatttgaaaatttcttttgattcaacagtttggaaacactctttttgtagaatctgcaagttgacagttggagcactttgcagcctgtggaagaaaaggaaatatcttcacataaagtctagacagaaacaatctgagaaacttctctctgacatgtgcattcatctcacagagttaaacatttcttttgattgaggagttttgaaactctctttttgcagaatctgcaagtggacagttggagccctttgaggcctatggtggaaaaggaaatatcttcacataaaaactagacagaagaattatgagaaacttctttgtgatacgtgtgttcatctcacagagttgaacttttcttttgattgagcagtttggaaacactctttttgtacaacctgcaagtgtacatttggtgcactctgtggcctacagtagaaaaggaaataccttcacataaaacctagacagaagcaatctgagaaacttctttgtgatatgtgtattcaactcacagagttaaacctttcttttgattgagcagttctgaaactctttctgtagaatcttcaagtggacatttggagcggtttgaggcctatggtggaaaagtaaatatcttcacataaaaactggacagaagaattctgagaaacttctttgtgatatgtgaattcgtctcacagagttgagcctttcttttgattgagcagtttggaatcactctttttgtagaatctgcaagtggacatttggagtgctttgcggcctgttgtagaaagggaaatatcttcatatcacatctagacagaagcaatctgagaaacttctttatgatgtgtgcattcatctcatagagttaaacctttcttttgattgagcagttttgaaactctctttttgtagaaactgcaagtggacatttggagcgctttgaggcctatggtggaaaaggaaatatcttcacataaaaactagacagaagaattctgagaaacttctttgtgatttgtgcattcatctcacagagttaaacttttctttttattgagcagtttggaaagcctctgtttgtagaatctgcaagtggatatttggaacgctttgcagcctatagtagaaaaggaaatatcttcacataaaatctagaaagaagcaatctgtgaaacttctttgtgatgtgtgcattcatctcacagagttaagcctttcttttgactgaccagttttgaaactctctttttgtagtatctgtaagtggacaatctgaacacttggaggcctcagctggaaaaggaaatatcttcatgtaaaactagacagaagaattctgagaaacttcattgtgatatgtgcgttcatctcacagagttgaagctttctttttattaagcagattggaaacacgctttttgtagaatctgcaactggacagttagagcgatttgtggcctactgtagaaaaggaaacatcttcacataaaatccagacagaagcaatctgaaaaacttctttgtgatgtgtgcattcatctcacagagttaacccttccttttgattgaggcgttttgaaactctctttttgtggaatctgcaagtggacatttggagcgtcttcaggcctatggtggaaaggaaatatcttcacttaaaaactagacagaagaattctgagaaaattctttgtgatgtgtgcattcatctcacagacttgagcctttcttttgattgagcagtttgaaaacactctttttgtaaaatctgcaagtggacatttggagtgctttgcagcctttgctagaaaaggaaatatcttcacatagaatctagacagaagcaatctgagaaacttctttgtgatgcatgcattcgtctcacagagttcaacatttcttttgattgagcaatttggaaacactctttttgtagaatctgcaggtagatatttggagcacgttgcggcctgtggtagaaaaggaaatatcttcacataaaatctgcacagaagcaacctgagaaacttctttgtgatgtgtgcattcatctaatagagttaaaacttcatcttgattgagcagttttgaaactctctttttgtagaatgtggtagtggacatttggagtgctttgagtcttatgattaaaaaggaaatatcatcacacaaaaactagactgaagaatttggagaaactttttttgtgatgcgtgcattcattgatcagagttgaacatgacttttgattgagcagtttggaaacactctttttgttgaatctacaagtggacatttggagcgctttgcagcctacggtagaaaaggaaatatcttcacataaaatctagacagaaacaatctgagaaacttccctgtgatgtgtgcattcatctcacagagttcaacttttcttttgattgagcagtttggaaacactctttttgtagaaactgcaagtggacatttggtgcactttgaggcctacggtagaaaaggatatatcttcatataaaatgtagacagaagcaatctgagaaacttctttgcaatgtgtgcattcatctcacagagttaaacctttcttttgattgaacagctttgaaactctttttgtacaatctacaagagtacatttggaacgcttcgaggcctatggtggaaaaggaaatatcttcacataaaaactagacagaaaaattctgagaaatttctttgtgatgtgtgaactcatgtcacagagttaaacctttcttttgattgagcagtttcaaaactctttttgtagaatctgcaagtggacatttttagcgctttgaggcctatggtggaaaggaaatatcttcacataaaaactggacagaagaattctgagaaagttctttgtgatgtgtgcgtttgtctcacagagttgaacctttctttcaattgagcagtgtggaaacactgtttttgtagaacctgcaaatggacatttggagtgctttgtggcctatggtagaaaaggaattatcttcacataaaatctagacagaagctatctgagaaacttctttgtgacttgtgcattcatctcgtggagttaaacctttcttttgattgagcagttttgaaactctctttttgcagaatctgcaagagtacatttggaacgctttgaggcctatggtggaaaatgaaatatcttcacataaaaactagacagaataattctgagaaacttctttgtgatgtgtgcattcatctcacaatgttaaacctttcttttgattgagcagttttgaaactctttttgtagaatctgcacgtggacatttttagcctttgaggcctatggtggcaaggaaatatcttcagataaaaactggacagaagcaatctgagaaacttctttgttatgtgtgcattcatctcacagagttgaacctttcttttgattgagcagtttggaaacactctttttgtagaatctgcaagtgaacatttgaagcgctttgcagcctatggtagaaaaggaattgtcttcacataaaatctagagagaagcaaaactttcttttgattgagtagttttgaaactctcttttcgtagaaactgcaagtggacatatggagcgctttgaggcctaagctctaaaaggaaataacttcccataaaaactagacagaagaattctgagaaacttcttgtgatgtgtgagttcatctcacagagttgaacctttcttttattgagcagtttggaaactctctttttgtggaatctgcaagtggacacttggagcgctttgccgcctgtggtagaaaaggaaatatattcacataaaatctagacagaagcaatctgagaaacttctttgtgatgtgtgcattcatctcacagagttaaacttttcttttgcttgagaaatttagaaagcttctgtttgtagaatctgcaagtggacatttagagcactttgctgcctatggtagaaaaggaaatatcttcacataaaatctagactgaagcaatctgagaaaattcttcgtgatgtgtgcattcatctgacagagttgaacctttcttttgattgagcagtttggaaacactcttttagtagaatctgcaagtggatatttggggcccttggggtctgaatgattgtccctcacataggattggtgaacactgctgctggggtctgaatgtttgtccctcacataggatcccagaacactgctgctggggtctatatgtatgtccgtcacgtgggattccaaaacactgctgctgggttctgactgtttctccctctcatagaattccatagcactgcgacgaggttctgaatgtttgtccgtaacataggattccagaaccccccgcctgttgtttaaatgtttgtccctcacattggattccagaacactgctgctggattctgaatgtttgtcactcacagaggattccagaacactgctactattgtctgaatgtttgtccctcacataggattctagaaccctcctaagagtgtgtgaatgtttgttcctcacatagatttccagatcactgctacgattgtctgaatgtttgtcctacacttaggattccagaacactgctatgacagtcgaatgattgtccctcacacagaattccagaacactgctacgagggtctgaatgattgtccctcacataggattcgaggacactgctgctggggtctgaatgtttttccctcacataggatcctagaacactgttgctggggtctacatgtgtgtctgtcacataggattccaaaacactgctgctgggttctgactgtttttccctgacatagaattcaagaacactgcgacgaggttctgaatgtttgtccgtaacataggattccagaacgccccctccccgtagcttaaatgtttgtccctcacattggattccagaacactgctacgatcgtctgaatgtttgtccttcacataggattccaaaacattgctacgggggtctgaatgtttgttcttcacataggattccagaacactcctgctgtgttctgaatgttagttcctcctataggattcacgaacactgtcacgaggttctgaatgtttgttccgcacataggaatccaaaacactcctgctgtgttccgagtgtttgtccctcacatgggattccagaacaatcctgccgtggtctgaatgtgagtccctcacataggtttctggaacactgctgctgggttctgtgtgtttctccctcacgtagaattccataacactgtgaagagattattaatggttgtccgtaacataggattccagaacaatctcggtgttgtttgaatgtttttcccttacataggtttccagaacactgctacgtttgtctgaatgtttgtccctcacataggattccagaacactgctgggagggtctgaatgtttttccctcacatgggattccagaacactgctatgattgtctgaatgtttgtccctcacttaggattccagaacacagccacgagggtctgaatgattgtccctcacatgggattacagaacaatcctgctgtgttctgaatgtttgcccctcacatatagttacagaacactgctgctgggttctgagtggttgtccatcacatgggattccagaacacacctatgagggtctgattgtttttctcttacaaaggattacagaacactgctgctggggtctaaaagtttctccatcacacactattccagagcattgctatgagggtctgaatgtttgtccctcatttagaattccacaacacttctgctggggtgtgaatgtttgtccctcacacaaaattccagaacactgctatgacgatctgaatgactgtccctcatttaggattccaaaacactcctgttgttttctgagtgtttgtccctcacctaggattccagaactatcctcctgttgtcagaatgtttgtctctcacatagggtttcagaacactgctgctgggttctgagtgtttctccctcacataggattccagaacactgctacaagggtctgaatgtttgaccctcacataggatcccagaacactgctgctagggtctagatttttgtccatcacaccggattccagaaccctcctaagagggtctgaatgtctgttcctcacagggaattccagaacactcctgctgtggtctcaatgtttttccctcacacagtactacagaacactgctacaggagtcagaatgtttgtccctcacgcagaattccagaacactggcacgagtgtctgaatgattggccctcacataggattccagaacactgtcgctggggtcgtaatgtttgtccctcacataggattccagaacactgcttttgggttctgagtgtttctcgctcacatagaattccagaacactgcgatgagggtctagaatgtttgtccataacataggattcctgaacaatcccgctgttgtttgaatgtttgtccctcacataggattacggaacactgctacgattgtctgaatgtttgtccctcacatagcattccagaacactgctacgactgtctgaacgtttattcctcacaggggattccagaacactcctgctatggcctggatgattgtccctcacataggattccagaacactgctatgagggtctgaaagtttgtgcttgacacagaattccagaacactgctacgagggtctgaatgactgtccctcacataggattccaaaacactgctgctggggtctacatgtatgtccgtcacataggattccagaacactgctattgggttctgactgtttctccctcacatagaattccagaacattgtgacgagcgtctgaatgtttgtccgcaacataggattccagaacactctcgctcttgtttgtatgtttgtccctcacataggattccagaacactgctgctggtgtccgaatgtttgtccctcacatatgattccagaacactgcttcgattgtctgaatgtcggtccctcacataggaatctaaaacgttgctatgtgggtctgaacgtttgttcctcacatagaattccataacactgctgctattgtctgaatgtttgtaccttacataggattccagaactctgcttcgaggatctgaatgtttgttcctcacataggatttcagaaccctgctgctgtggtctaaatctttgtccatcacataggattccagaacactgctaggagggtctgaatgtttttcccacagtggggattccagaactgtgtggtctgaatgtttgtccttcatacaggattcccaaacactgctatgagggaatgaatgtttgtccctcacaaaggattccagaaaattgctacgattgtctcagtgtttgcccccacataggattctggaacacagctacgagggtttgattgtttggccctcacgtaggattccaaaacattcctatggttttctgagggtttctccctcacataggattgcagaacaatcctgccgtgttctgaatgtttgtccctcatacagagttccagaacactgctgcttggttctgaatgtttgtccctcacataggattccagaacactgcttcgagggtctgaatgtttgttcctcacataggattccagaacattgctgctggggtctaaatgtttgtccctcacataggattccagaacactggtatgggggtctgaatgttggatcctcacaggggattccagaatactcctgctgtggtctgaatgtttgtcaatcacatgggattccagaacactgctacgagggtctgaatgtttgtccctcacataggatactaaaacactcctgcagtattctgagagttcgttcctcacatagaattccagagcatacctgctttggcctgaatctttgtcccttacataattttccagaacaccgctgcttgtttctgagagttggtctctcagataggataccagaacactgctacgagggtctcaatgtttgtccctcacattgcattccagagcactgctggcgtctaaatgtttgtccatcacataggatttcagaacactgttaggggtctgaatgtctgttcctcacaggagattccagaacactcctgctgtggtctgaatgattgtccctcacataggattccagaacactgctatgggggtctgaatgtttatccctcatgaagaattccaggacactgctacgacgatctgaatgtttgtccctcacataggattccaaaacactcctgctgttttctgagtgtatatccctcacatcggagtccagaacaatcctgctgttgtctgaatgtttgtccctcacatagggttcctgaatgctgctgctggtttccgagtgtttgtccttctcataggattccagacaattcgacgaaggtctgaatatttgtccctcacatgggattccagaacactgctgctggggtctacatgtatgtccatcatataggattccagaaaactgctgctgggttctgagtgttcctccctcacgtacaattccagaacactgcaatgagcgtctgaatgtttgtccataacataggattccagaacactcccgctgttgattcaatgtttttcccttacataggattccagaaaactgctaggattgtctgaatgtgtcaaagacttggacccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggagaaaaaaccaaacaccacatgttctcactcgtaggtgggaattgaacaatgagaacacatggacacaggaaggggaacatcacactccggggactgttgtggggtgtggggaggggggagggatagcattaggagatatacctaaggctaaatgacgagttaatgggtgcagcacaccgacatggcacatgtatacatatgtaactaacctgcacattgtgcacatgtaccctaaaacttgaagtataataataattaaaaaaaggaaacaacaggtgctggagaggatgtagggaaataggaacacttttacactgttggtgggaccagttcaaccattctggaagtcagtgtggcaactcctcagggatctagaactagaaataccatttgacccagccatcccattactgggtatatacccaaaggattataaatcatgctgctataaagacacatccacacatatgtttattgcagcactattcacattagcaaagacttgcaaccaacacatatgtccaacaatgatagactggattaagaaaatgtggcacatgtacagcatgggatactgtgcagccataaaacatgatgagttcatgtcctttgtagggacatggatgaagctggaaaccatcattctcagcaaactattgcaagcacaaaaaaccaaacaccacatgttctcactcataggtgggaattgaacaatgagaacacatggacacaggaaggggaatatcacacaccggggactgttgtgagttgggggaagcagggagggatagcatcaggagatatacctaatgttaaatgacgagttaatgggtgcagcacaccaacatggcacatgtatacatatgtaacaaacctgcacgttgtgcacatgtaccctaaaacttaaagtataataaaaaaaaagaaaagctaaaaaaaaaaaaaaggattccagaacactgctacgattgtctgaatgtttgttcctcaaataggattctagaatgctcctgctgtggtctgaatgtttgtccctcacataggattcctgaacactgctatgaggttctgagtgtttatacctcagataggattccaaaatactcttgctattttctgagagtttgtccctcccataggattccagaacattgctgctggggtctgaatgtttgtccctcacataggattccagaacactgctaggattgtctgaatgtttgtgtctcacatggaattccataacactgctattagggtctgaaagtttgtccttcacagaggtttccaggaaactgctacaattatctgaatgtccgttacgtaggattccagaacactgctatgagggtctgaatgtttgtctcttacataggattccagaacactgcagatttggtctgaatgtttatcactcacacaggaatccagaacactgctatgatggtctgaatgttcattcctcacataggattccagaacacagctacaaccgtcttaatgtttgtccctcacaggggattccagaacactcctgctgcagtctgaatgtttctaactcacacaggattccagaacactgctacgagggtctgaatgtttgtccctcacacttaatagcagaacactgatacaagggtctgaataattgtccctagcaaaggattccagagcactgttactgtggtctgaatgtttgtccctcacataggattccagaacactgctgctgggttctgaatgtatctccctcacctagaattccagaacgttgagacgaggttctgaatgtttgtccataacataggattccagaacactgctacaattgtctcaatgtttctcactcacatggcataccagaacactgcggcgagggtctgaatgttttccctcatatacgattccagaacactcatgctgtggtctgaatgtttgtcccttgcataggattcctgaacaatgctgcgagagtctgaatgtttatccctcacataggattccaaaacactcctgctgtagtctcaatgtttgcccctcacataggattccagaacaatcctgctgtggtctgaatgtttgtccctcacatagggctccagaacactcctgctgggttctaagcgtttctccctcaccttaaattcctcaacactgtgatgagggtctgaatgtttgtccataaaataggattcctgaacactcccgctgttgtttgaatgtttgttcctcccttaggactccagaaaactgctgctgggttctgaatggttgtccctcacacaggtttccagaacactgttacgagggtctgaatgtccctcacataggattccagaacactgttgagaagttctaaatgtttgtctgtcatataggattccagagaacagctacgagggtctgaatgtttgttcctcacagaggattccagaagagtcctgctttggtgtgaatgtttgtgcctcacacaggaattcagaacacggctatgaggttgtgaatgtttgtccctcacacacaattccagaatgctgctatgagggtctgaatgattgtccctcacataggattccagaacactgctgctgggttgcgagtgtgtctccctcacatagaattccagaacactgcgaagaagttctgaatatttgtccataacataggattccagaacactcctgcagttgtttgaatttttgtccctcccataggattccagaacactactgctggggtgtgagtgtatgtccctcacttaggattccagaacactgcaaagattctcttaaagattgtccctcacataggtttccggaacactgctatgagagtctgaatgtttgtccctcacacaggattccataatactcctgctgtgttctgaatatttgtacgtcacataggattcctgaacactactacgagattctgaatgtttgttgctcacataggattccaaaatgtccctgctgtgttctgagtgtttgtccctcacatagggtcactgctgctgggttctcagtgtttctcactcacatagaattccagaacactgcaaagaggttctgaatgtttttctgtaacatagtattccagaacactctcgctgttttttgaatgtttgtccctcacataggattccagaacacttctgctggtgtctgaaagtttgtccctcacacaggattccagaacactgctacgagggtctgaatgtttttccctcacaaagggttccagaacaaagctgttggagtcataatgtttgtctgtcacacaggattctagaacactgctacgaggttctgaatgtttctcccttacatagaattccagaacactgctaccaatgtctgaatgtttgtctctcacataggattccagaacactgctacgattgtctgaaagtttgtcgctcacataggattccagaacactgctacgattgtctgaaagtttgtccctcacataggattccagaacgctgctatgagggtctgaatgtttgtccctcatgcagagtaccagaacactgcttcgagggtctgaatgattgtccctcacataggattccagaacacggctgctggggtctcaatgtttgtgccacacataggattccagaatacggctgctggggtccacttgtaagtccgtcacaatggattccagaacacagctgctgggttctgagtgtttctccctcacttggaatttcagaacactgatatgagggtctgaaagtttttctgttacttaggactccagggctttccctctgttgtttgaatgtttgtccctcacagaggattccagaaaaatgctacgattgtatgaatgtttgtcccccacatatgattaaagaacactgcgaagagggtctgaatgtttgtctgaaacataggtttcccaaacagtttcgctgttgtttgactgtttttccctcacataggattccagaaaaatgctacgattgtatgaatgctggtccctcacataggattccagaacagtgctacgagggtctgaatatttgtccctcacatgggattccagaacacttctgctgtgttctgaatgtttggccctcagaaaggattcctgaactctgctacgacagtatgaatgtttgtccctcacatcagattccaaaacactcctactgtgttctgagtgtttgtccctcacatagaattctagaacagtcctgctattgtctgaatgtttgtcacacacacagggttgctgataactgctgctgagttctgaatgtttctccctaacatagaactctagaacactgtgacgaggttcggaatgtttgtcggtaacataggattcaaaaacactcatgctgttgtttgaatgtttgtccctcaagtaggattccagaacactgcttctggggactacatgtatgtctgtcacataggattccagaacactgctgttgggttctgtgtgtttctccctcacatagaattccagaacactgcgatgagggtatgaatgttgttcataacataggactccagaaaactcacgctcttctttgaatgtttgtccctcacgttggattccagaacactgctgctggggtctcaaagtttgtccctaacataggattccagaacactgctacgattgtctgaatattttgccttcacataatattccagaacactgctacgagggtctgaatgtttgtccctcaaataggattccagaatgctgctgctgggttctaaatgtttgtcggtcacataggattccagaacactgctgctggggtctgaatgtttgtccctcacatattattccagaacactgctgggttctaaatgtttgttggtcacatcagattccagaacactgctgctggggtgtgaatgtttatccctcacataggattccagaacacagttgctggggtctacatgtatgccagtcacatgggattccagaacactgctgctgggttcacagtgtttctccctcacatagaattccagataattgagacaatattctgaatgtttgaccataacataggattccagaacattcccgctcttgtttgaatgtttgtccctcacatagcattgcagaacactgctgctggggtctgaatgtttgtctctcacataggattccagtacactgctacgattgtcagaatgtttatccctcacctaggattacagaacactgctatgatgctctgaaagtttgtccctcacataggattccagaacactgctgctgaggtataaatgtttgtccatcacatgggattccagaacaaagctacgagtgtctgaatgttcctcacagcagattccataacactcctgctgtggtctcaatgtgtgtccctcacaaaggatttcagaacacggctaagagggtatgaatgtttgtccctcatacagaattccagaacactgctacgagggtctgaatgctggtccctcacataggacaccagaacactgctacggttgtctgaatgtttgtcccttccataggattcctgaacactgcttcgagggtctgaatgtttgtccctcacattgcattccaaaacactcctgttgtgttctgtgagtttgaccctcacataggattccagaacaatcctgctgtggtgtgaatgcttgtccctcacatatggttccagaacactgttgctgggttctgagtgtttgtccctcacaagggattccagaacactgctacgagggtgtgaatgtttgtcccacacaaaggattccagaacactgctactggggtctaaatgtttgtccgtcacatagcattcctgaacaatgttacaagaatctgaatgtttgtacctcacataggattcctgaaccactgctacgagggtctgaatgtttgtccctcacatagaattccaaaatactcctgctgtgttctgagtgtttgtccctcacatagcattccagaacactgcagctagggtctaaatgtccgtcacataggattctggaaaactactatgagtttctgaatgacagtccctcacataggattccagaatactgctgctggggtctgaatgcttgtccctcacataggattccagaactctgctgctggggtgtacatgtatgtccgtcacataggattccagaacactgctgctgggttctgagtgtttctcactcgcataggattccagaacactgctacaagtgtctgaatgtttgtctgtcacattggattccaaaacactcctgctgtgttctgagtgtttgttcctcacataagattgcagaacactcctgctgtggccggaaagtttgtccctcacataagattccagaacactgctgctggaatctgaatatttgtccctcaagtaggtttctagaacaatgctactattgtttgaatgtttgtccctcacatgggattccagaacgctcctgctgtggtctgaaagtttgtccctcacataggattcctgaacactgctacgagtgcctgcatgtttgtccctcacatcagattccaatacattcctgctgtgttctgagtatttctccctcacatatgattctagagcaatcctgctgtgatctgaatgtttgtccctcacatagggatccagaacactgttgctgggttcttaatgtttctccctaaagtagaactccagaacactgcctcgagggtgtgaatgcttgtccgtaacacaggattccagaacactctaactgttgtttgaatgtttgtccctcaaataggattccagaacagtgctgctggggtctacatgcatgtccgtcagagaggataccagaacactgatgctcggttctgagtgtttctccctcacatcgaattctagcacactgtgaccagtttctgaatgtttttctgtaacatgggattctagaacactcccgctgttatttgaatgtttgtccctcacataggattccagaacactgctatgagtgtctgaatgtttgtccctcacttaagattccagaacactgctatgagggtctgaatgtttttccctcacataggaatccagaacaccgttacgagggtcggattgttcgttcctctcaggggattcctgaacactcctgctgtggtctgaatgattgtctgtcaaacaggattccaggacactgctacgagggtctgaatgtttgtccctcacacagaattccagaacactgctacgtgggtctgaatgattgtccctcacgtaggattccagaacactgccatgagggtcttaatgtttgctcctcacttaggactccagaacattcctgctgtggtctgaatgtttctcccccacataggattcctgaacactgctatgagggtctggatgtttgtccctcacataggattccaaaacattcctgctgtgttccgagtgtttgtccctcacatacgattccagaacaatcctgctgtggtccgaatgtttgtccctcacatgcggttccagagcacagctgctgggttctgagtgtttctccctcacatagaattccagaacactgcgacgagtttctgaacgtttgtccataacattggattccaaaacactcttgctgttgtttgaatgtttgtccgtcacacaggattccagaatactgctgctggggtctgaatgtttgtcccttacgaaagattctagaacactgctatgattgtctgaatgtttgtctctaatacagggtcccagaacactgtgacgagtgtctgaatgtttgtccataatataggtttccagaacacagctgctgttgtttgtttttccctcacaggattccagaacaatactgcaattgtatgagcgtttgtccctcacattggattccagaacactgcttcgaggttctgaatgtttgtccctcacactgaattacagaacacagctggtggggtggaaatgtttgtccgtcacataggattccaggacagtgccacgagggtctgaaagtttgttcctcacaggggattccagatcactcccgatgtgtctgaatgtttgtccctcacacaggattgcataacactgctatgatggtctgaatgattgtcactcaagcagaattccagaacactgctactaggtctgaatgactttccctcacataggattccagaacattgctgctggtttctgaatgtttgtccttcacataagattccagaacactgctgctggtgtctacatgtatgtctgtcacatagaattccagaacactgctgctgggttctgagcatttctccctcatgcagaattccagaacactacaacgaggttctgaatgtttgcccataacacaggattccagaacactcccgctgttgtttgaatgtttgtcactcacataggattccagaacactaacacgagggtctgaatgtttgttcctcacataggattccagaacactgctacaagggtttgaatgtttgttcttcgttggggattccagaacactcctgctctggtatgaatgtttatccctcacatagaattccagaacactgctatgagggtctgaattttttgtccctcacacagaattccccaacactgctatgagggtctgaataattgccctaccatagggttccagaacactgctgctggggtccaaattattgtccctcagataggattccagaacatgctgatggggtctacatgtattgccgtcacataggattccagaacactgctgctagattctgcattttgctccctcacatagaattccagaagagtgcgacgagggtctgaatgttttttcatatcataggattccagaacactcctgctgttgtttgaatgtttgttcctcacacaggattccacaacacagctaaaaatgtctgaaagtttgtccctcagataggattccagaacactgcggctgtggtctgaatgtttgtccctcacataggattccagaacactgctatgattgtctgaatgtttgtccctcacatagcattccagaccactgctacaagggtctaaaggcttgttcctcacaaaggattccagagcacacctgctgtggtctgattgtttgttcctcacataggattcctgaacactgctgctagggtctgaatgttggccttcacataggattccagaaccctgatacgattgtctgaatgtttgtccctcacacagcactacagaacactgctacgagggtctgaatgtttgttcctcacatgggattccagaacactgctatgattgtctgaatgtttgttcctcacataggtttccagaaaacttctgctatggtctgaaagtttatccctcacataggattccagaacactgctacgagggtctgaatgtttgtcccttcacataggattacagaacgctgctgctgttgtccaaacatctctctgtcacatagggttccagaacactgcaacatgtgtctgaatgttttccctcacataggattccagaacactctcattgttgtttgaatgtttgttcctcacataggattccagaacactgctgctggggtctgaatgattgttcctcacataggattccagaacactgctgctgggttctgagtgtttctccctcacgtagatttccagaaaacagggacgagggtctgaatgtttgtccataacagaggatttcaggacactctcgctgttgtttgaaagtttgtccctctctaacggggacaaattttgtgtctctatttccttcagttatgctctgattttagttatttcttgccttctgctagcttttgaatgtgtttgctcttgcttttctagttcttttaattgtgatgttagggtgtcaatcttggatctttcctgcattctcttgtgggcatttagtgctataaatttccctctacacactgctttaaatgtgtcccagagattctggtatgttgtgtctttgttctcgttggtttcaaagaacatctttatttctgccttcatttcgttatgtacccagtagtcattcaggaggaggtttttcaatttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgttgaaaaaaatgtgtattctgttgatttggggtggagagttctgtagatgtctattatgtctgcttggtgcagagctgagttcaattcctgggtatccttgttaattttctgtctcgttgatttgtccaatgttgagagtggggtgttaaagtctcccattattattgtgtgggagtctaagtctctttgtaggtcactcaggacttgctttatgaatctgggtgctcctgtattggatgcatatatatttaggatagtgagctcttcttgttgaattgatccctttaccattatgtaatggccttctttgtctcttttgaactttgttggtttaaagtctgttttatcagagactaggattgcaaaccctgccttttttcgttttccattttcttggtagatcttcctccatccctttattttgagcctaaaccctagaaggaaacctggtcaataccattcaggatatagtcatgggcaaggacttcatgtcttaaacaccaaaagtaatggcaacaaaaaccaaaattgggccgggcgcggtggctcacgcctgtaatcc

SEQ ID NO: 1986 - DNA, 6122 bp, Homo sapiens
ggcctatggtggaaaaggaaatatcttcacataaaaactagacagaaaaattctgagaaatttctttgtgatgtgtgaactcatgtcacagagttaaacctttcttttgattgagcagtttcaaaactctttttgtagaatctgcaagtggacatttttagcgctttgaggcctatggtggaaaggaaatatcttcacataaaaactggacagaagaattctgagaaagttctttgtgatgtgtgcgtttgtctcacagagttgaacctttctttcaattgagcagtgtggaaacactgtttttgtagaacctgcaaatggacatttggagtgctttgtggcctatggtagaaaaggaattatcttcacataaaatctagacagaagctatctgagaaacttctttgtgacttgtgcattcatctcgtggagttaaacctttcttttgattgagcagttttgaaactctctttttgcagaatctgcaagagtacatttggaacgctttgaggcctatggtggaaaatgaaatatcttcacataaaaactagacagaataattctgagaaacttctttgtgatgtgtgcattcatctcacaatgttaaacctttcttttgattgagcagttttgaaactctttttgtagaatctgcacgtggacatttttagcctttgaggcctatggtggcaaggaaatatcttcagataaaaactggacagaagcaatctgagaaacttctttgttatgtgtgcattcatctcacagagttgaacctttcttttgattgagcagtttggaaacactctttttgtagaatctgcaagtgaacatttgaagcgctttgcagcctatggtagaaaaggaattgtcttcacataaaatctagagagaagcaaaactttcttttgattgagtagttttgaaactctcttttcgtagaaactgcaagtggacatatggagcgctttgaggcctaagctctaaaaggaaataacttcccataaaaactagacagaagaattctgagaaacttcttgtgatgtgtgagttcatctcacagagttgaacctttcttttattgagcagtttggaaactctctttttgtggaatctgcaagtggacacttggagcgctttgccgcctgtggtagaaaaggaaatatattcacataaaatctagacagaagcaatctgagaaacttctttgtgatgtgtgcattcatctcacagagttaaacttttcttttgcttgagaaatttagaaagcttctgtttgtagaatctgcaagtggacatttagagcactttgctgcctatggtagaaaaggaaatatcttcacataaaatctagactgaagcaatctgagaaaattcttcgtgatgtgtgcattcatctgacagagttgaacctttcttttgattgagcagtttggaaacactcttttagtagaatctgcaagtggatatttggggcccttggggtctgaatgattgtccctcacataggattggtgaacactgctgctggggtctgaatgtttgtccctcacataggatcccagaacactgctgctggggtctatatgtatgtccgtcacgtgggattccaaaacactgctgctgggttctgactgtttctccctctcatagaattccatagcactgcgacgaggttctgaatgtttgtccgtaacataggattccagaaccccccgcctgttgtttaaatgtttgtccctcacattggattccagaacactgctgctggattctgaatgtttgtcactcacagaggattccagaacactgctactattgtctgaatgtttgtccctcacataggattctagaaccctcctaagagtgtgtgaatgtttgttcctcacatagatttccagatcactgctacgattgtctgaatgtttgtcctacacttaggattccagaacactgctatgacagtcgaatgattgtccctcacacagaattccagaacactgctacgagggtctgaatgattgtccctcacataggattcgaggacactgctgctggggtctgaatgtttttccctcacataggatcctagaacactgttgctggggtctacatgtgtgtctgtcacataggattccaaaacactgctgctgggttctgactgtttttccctgacatagaattcaagaacactgcgacgaggttctgaatgtttgtccgtaacataggattccagaacgccccctccccgtagcttaaatgtttgtccctcacattggattccagaacactgctacgatcgtctgaatgtttgtccttcacataggattccaaaacattgctacgggggtctgaatgtttgttcttcacataggattccagaacactcctgctgtgttctgaatgttagttcctcctataggattcacgaacactgtcacgaggttctgaatgtttgttccgcacataggaatccaaaacactcctgctgtgttccgagtgtttgtccctcacatgggattccagaacaatcctgccgtggtctgaatgtgagtccctcacataggtttctggaacactgctgctgggttctgtgtgtttctccctcacgtagaattccataacactgtgaagagattattaatggttgtccgtaacataggattccagaacaatctcggtgttgtttgaatgtttttcccttacataggtttccagaacactgctacgtttgtctgaatgtttgtccctcacataggattccagaacactgctgggagggtctgaatgtttttccctcacatgggattccagaacactgctatgattgtctgaatgtttgtccctcacttaggattccagaacacagccacgagggtctgaatgattgtccctcacatgggattacagaacaatcctgctgtgttctgaatgtttgcccctcacatatagttacagaacactgctgctgggttctgagtggttgtccatcacatgggattccagaacacacctatgagggtctgattgtttttctcttacaaaggattacagaacactgctgctggggtctaaaagtttctccatcacacactattccagagcattgctatgagggtctgaatgtttgtccctcatttagaattccacaacacttctgctggggtgtgaatgtttgtccctcacacaaaattccagaacactgctatgacgatctgaatgactgtccctcatttaggattccaaaacactcctgttgttttctgagtgtttgtccctcacctaggattccagaactatcctcctgttgtcagaatgtttgtctctcacatagggtttcagaacactgctgctgggttctgagtgtttctccctcacataggattccagaacactgctacaagggtctgaatgtttgaccctcacataggatcccagaacactgctgctagggtctagatttttgtccatcacaccggattccagaaccctcctaagagggtctgaatgtctgttcctcacagggaattccagaacactcctgctgtggtctcaatgtttttccctcacacagtactacagaacactgctacaggagtcagaatgtttgtccctcacgcagaattccagaacactggcacgagtgtctgaatgattggccctcacataggattccagaacactgtcgctggggtcgtaatgtttgtccctcacataggattccagaacactgcttttgggttctgagtgtttctcgctcacatagaattccagaacactgcgatgagggtctagaatgtttgtccataacataggattcctgaacaatcccgctgttgtttgaatgtttgtccctcacataggattacggaacactgctacgattgtctgaatgtttgtccctcacatagcattccagaacactgctacgactgtctgaacgtttattcctcacaggggattccagaacactcctgctatggcctggatgattgtccctcacataggattccagaacactgctatgagggtctgaaagtttgtgcttgacacagaattccagaacactgctacgagggtctgaatgactgtccctcacataggattccaaaacactgctgctggggtctacatgtatgtccgtcacataggattccagaacactgctattgggatattaatgtttgtccctcacataagattccaaaacactcctgctttgatctgagtgattgtccctcacatacgattccagaaccctactgctgggttttgagtgtttctacctcacatagatttgcagaagactgcaacaggggtctgaatgtttgtccgtaacataggactccagaacactccagctgttgttagaatgtttgtctctcacataggattgcagaacacttcttcttgggtctgaacggttgtctctcacacaggattccagaacactaatacgatggtctgaatgtttatccctcatgtaggattccagaacactgctgtgagggtctgcatgtttgtccctcagataggattcctgaaccatcctgcagtggtctgaatgtttgtccctcacactggattccagaactctgctacaagggtctaaatgttgtccctcccataggattgcaatacactaatgcttttttctgagtgtttctccctcacataggattccagaacaatcctgctgtggtctgattgtttgtccctcacatagggttccagaacactgctgctaggttctgagtgtttatccgtcacagagcattccagaacactgctgctaggtactcattgtttctccctcacatagaattccagaaaactgtgactagggtctgaatgtttgtgcataacataggattccagaacactcccgcccttgtttgaatgattttccttcacataggattccaggacgctgctaggagggtctgaatgtttgttccacacaggggattcaagaacactcctgacttgatctgaatgtttgtccctcacataggattccagaacactgctatgaggttgtgaaagtttgtccctcataaggaattccagaacactgctatgatgctctgaatgtttgtctctcacataggaatccaaaacactcttgctgtagtctgagtgtttgtccctcacaaaggattccagaacaatcctgctgtggtctgaatgtttgtccctcacataggattccagaacactgctaagagggtatgaatgtttgtccctcacataggattccaaaacactcgtactgtgttcttagtgtttctccctcacataggattccagaacaccgctgctggagtctaaatgtttgttcatcacataggattccagaacattgctatgaggttatgaatgtttgttccccacaggggtttccagaacactcctgctttggtctgaatgtttacccctcacacaggattccagaacactgctacaagggtttgaatgtttctacctcacatagaattccagcactctgtgatgaggttccgaatgtttgtgcatcacatagaattccagaacactgctacgattgtctgaatgtttgcccatcacatgggattccagaacactggaaggcagccaagatggccgaataggaacagctctggtctacagctcccagcgtgagcgacacagaagatggatgatttgtgcatttccgtctgaggtactgggttcatctcactaggaagtgccagccctacagtgggtgcaggagagtgggtgcagtgcactgtgcaggagctgaagcagggtgaggcattgcctcactcaggaagtgcaaggggtcagggagttccctttcctagtcaaagaaaggggtgacagatggcacctggaaaatcgggtcaccctctcctgaacactgcgcttttctgacaggcttaaaaaccggtgcaacaggagattatatcccgcacctggctcggagggtcctatggctatggagtatggctgattgctagcacagcagtctgagttcaagctgcaaggcagcagcgaggctgcaggaggggcgtccaccattgcccaggcttgcttaggtaaacaaagcagccaggaagctcaaactgggtggagcccaccac

SEQ ID NO: 1987 - DNA, 10679 bp, Homo sapiens
gtccctcacataacactccagaacactgctgctggggtctcaatgtttgtcagtcacacaggattccagaacactgctacgatagcctgaatgtttgttcttcagaggggattccagaatactcctgctgtggtctgaatgcttgttcctcacacaggactccagaacactgctacgagggtctgaatgattgtctctcacataggattgcaaaatagtccagctgtcttctgagtgtttgtccatcacataggattccagaacactcctgctgtggtctgaaagtttgtccctcacacagaattccagaacactgatacgaggttctcaatgattgtccctcacacagtattccagaacactgctgctggggtctgaatgaatattcctcacatagcgttccacagcactgcttctggggtcttcatgtatgtctgtcacataggatttcagaacactgctgctgggttctgggtgtttctccctcacatagcattctagaacactgtgatgagagcctgaatgtttgtctgtaacataggattccagaacactcccactgttgtttgaatgtttgtccctcacataggattccagaacactgctgctggggtatacatgtgtgtctgtcacataggattccagagcactgctgctgggttctgagtctttctccctcacatagaactccagagcactgcgacgagggtctgaaagtttgtttgcaataaaggattccagaacactcccgttgttgtttcaatgtttgtaacttacataggattccagaatacttctgctgaggtctaaatgcttgtccgtcacttaggattccagaacactgctacgagagtgtgaatgtttgtccctcacacagaattccagaacagtgctacgatggtctgaatgattgtccctcacatgggactccagaacactgctgctgggttctgaatatttgtccctcacataggattccagaacacggctgcaggggtctacatgtatgtccgtcacatgggattccagaacaatgctgcaggattctgagtgttcctccctcacatagaattccagaagactgcgacgagggtctgaatatttgtccgtaacataggattccagaagactcctgctgttgtttgaatgtttgtccctcacataggattccagaacactgctgcttgagtctgaaggttttttcgtcacacaggattccagaaccctgctacaattgtctgaatgtttgccactccataggattccagaacactgccacgagggtctgaaagtttgtccctcactgtggattccagaacactctgctgtggtctgaatgtttgtccctcacttaggatccagaacagtgatacgagggtctgaatgttcttccctcacttaggactctagaacactgctacgattgtctgaatgtttgtccctcacataggattccagaacactgctacgattgtctgaatgtttgtccctcatataggattccagaacactcctgttgtggtctgaatgtctgtccctcatatagggttgcagaacactgctgctagattctcagtgtttgtccctcacataggattctggaacactgctacaagggtctgaatatttgtcacacacacataggattccaaaacactgctgctggggtctgaatgtttgtccctcacataggattccagaacactgctgctggggtctacatgtatggccgtcacatggggttccagatccctgctgctgggttctgaatgtatctccctcacatagaactccagaacactgcaacaagagtctgaatgtttctccgtaacatagcattccggaacactctcactgttgtttgaacgtttgtccctcacataggactccagaacactgctactggggtctgagtgtttgtccctcacataggactccagaacactgccacgaggctctgaatgtttattccttacaggggattccagaacactcctgttgtgttgtgaatatttgtccctcacacaggagtccagaacactcctatgaggctctgaatttttgtccctcacacagaattccagaacaccgctatgagggtctgaatgattttccctcacatagcattccagaacactgctgctggagtctgaatgtttgtccctcacataggattccagaaaactgctgctggtttctgagtgcttctccctcatacagaattccagaaaactgtgacgagggtcagaatgtttgtccgtaacataggattgcagaacactcccgctgttgtttgaatgattgtccctcacataggattccagaacactgctgctgggttgcgagtgtgtctccctcacatagaattccagaacactgcgaagaagttctgaatatttgtccataacataggattccagaacactcctgcagttgtttgaatttttgtccctcccataggattccagaacactactgctggggtgtgagtgtatgtccctcacttaggattccagaacactgcaaagattctcttaaagattgtccctcacataggtttccggaacactgctatgagagtctgaatgtttgtccctcacacaggattccataatactcctgctgtgttctgaatatttgtacgtcacataggattcctgaacactactacgagattctgaatgtttgttgctcacataggattccaaaatgtccctgctgtgttctgagtgtttgtccctcacatagggtcactgctgctgggttctcagtgtttctcactcacatagaattccagaacactgcaaagaggttctgaatgtttttctgtaacatagtattccagaacactctcgctgttttttgaatgtttgtccctcacataggattccagaacacttctgctggtgtctgaaagtttgtccctcacacaggattccagaacactgctacgagggtctgaatgtttttccctcacaaagggttccagaacaaagctgttggagtcataatgtttgtctgtcacacaggattctagaacactgctacgaggttatgaatgtttgttcctcaaagggtttttcagaacactcctgttgttgtctgaatgtgtgtccctcacacaggattccagaacactgctacgaggttctgaatgtttctcccttacatagaattccagaacactgctaccaatgtctgaatgtttgtctctcacataggattccagaacactgctacgattgtctgaaagtttgtcgctcacataggattccagaacactgctacgattgtctgaaagtttgtccctcacataggattccagaacgctgctatgagggtctgaatgtttgtccctcatgcagagtaccagaacactgcttcgagggtctgaatgattgtccctcacataggattccagaacacggctgctggggtctcaatgtttgtgccacacataggattccagaatacggctgctggggtccacttgtaagtccgtcacaatggattccagaacacagctgctgggttctgagtgtttctccctcacttggaatttcagaacactgatatgagggtctgaaagtttttctgttacttaggactccagggctttccctctgttgtttgaatgtttgtccctcacagaggattccagaaaaatgctacgattgtatgaatgtttgtcccccacatatgattaaagaacactgcgaagagggtctgaatgtttgtctgaaacataggtttcccaaacagtttcgctgttgtttgactgtttttccctcacataggattccagaaaaatgctacgattgtatgaatgctggtccctcacataggattccagaacagtgctacgagggtctgaatatttgtccctcacatgggattccagaacacttctgctgtgttctgaatgtttggccctcagaaaggattcctgaactctgctacgacagtatgaatgtttgtccctcacatcagattccaaaacactcctactgtgttctgagtgtttgtccctcacatagaattctagaacagtcctgctattgtctgaatgtttgtcacacacacagggttgctgataactgctgctgagttctgaatgtttctccctaacatagaactctagaacactgtgacgaggttcggaatgtttgtcggtaacataggattcaaaaacactcatgctgttgtttgaatgtttgtccctcaagtaggattccagaacactgcttctggggactacatgtatgtctgtcacataggattccagaacactgctgttgggttctgtgtgtttctccctcacatagaattccagaacactgcgatgagggtatgaatgttgttcataacataggactccagaaaactcacgctcttctttgaatgtttgtccctcacgttggattccagaacactgctgctggggtctcaaagtttgtccctaacataggattccagaacactgctacgattgtctgaatattttgccttcacataatattccagaacactgctacgagggtctgaatgtttgtccctcaaataggattccagaatgctgctgctgggttctaaatgtttgtcggtcacataggattccagaacactgctgctggggtctgaatgtttgtccctcacatattattccagaacactgctgggttctaaatgtttgttggtcacatcagattccagaacactgctgctggggtgtgaatgtttatccctcacataggattccagaacacagttgctggggtctacatgtatgccagtcacatgggattccagaacactgctgctgggttcacagtgtttctccctcacatagaattccagataattgagacaatattctgaatgtttgaccataacataggattccagaacattcccgctcttgtttgaatgtttgtccctcacatagcattgcagaacactgctgctggggtctgaatgtttgtctctcacataggattccagtacactgctacgattgtcagaatgtttatccctcacctaggattacagaacactgctatgatgctctgaaagtttgtccctcacataggattccagaacactgctgctgaggtataaatgtttgtccatcacatgggattccagaacaaagctacgagtgtctgaatgttcctcacagcagattccataacactcctgctgtggtctcaatgtgtgtccctcacaaaggatttcagaacacggctaagagggtatgaatgtttgtccctcatacagaattccagaacactgctacgagggtctgaatgctggtccctcacataggacaccagaacactgctacggttgtctgaatgtttgtcccttccataggattcctgaacactgcttcgagggtctgaatgtttgtccctcacattgcattccaaaacactcctgttgtgttctgtgagtttgaccctcacataggattccagaacaatcctgctgtggtgtgaatgcttgtccctcacatatggttccagaacactgttgctgggttctgagtgtttgtccctcacaagggattccagaacactgctacgagggtgtgaatgtttgtcccacacaaaggattccagaacactgctactggggtctaaatgtttgtccgtcacatagcattcctgaacaatgttacaagaatctgaatgtttgtacctcacataggattcctgaaccactgctacgagggtctgaatgtttgtccctcacatagaattccaaaatactcctgctgtgttctgagtgtttgtccctcacatagcattccagaacactgcagctagggtctaaatgtccgtcacataggattctggaaaactactatgaggttctgaatgtttgtctctcacacagaattccagaacactgctacgagtttctgaatgacagtccctcacataggattccagaatactgctgctggggtctgaatgcttgtccctcacataggattccagaactctgctgctggggtgtacatgtatgtccgtcacataggattccagaacactgctgctgggttctgagtgtttctcactcgcataggattccagaacactgctacaagtgtctgaatgtttgtctgtcacattggattccaaaacactcctgctgtgttctgagtgtttgttcctcacataagattgcagaacactcctgctgtggccggaaagtttgtccctcacataagattccagaacactgctgctggaatctgaatatttgtccctcaagtaggtttctagaacaatgctactattgtttgaatgtttgtccctcacatgggattccagaacgctcctgctgtggtctgaaagtttgtccctcacataggattcctgaacactgctacgagtgcctgcatgtttgtccctcacatcagattccaatacattcctgctgtgttctgagtatttctccctcacatatgattctagagcaatcctgctgtgatctgaatgtttgtccctcacatagggatccagaacactgttgctgggttcttaatgtttctccctaaagtagaactccagaacactgcctcgagggtgtgaatgcttgtccgtaacacaggattccagaacactctaactgttgtttgaatgtttgtccctcaaataggattccagaacagtgctgctggggtctacatgcatgtccgtcagagaggataccagaacactgatgctcggttctgagtgtttctccctcacatcgaattctagcacactgtgaccagtttctgaatgtttttctgtaacatgggattctagaacactcccgctgttatttgaatgtttgtccctcacataggattccagaacactgctatgagtgtctgaatgtttgtccctcacttaagattccagaacactgctatgagggtctgaatgtttttccctcacataggaatccagaacaccgttacgagggtcggattgttcgttcctctcaggggattcctgaacactcctgctgtggtctgaatgattgtctgtcaaacaggattccaggacactgctacgagggtctgaatgtttgtccctcacacagaattccagaacactgctacgtgggtctgaatgattgtccctcacgtaggattccagaacactgccatgagggtcttaatgtttgctcctcacttaggactccagaacattcctgctgtggtctgaatgtttctcccccacataggattcctgaacactgctatgagggtctggatgtttgtccctcacataggattccaaaacattcctgctgtgttccgagtgtttgtccctcacatacgattccagaacaatcctgctgtggtccgaatgtttgtccctcacatgcggttccagagcacagctgctgggttctgagtgtttctccctcacatagaattccagaacactgcgacgagtttctgaacgtttgtccataacattggattccaaaacactcttgctgttgtttgaatgtttgtccgtcacacaggattccagaatactgctgctggggtctgaatgtttgtcccttacgaaagattctagaacactgctatgattgtctgaatgtttgtctctaatacagggtcccagaacactgtgacgagtgtctgaatgtttgtccataatataggtttccagaacacagctgctgttgtttgtttttccctcacaggattccagaacaatactgcaattgtatgagcgtttgtccctcacattggattccagaacactgcttcgaggttctgaatgtttgtccctcacactgaattacagaacacagctggtggggtggaaatgtttgtccgtcacataggattccaggacagtgccacgagggtctgaaagtttgttcctcacaggggattccagatcactcccgatgtgtctgaatgtttgtccctcacacaggattgcataacactgctatgatggtctgaatgattgtcactcaagcagaattccagaacactgctactaggtctgaatgactttccctcacataggattccagaacattgctgctggtttctgaatgtttgtccttcacataagattccagaacactgctgctggtgtctacatgtatgtctgtcacatagaattccagaacactgctgctgggttctgagcatttctccctcatgcagaattccagaacactacaacgaggttctgaatgtttgcccataacacaggattccagaacactcccgctgttgtttgaatgtttgtcactcacataggattccagaacactaacacgagggtctgaatgtttgttcctcacataggattccagaacactgctacaagggtttgaatgtttgttcttcgttggggattccagaacactcctgctctggtatgaatgtttatccctcacatagaattccagaacactgctatgagggtctgaattttttgtccctcacacagaattccccaacactgctatgagggtctgaataattgccctaccatagggttccagaacactgctgctggggtccaaattattgtccctcagataggattccagaacatgctgatggggtctacatgtattgccgtcacataggattccagaacactgctgctagattctgcattttgctccctcacatagaattccagaagagtgcgacgagggtctgaatgttttttcatatcataggattccagaacactcctgctgttgtttgaatgtttgttcctcacacaggattccacaacacagctaaaaatgtctgaaagtttgtccctcagataggattccagaacactgcggctgtggtctgaatgtttgtccctcacataggattccagaacactgctatgattgtctgaatgtttgtccctcacatagcattccagaccactgctacaagggtctaaaggcttgttcctcacaaaggattccagagcacacctgctgtggtctgattgtttgttcctcacataggattcctgaacactgctgctagggtctgaatgttggccttcacataggattccagaaccctgatacgattgtctgaatgtttgtccctcacacagcactacagaacactgctacgagggtctgaatgtttgttcctcacatgggattccagaacactgctatgattgtctgaatgtttgttcctcacataggtttccagaaaacttctgctatggtctgaaagtttatccctcacataggattccagaacactgctacgagggtctgaatgtttgtcccttcacataggattacagaacgctgctgctgttgtccaaacatctctctgtcacatagggttccagaacactgcaacatgtgtctgaatgttttccctcacataggattccagaacactctcattgttgtttgaatgtttgttcctcacataggattccagaacactgctgctggggtctgaatgattgttcctcacataggattccagaacactgctgctgggttctgagtgtttctccctcacgtagatttccagaaaacagggacgagggtctgaatgtttgtccataacagaggatttcaggacactctcgctgttgtttgaaagtttgtccctctctaacggggacaaattttgtgtctctatttccttcagttatgctctgattttagttatttcttgccttctgctagcttttgaatgtgtttgctcttgcttttctagttcttttaattgtgatgttagggtgtcaatcttggatctttcctgcattctcttgtgggcatttagtgctataaatttccctctacacactgctttaaatgtgtcccagagattctggtatgttgtgtctttgttctcgttggtttcaaagaacatctttatttctgccttcatttcgttatgtacccagtagtcattcaggaggaggtttttcaatttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgttgaaaaaaatgtgtattctgttgatttggggtggagagttctgtagatgtctattatgtctgcttggtgcagagctgagttcaattcctgggtatccttgttaattttctgtctcgttgatttgtccaatgttgagagtggggtgttaaagtctcccattattattgtgtgggagtctaagtctctttgtaggtcactcaggacttgctttatgaatctgggtgctcctgtattggatgcatatatatttaggatagtgagctcttcttgttgaattgatccctttaccattatgtaatggccttctttgtctcttttgaactttgttggtttaaagtctgttttatcagagactaggattgcaaaccctgccttttttcgttttccattttcttggtagatcttcctccatccctttattttgagcctaaaccctagaaggaaacctggtcaataccattcaggatatagtcatgggcaaggacttcatgtcttaaacaccaaaagtaatggcaacaaaaaccaaaattgggccgggcgcggtggctcacgcctgtaatcc

SEQ ID NO: 1988 - DNA, 9612 bp, Homo sapiens
gtcccacacatagcattccagaacactgctactggtgtctgaatgtttgtcccacacatagtattccagaatctgctatgattgtctgaaggtttgtccctcacataggattccagaacactgctaggttctgaatgtttgtccctcacctaggatttcagaacactgctcctcgaatataaatatttatccttcacataggattccagaacacagctatgagggtctgaatgtatgtttcccacgtaggattccaaaacactcctgctgtgttctgagtgtttgtccctcacataggattccagaacaatcctgctgtgttctgaaggtttgtcccatacatagggttacagagaactgctgcagtgttatgagtgattctccctcacatagaattccagaacagtacgacgagggtctgaatgttcgtccgtaaaataggattccgtaacactctcgatgttgtttaaatgtttgtcctgcacatagcattccagaacactgctacttgtgtctgaatgtttgtcccatacatagtattccagaatctgctatgattgtctgaatgtcactcacctaggatttcagaacactgctcgtcagatataaatatttatccatcacaggattccagaacactgctaagaggttctgaatgtttgttcttcacagtggattccagaacactcctgctgtggtctgaatgtttgtccctcacaaaggaatccagaacaatgctacgcaggtctcaatgtttgtccctaacaaagaattccagaacactgctatgagtgtctgaaagattggccctctcatacgtttccagaactctgctgctggtgtctgaatgtttgtccctcacacaggattccagaacactgctactgggttctgaattttgtccctcaaacagaattccagatcactgctacgagggtctgaatgattgtcccttacgtaggattccctaacactgttgctggtttctgaatgtttgtccctcacacaggattccagaacactgctgcagggttctaaatgtttgtctgtcatataggattccagagaacagctacgagggtctgaatgtttgttcctcacagaggattccagaagagtcctgctttggtgtgaatgtttgtgcctcacacaggaattcagaacacggctatgaggttgtgaatgtttgtccctcacacacaattccagaatgctgctatgagggtctgaatgattgtccctcacataggattccagaacactgctgctgggttgcgagtgtgtctccctcacatagaattccagaacactgcgaagaagttctgaatatttgtccataacataggattccagaacactcctgcagttgtttgaatttttgtccctcccataggattccagaacactactgctggggtgtgagtgtatgtccctcacttaggattccagaacactgcaaagattctcttaaagattgtccctcacataggtttccggaacactgctatgagagtctgaatgtttgtccctcacacaggattccataatactcctgctgtgttctgaatatttgtacgtcacataggattcctgaacactactacgagattctgaatgtttgttgctcacataggattccaaaatgtccctgctgtgttctgagtgtttgtccctcacatagggtcactgctgctgggttctcagtgtttctcactcacatagaattccagaacactgcaaagaggttctgaatgtttttctgtaacatagtattccagaacactctcgctgttttttgaatgtttgtccctcacataggattccagaacacttctgctggtgtctgaaagtttgtccctcacacaggattccagaacactgctacgagggtctgaatgtttttccctcacaaagggttccagaacaaagctgttggagtcataatgtttgtctgtcacacaggattctagaacactgctacgaggttatgaatgtttgttcctcaaagggtttttcagaacactcctgttgttgtctgaatgtgtgtccctcacacaggattccagaacactgctacgaggttctgaatgtttctcccttacatagaattccagaacactgctaccaatgtctgaatgtttgtctctcacataggattccagaacactgctacgattgtctgaaagtttgtcgctcacataggattccagaacactgctacgattgtctgaaagtttgtccctcacataggattccagaacgctgctatgagggtctgaatgtttgtccctcatgcagagtaccagaacactgcttcgagggtctgaatgattgtccctcacataggattccagaacacggctgctggggtctcaatgtttgtgccacacataggattccagaatacggctgctggggtccacttgtaagtccgtcacaatggattccagaacacagctgctgggttctgagtgtttctccctcacttggaatttcagaacactgatatgagggtctgaaagtttttctgttacttaggactccagggctttccctctgttgtttgaatgtttgtccctcacagaggattccagaaaaatgctacgattgtatgaatgtttgtcccccacatatgattaaagaacactgcgaagagggtctgaatgtttgtctgaaacataggtttcccaaacagtttcgctgttgtttgactgtttttccctcacataggattccagaaaaatgctacgattgtatgaatgctggtccctcacataggattccagaacagtgctacgagggtctgaatatttgtccctcacatgggattccagaacacttctgctgtgttctgaatgtttggccctcagaaaggattcctgaactctgctacgacagtatgaatgtttgtccctcacatcagattccaaaacactcctactgtgttctgagtgtttgtccctcacatagaattctagaacagtcctgctattgtctgaatgtttgtcacacacacagggttgctgataactgctgctgagttctgaatgtttctccctaacatagaactctagaacactgtgacgaggttcggaatgtttgtcggtaacataggattcaaaaacactcatgctgttgtttgaatgtttgtccctcaagtaggattccagaacactgcttctggggactacatgtatgtctgtcacataggattccagaacactgctgttgggttctgtgtgtttctccctcacatagaattccagaacactgcgatgagggtatgaatgttgttcataacataggactccagaaaactcacgctcttctttgaatgtttgtccctcacgttggattccagaacactgctgctggggtctcaaagtttgtccctaacataggattccagaacactgctacgattgtctgaatattttgccttcacataatattccagaacactgctacgagggtctgaatgtttgtccctcaaataggattccagaatgctgctgctgggttctaaatgtttgtcggtcacataggattccagaacactgctgctggggtctgaatgtttgtccctcacatattattccagaacactgctgggttctaaatgtttgttggtcacatcagattccagaacactgctgctggggtgtgaatgtttatccctcacataggattccagaacacagttgctggggtctacatgtatgccagtcacatgggattccagaacactgctgctgggttcacagtgtttctccctcacatagaattccagataattgagacaatattctgaatgtttgaccataacataggattccagaacattcccgctcttgtttgaatgtttgtccctcacatagcattgcagaacactgctgctggggtctgaatgtttgtctctcacataggattccagtacactgctacgattgtcagaatgtttatccctcacctaggattacagaacactgctatgatgctctgaaagtttgtccctcacataggattccagaacactgctgctgaggtataaatgtttgtccatcacatgggattccagaacaaagctacgagtgtctgaatgttcctcacagcagattccataacactcctgctgtggtctcaatgtgtgtccctcacaaaggatttcagaacacggctaagagggtatgaatgtttgtccctcatacagaattccagaacactgctacgagggtctgaatgctggtccctcacataggacaccagaacactgctacggttgtctgaatgtttgtcccttccataggattcctgaacactgcttcgagggtctgaatgtttgtccctcacattgcattccaaaacactcctgttgtgttctgtgagtttgaccctcacataggattccagaacaatcctgctgtggtgtgaatgcttgtccctcacatatggttccagaacactgttgctgggttctgagtgtttgtccctcacaagggattccagaacactgctacgagggtgtgaatgtttgtcccacacaaaggattccagaacactgctactggggtctaaatgtttgtccgtcacatagcattcctgaacaatgttacaagaatctgaatgtttgtacctcacataggattcctgaaccactgctacgagggtctgaatgtttgtccctcacatagaattccaaaatactcctgctgtgttctgagtgtttgtccctcacatagcattccagaacactgcagctagggtctaaatgtccgtcacataggattctggaaaactactatgaggttctgaatgtttgtctctcacacagaattccagaacactgctacgagtttctgaatgacagtccctcacataggattccagaatactgctgctggggtctgaatgcttgtccctcacataggattccagaactctgctgctggggtgtacatgtatgtccgtcacataggattccagaacactgctgctgggttctgagtgtttctcactcgcataggattccagaacactgctacaagtgtctgaatgtttgtctgtcacattggattccaaaacactcctgctgtgttctgagtgtttgttcctcacataagattgcagaacactcctgctgtggccggaaagtttgtccctcacataagattccagaacactgctgctggaatctgaatatttgtccctcaagtaggtttctagaacaatgctactattgtttgaatgtttgtccctcacatgggattccagaacgctcctgctgtggtctgaaagtttgtccctcacataggattcctgaacactgctacgagtgcctgcatgtttgtccctcacatcagattccaatacattcctgctgtgttctgagtatttctccctcacatatgattctagagcaatcctgctgtgatctgaatgtttgtccctcacatagggatccagaacactgttgctgggttcttaatgtttctccctaaagtagaactccagaacactgcctcgagggtgtgaatgcttgtccgtaacacaggattccagaacactctaactgttgtttgaatgtttgtccctcaaataggattccagaacagtgctgctggggtctacatgcatgtccgtcagagaggataccagaacactgatgctcggttctgagtgtttctccctcacatcgaattctagcacactgtgaccagtttctgaatgtttttctgtaacatgggattctagaacactcccgctgttatttgaatgtttgtccctcacataggattccagaacactgctatgagtgtctgaatgtttgtccctcacttaagattccagaacactgctatgagggtctgaatgtttttccctcacataggaatccagaacaccgttacgagggtcggattgttcgttcctctcaggggattcctgaacactcctgctgtggtctgaatgattgtctgtcaaacaggattccaggacactgctacgagggtctgaatgtttgtccctcacacagaattccagaacactgctacgtgggtctgaatgattgtccctcacgtaggattccagaacactgccatgagggtcttaatgtttgctcctcacttaggactccagaacattcctgctgtggtctgaatgtttctcccccacataggattcctgaacactgctatgagggtctggatgtttgtccctcacataggattccaaaacattcctgctgtgttccgagtgtttgtccctcacatacgattccagaacaatcctgctgtggtccgaatgtttgtccctcacatgcggttccagagcacagctgctgggttctgagtgtttctccctcacatagaattccagaacactgcgacgagtttctgaacgtttgtccataacattggattccaaaacactcttgctgttgtttgaatgtttgtccgtcacacaggattccagaatactgctgctggggtctgaatgtttgtcccttacgaaagattctagaacactgctatgattgtctgaatgtttgtctctaatacagggtcccagaacactgtgacgagtgtctgaatgtttgtccataatataggtttccagaacacagctgctgttgtttgtttttccctcacaggattccagaacaatactgcaattgtatgagcgtttgtccctcacattggattccagaacactgcttcgaggttctgaatgtttgtccctcacactgaattacagaacacagctggtggggtggaaatgtttgtccgtcacataggattccaggacagtgccacgagggtctgaaagtttgttcctcacaggggattccagatcactcccgatgtgtctgaatgtttgtccctcacacaggattgcataacactgctatgatggtctgaatgattgtcactcaagcagaattccagaacactgctactaggtctgaatgactttccctcacataggattccagaacattgctgctggtttctgaatgtttgtccttcacataagattccagaacactgctgctggtgtctacatgtatgtctgtcacatagaattccagaacactgctgctgggttctgagcatttctccctcatgcagaattccagaacactacaacgaggttctgaatgtttgcccataacacaggattccagaacactcccgctgttgtttgaatgtttgtcactcacataggattccagaacactaacacgagggtctgaatgtttgttcctcacataggattccagaacactgctacaagggtttgaatgtttgttcttcgttggggattccagaacactcctgctctggtatgaatgtttatccctcacatagaattccagaacactgctatgagggtctgaattttttgtccctcacacagaattccccaacactgctatgagggtctgaataattgccctaccatagggttccagaacactgctgctggggtccaaattattgtccctcagataggattccagaacatgctgatggggtctacatgtattgccgtcacataggattccagaacactgctgctagattctgcattttgctccctcacatagaattccagaagagtgcgacgagggtctgaatgttttttcatatcataggattccagaacactcctgctgttgtttgaatgtttgttcctcacacaggattccacaacacagctaaaaatgtctgaaagtttgtccctcagataggattccagaacactgcggctgtggtctgaatgtttgtccctcacataggattccagaacactgctatgattgtctgaatgtttgtccctcacatagcattccagaccactgctacaagggtctaaaggcttgttcctcacaaaggattccagagcacacctgctgtggtctgattgtttgttcctcacataggattcctgaacactgctgctagggtctgaatgttggccttcacataggattccagaaccctgatacgattgtctgaatgtttgtccctcacacagcactacagaacactgctacgagggtctgaatgtttgttcctcacatgggattccagaacactgctatgattgtctgaatgtttgttcctcacataggtttccagaaaacttctgctatggtctgaaagtttatccctcacataggattccagaacactgctacgagggtctgaatgtttgtcccttcacataggattacagaacgctgctgctgttgtccaaacatctctctgtcacatagggttccagaacactgcaacatgtgtctgaatgttttccctcacataggattccagaacactctcattgttgtttgaatgtttgttcctcacataggattccagaacactgctgctggggtctgaatgattgttcctcacataggattccagaacactgctgctgggttctgagtgtttctccctcacgtagatttccagaaaacagggacgagggtctgaatgtttgtccataacagaggatttcaggacactctcgctgttgtttgaaagtttgtccctctctaacggggacaaattttgtgtctctatttccttcagttatgctctgattttagttatttcttgccttctgctagcttttgaatgtgtttgctcttgcttttctagttcttttaattgtgatgttagggtgtcaatcttggatctttcctgcattctcttgtgggcatttagtgctataaatttccctctacacactgctttaaatgtgtcccagagattctggtatgttgtgtctttgttctcgttggtttcaaagaacatctttatttctgccttcatttcgttatgtacccagtagtcattcaggaggaggtttttcaatttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgttgaaaaaaatgtgtattctgttgatttggggtggagagttctgtagatgtctattatgtctgcttggtgcagagctgagttcaattcctgggtatccttgttaattttctgtctcgttgatttgtccaatgttgagagtggggtgttaaagtctcccattattattgtgtgggagtctaagtctctttgtaggtcactcaggacttgctttatgaatctgggtgctcctgtattggatgcatatatatttaggatagtgagctcttcttgttgaattgatccctttaccattatgtaatggccttctttgtctcttttgaactttgttggtttaaagtctgttttatcagagactaggattgcaaaccctgccttttttcgttttccattttcttggtagatcttcctccatccctttattttgagcctaaaccctagaaggaaacctggtcaataccattcaggatatagtcatgggcaaggacttcatgtcttaaacaccaaaagtaatggcaacaaaaaccaaaattgggccgggcgcggtggctcacgcctgtaatcc

SEQ ID NO: 1989 - DNA, 9196 bp, Homo sapiens
ggggaacatcacactccggggactgttgtgggttgggggaagcagggagggatagcatcaggagatatacctaatgttaaatgacgagttaatgggtgcagcacaccaacatggcacatgtatacatatgtaacaaacctgcacgttgtgcacatgtaccctaaaacttaaagtataataaaaaaaaagaaaagctaaaaaaaaaaaaaaggattccagaacactgctacgattgtctgaatgtttgttcctcaaataggattctagaatgctcctgctgtggtctgaatgtttgtccctcacataggattcctgaacactgctatgaggttctgagtgtttatacctcagataggattccaaaatactcttgctattttctgagagtttgtccctcccataggattccagaacattgctgctggggtctgaatgtttgtccctcacataggattccagaacactgctaggattgtctgaatgtttgtgtctcacatggaattccataacactgctattagggtctgaaagtttgtccttcacagaggtttccaggaaactgctacaattatctgaatgtccgttacgtaggattccagaacactgctatgagggtctgaatgtttgtctcttacataggattccagaacactgcagatttggtctgaatgtttatcactcacacaggaatccagaacactgctatgatggtctgaatgttcattcctcacataggattccagaacacagctacaaccgtcttaatgtttgtccctcacaggggattccagaacactcctgctgcagtctgaatgtttctaactcacacaggattccagaacactgctacgagggtctgaatgtttgtccctcacacttaatagcagaacactgatacaagggtctgaataattgtccctagcaaaggattccagagcactgttactgtggtctgaatgtttgtccctcacataggattccagaacactgctgctgggttctgaatgtatctccctcacctagaattccagaacgttgagacgaggttctgaatgtttgtccataacataggattccagaacactgctacaattgtctcaatgtttctcactcacatggcataccagaacactgcggcgagggtctgaatgttttccctcatatacgattccagaacactcatgctgtggtctgaatgtttgtcccttgcataggattcctgaacaatgctgcgagagtctgaatgtttatccctcacataggattccaaaacactcctgctgtagtctcaatgtttgcccctcacataggattccagaacaatcctgctgtggtctgaatgtttgtccctcacatagggctccagaacactcctgctgggttctaagcgtttctccctcaccttaaattcctcaacactgtgatgagggtctgaatgtttgtccataaaataggattcctgaacactcccgctgttgtttgaatgtttgttcctcccttaggactccagaaaactgctgctgggttctgaatggttgtccctcacacaggtttccagaacactgttacgagggtctgaatgtccctcacataggattccagaacactgttgagaagttctaaatgtttgtctgtcatataggattccagagaacagctacgagggtctgaatgtttgttcctcacagaggattccagaagagtcctgctttggtgtgaatgtttgtgcctcacacaggaattcagaacacggctatgaggttgtgaatgtttgtccctcacacacaattccagaatgctgctatgagggtctgaatgattgtccctcacataggattccagaacactgctgctgggttgcgagtgtgtctccctcacatagaattccagaacactgcgaagaaggtctgaatgattgtccctcacataggattccagaacacggctgctggggtctcaatgtttgtgccacacataggattccagaatacggctgctggggtccacttgtaagtccgtcacaatggattccagaacacagctgctgggttctgagtgtttctccctcacttggaatttcagaacactgatatgagggtctgaaagtttttctgttacttaggactccagggctttccctctgttgtttgaatgtttgtccctcacagaggattccagaaaaatgctacgattgtatgaatgtttgtcccccacatatgattaaagaacactgcgaagagggtctgaatgtttgtctgaaacataggtttcccaaacagtttcgctgttgtttgactgtttttccctcacataggattccagaaaaatgctacgattgtatgaatgctggtccctcacataggattccagaacagtgctacgagggtctgaatatttgtccctcacatgggattccagaacacttctgctgtgttctgaatgtttggccctcagaaaggattcctgaactctgctacgacagtatgaatgtttgtccctcacatcagattccaaaacactcctactgtgttctgagtgtttgtccctcacatagaattctagaacagtcctgctattgtctgaatgtttgtcacacacacagggttgctgataactgctgctgagttctgaatgtttctccctaacatagaactctagaacactgtgacgaggttcggaatgtttgtcggtaacataggattcaaaaacactcatgctgttgtttgaatgtttgtccctcaagtaggattccagaacactgcttctggggactacatgtatgtctgtcacataggattccagaacactgctgttgggttctgtgtgtttctccctcacatagaattccagaacactgcgatgagggtatgaatgttgttcataacataggactccagaaaactcacgctcttctttgaatgtttgtccctcacgttggattccagaacactgctgctggggtctcaaagtttgtccctaacataggattccagaacactgctacgattgtctgaatattttgccttcacataatattccagaacactgctacgagggtctgaatgtttgtccctcaaataggattccagaatgctgctgctgggttctaaatgtttgtcggtcacataggattccagaacactgctgctggggtctgaatgtttgtccctcacatattattccagaacactgctgggttctaaatgtttgttggtcacatcagattccagaacactgctgctggggtgtgaatgtttatccctcacataggattccagaacacagttgctggggtctacatgtatgccagtcacatgggattccagaacactgctgctgggttcacagtgtttctccctcacatagaattccagataattgagacaatattctgaatgtttgaccataacataggattccagaacattcccgctcttgtttgaatgtttgtccctcacatagcattgcagaacactgctgctggggtctgaatgtttgtctctcacataggattccagtacactgctacgattgtcagaatgtttatccctcacctaggattacagaacactgctatgatgctctgaaagtttgtccctcacataggattccagaacactgctgctgaggtataaatgtttgtccatcacatgggattccagaacaaagctacgagtgtctgaatgttcctcacagcagattccataacactcctgctgtggtctcaatgtgtgtccctcacaaaggatttcagaacacggctaagagggtatgaatgtttgtccctcatacagaattccagaacactgctacgagggtctgaatgctggtccctcacataggacaccagaacactgctacggttgtctgaatgtttgtcccttccataggattcctgaacactgcttcgagggtctgaatgtttgtccctcacattgcattccaaaacactcctgttgtgttctgtgagtttgaccctcacataggattccagaacaatcctgctgtggtgtgaatgcttgtccctcacatatggttccagaacactgttgctgggttctgagtgtttgtccctcacaagggattccagaacactgctacgagggtgtgaatgtttgtcccacacaaaggattccagaacactgctactggggtctaaatgtttgtccgtcacatagcattcctgaacaatgttacaagaatctgaatgtttgtacctcacataggattcctgaaccactgctacgagggtctgaatgtttgtccctcacatagaattccaaaatactcctgctgtgttctgagtgtttgtccctcacatagcattccagaacactgcagctagggtctaaatgtccgtcacataggattctggaaaactactatgaggttctgaatgtttgtctctcacacagaattccagaacactgctacgagtttctgaatgacagtccctcacataggattccagaatactgctgctggggtctgaatgcttgtccctcacataggattccagaactctgctgctggggtgtacatgtatgtccgtcacataggattccagaacactgctgctgggttctgagtgtttctcactcgcataggattccagaacactgctacaagtgtctgaatgtttgtctgtcacattggattccaaaacactcctgctgtgttctgagtgtttgttcctcacataagattgcagaacactcctgctgtggccggaaagtttgtccctcacataagattccagaacactgctgctggaatctgaatatttgtccctcaagtaggtttctagaacaatgctactattgtttgaatgtttgtccctcacatgggattccagaacgctcctgctgtggtctgaaagtttgtccctcacataggattcctgaacactgctacgagtgcctgcatgtttgtccctcacatcagattccaatacattcctgctgtgttctgagtatttctccctcacatatgattctagagcaatcctgctgtgatctgaatgtttgtccctcacatagggatccagaacactgttgctgggttcttaatgtttctccctaaagtagaactccagaacactgcctcgagggtgtgaatgcttgtccgtaacacaggattccagaacactctaactgttgtttgaatgtttgtccctcaaataggattccagaacagtgctgctggggtctacatgcatgtccgtcagagaggataccagaacactgatgctcggttctgagtgtttctccctcacatcgaattctagcacactgtgaccagtttctgaatgtttttctgtaacatgggattctagaacactcccgctgttatttgaatgtttgtccctcacataggattccagaacactgctatgagtgtctgaatgtttgtccctcacttaagattccagaacactgctatgagggtctgaatgtttttccctcacataggaatccagaacaccgttacgagggtcggattgttcgttcctctcaggggattcctgaacactcctgctgtggtctgaatgattgtctgtcaaacaggattccaggacactgctacgagggtctgaatgtttgtccctcacacagaattccagaacactgctacgtgggtctgaatgattgtccctcacgtaggattccagaacactgccatgagggtcttaatgtttgctcctcacttaggactccagaacattcctgctgtggtctgaatgtttctcccccacataggattcctgaacactgctatgagggtctggatgtttgtccctcacataggattccaaaacattcctgctgtgttccgagtgtttgtccctcacatacgattccagaacaatcctgctgtggtccgaatgtttgtccctcacatgcggttccagagcacagctgctgggttctgagtgtttctccctcacatagaattccagaacactgcgacgagtttctgaacgtttgtccataacattggattccaaaacactcttgctgttgtttgaatgtttgtccgtcacacaggattccagaatactgctgctggggtctgaatgtttgtcccttacgaaagattctagaacactgctatgattgtctgaatgtttgtctctaatacagggtcccagaacactgtgacgagtgtctgaatgtttgtccataatataggtttccagaacacagctgctgttgtttgtttttccctcacaggattccagaacaatactgcaattgtatgagcgtttgtccctcacattggattccagaacactgcttcgaggttctgaatgtttgtccctcacactgaattacagaacacagctggtggggtggaaatgtttgtccgtcacataggattccaggacagtgccacgagggtctgaaagtttgttcctcacaggggattccagatcactcccgatgtgtctgaatgtttgtccctcacacaggattgcataacactgctatgatggtctgaatgattgtcactcaagcagaattccagaacactgctactaggtctgaatgactttccctcacataggattccagaacattgctgctggtttctgaatgtttgtccttcacataagattccagaacactgctgctggtgtctacatgtatgtctgtcacatagaattccagaacactgctgctgggttctgagcatttctccctcatgcagaattccagaacactacaacgaggttctgaatgtttgcccataacacaggattccagaacactcccgctgttgtttgaatgtttgtcactcacataggattccagaacactaacacgagggtctgaatgtttgttcctcacataggattccagaacactgctacaagggtttgaatgtttgttcttcgttggggattccagaacactcctgctctggtatgaatgtttatccctcacatagaattccagaacactgctatgagggtctgaattttttgtccctcacacagaattccccaacactgctatgagggtctgaataattgccctaccatagggttccagaacactgctgctggggtccaaattattgtccctcagataggattccagaacatgctgatggggtctacatgtattgccgtcacataggattccagaacactgctgctagattctgcattttgctccctcacatagaattccagaagagtgcgacgagggtctgaatgttttttcatatcataggattccagaacactcctgctgttgtttgaatgtttgttcctcacacaggattccacaacacagctaaaaatgtctgaaagtttgtccctcagataggattccagaacactgcggctgtggtctgaatgtttgtccctcacataggattccagaacactgctatgattgtctgaatgtttgtccctcacatagcattccagaccactgctacaagggtctaaaggcttgttcctcacaaaggattccagagcacacctgctgtggtctgattgtttgttcctcacataggattcctgaacactgctgctagggtctgaatgttggccttcacataggattccagaaccctgatacgattgtctgaatgtttgtccctcacacagcactacagaacactgctacgagggtctgaatgtttgttcctcacatgggattccagaacactgctatgattgtctgaatgtttgttcctcacataggtttccagaaaacttctgctatggtctgaaagtttatccctcacataggattccagaacactgctacgagggtctgaatgtttgtcccttcacataggattacagaacgctgctgctgttgtccaaacatctctctgtcacatagggttccagaacactgcaacatgtgtctgaatgttttccctcacataggattccagaacactctcattgttgtttgaatgtttgttcctcacataggattccagaacactgctgctggggtctgaatgattgttcctcacataggattccagaacactgctgctgggttctgagtgtttctccctcacgtagatttccagaaaacagggacgagggtctgaatgtttgtccataacagaggatttcaggacactctcgctgttgtttgaaagtttgtccctctctaacggggacaaattttgtgtctctatttccttcagttatgctctgattttagttatttcttgccttctgctagcttttgaatgtgtttgctcttgcttttctagttcttttaattgtgatgttagggtgtcaatcttggatctttcctgcattctcttgtgggcatttagtgctataaatttccctctacacactgctttaaatgtgtcccagagattctggtatgttgtgtctttgttctcgttggtttcaaagaacatctttatttctgccttcatttcgttatgtacccagtagtcattcaggaggaggtttttcaatttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgttgaaaaaaatgtgtattctgttgatttggggtggagagttctgtagatgtctattatgtctgcttggtgcagagctgagttcaattcctgggtatccttgttaattttctgtctcgttgatttgtccaatgttgagagtggggtgttaaagtctcccattattattgtgtgggagtctaagtctctttgtaggtcactcaggacttgctttatgaatctgggtgctcctgtattggatgcatatatatttaggatagtgagctcttcttgttgaattgatccctttaccattatgtaatggccttctttgtctcttttgaactttgttggtttaaagtctgttttatcagagactaggattgcaaaccctgccttttttcgttttccattttcttggtagatcttcctccatccctttattttgagcctaaaccctagaaggaaacctggtcaataccattcaggatatagtcatgggcaaggacttcatgtcttaaacaccaaaagtaatggcaacaaaaaccaaaattgggccgggcgcggtggctcacgcctgtaatcc

SEQ ID NO: 1990 - DNA, 10196 bp, Homo sapiens
gggaacatcacactccggggactgttgtgggttgggggaagcagggagggatagcatcaggagatatacctaatgttaaatgacgagttaatgggtgcagcacaccaacatggcacatgtatacatatgtaacaaacctgcacgttgtgcacatgtaccctaaaacttaaagtataataaaaaaaaagaaaagctaaaaaaaaaaaaaaggattccagaacactgctacgattgtctgaatgtttgttcctcaaataggattctagaatgctcctgctgtggtctgaatgtttgtccctcacataggattcctgaacactgctatgaggttctgagtgtttatacctcagataggattccaaaatactcttgctattttctgagagtttgtccctcccataggattccagaacattgctgctggggtctgaatgtttgtccctcacataggattccagaacactgctaggattgtctgaatgtttgtgtctcacatggaattccataacactgctattagggtctgaaagtttgtccttcacagaggtttccaggaaactgctacaattatctgaatgtccgttacgtaggattccagaacactgctatgagggtctgaatgtttgtctcttacataggattccagaacactgcagatttggtctgaatgtttatcactcacacaggaatccagaacactgctatgatggtctgaatgttcattcctcacataggattccagaacacagctacaaccgtcttaatgtttgtccctcacaggggattccagaacactcctgctgcagtctgaatgtttctaactcacacaggattccagaacactgctacgagggtctgaatgtttgtccctcacacttaatagcagaacactgatacaagggtctgaataattgtccctagcaaaggattccagagcactgttactgtggtctgaatgtttgtccctcacataggattccagaacactgctgctgggttctgaatgtatctccctcacctagaattccagaacgttgagacgaggttctgaatgtttgtccataacataggattccagaacactgctacaattgtctcaatgtttctcactcacatggcataccagaacactgcggcgagggtctgaatgttttccctcatatacgattccagaacactcatgctgtggtctgaatgtttgtcccttgcataggattcctgaacaatgctgcgagagtctgaatgtttatccctcacataggattccaaaacactcctgctgtagtctcaatgtttgcccctcacataggattccagaacaatcctgctgtggtctgaatgtttgtccctcacatagggctccagaacactcctgctgggttctaagcgtttctccctcaccttaaattcctcaacactgtgatgagggtctgaatgtttgtccataaaataggattcctgaacactcccgctgttgtttgaatgtttgttcctcccttaggactccagaaaactgctgctgggttctgaatggttgtccctcacacaggtttccagaacactgttacgagggtctgaatgtccctcacataggattccagaacactgttgagaagttctaaatgtttgtctgtcatataggattccagagaacagctacgagggtctgaatgtttgttcctcacagaggattccagaagagtcctgctttggtgtgaatgtttgtgcctcacacaggaattcagaacacggctatgaggttgtgaatgtttgtccctcacacacaattccagaatgctgctatgagggtctgaatgattgtccctcacataggattccagaacactgctgctgggttgcgagtgtgtctccctcacatagaattccagaacactgcgaagaagttctgaatatttgtccataacataggattccagaacactcctgcagttgtttgaatttttgtccctcccataggattccagaacactactgctggggtgtgagtgtatgtccctcacttaggattccagaacactgcaaagattctcttaaagattgtccctcacataggtttccggaacactgctatgagagtctgaatgtttgtccctcacacaggattccataatactcctgctgtgttctgaatatttgtacgtcacataggattcctgaacactactacgagattctgaatgtttgttgctcacataggattccaaaatgtccctgctgtgttctgagtgtttgtccctcacatagggtcactgctgctgggttctcagtgtttctcactcacatagaattccagaacactgcaaagaggttctgaatgtttttctgtaacatagtattccagaacactctcgctgttttttgaatgtttgtccctcacataggattccagaacacttctgctggtgtctgaaagtttgtccctcacacaggattccagaacactgctacgagggtctgaatgtttttccctcacaaagggttccagaacaaagctgttggagtcataatgtttgtctgtcacacaggattctagaacactgctacgaggttatgaatgtttgttcctcaaagggtttttcagaacactcctgttgttgtctgaatgtgtgtccctcacacaggattccagaacactgctacgaggttctgaatgtttctcccttacatagaattccagaacactgctaccaatgtctgaatgtttgtctctcacataggattccagaacactgctacgattgtctgaaagtttgtcgctcacataggattccagaacactgctacgattgtctgaaagtttgtccctcacataggattccagaacgctgctatgagggtctgaatgtttgtccctcatgcagagtaccagaacactgcttcgagggtctgaatgattgtccctcacataggattccagaacacggctgctggggtctcaatgtttgtgccacacataggattccagaatacggctgctggggtccacttgtaagtccgtcacaatggattccagaacacagctgctgggttctgagtgtttctccctcacttggaatttcagaacactgatatgagggtctgaaagtttttctgttacttaggactccagggctttccctctgttgtttgaatgtttgtccctcacagaggattccagaaaaatgctacgattgtatgaatgtttgtcccccacatatgattaaagaacactgcgaagagggtctgaatgtttgtctgaaacataggtttcccaaacagtttcgctgttgtttgactgtttttccctcacataggattccagaaaaatgctacgattgtatgaatgctggtccctcacataggattccagaacagtgctacgagggtctgaatatttgtccctcacatgggattccagaacacttctgctgtgttctgaatgtttggccctcagaaaggattcctgaactctgctacgacagtatgaatgtttgtccctcacatcagattccaaaacactcctactgtgttctgagtgtttgtccctcacatagaattctagaacagtcctgctattgtctgaatgtttgtcacacacacagggttgctgataactgctgctgagttctgaatgtttctccctaacatagaactctagaacactgtgacgaggttcggaatgtttgtcggtaacataggattcaaaaacactcatgctgttgtttgaatgtttgtccctcaagtaggattccagaacactgcttctggggactacatgtatgtctgtcacataggattccagaacactgctgttgggttctgtgtgtttctccctcacatagaattccagaacactgcgatgagggtatgaatgttgttcataacataggactccagaaaactcacgctcttctttgaatgtttgtccctcacgttggattccagaacactgctgctggggtctcaaagtttgtccctaacataggattccagaacactgctacgattgtctgaatattttgccttcacataatattccagaacactgctacgagggtctgaatgtttgtccctcaaataggattccagaatgctgctgctgggttctaaatgtttgtcggtcacataggattccagaacactgctgctggggtctgaatgtttgtccctcacatattattccagaacactgctgggttctaaatgtttgttggtcacatcagattccagaacactgctgctggggtgtgaatgtttatccctcacataggattccagaacacagttgctggggtctacatgtatgccagtcacatgggattccagaacactgctgctgggttcacagtgtttctccctcacatagaattccagataattgagacaatattctgaatgtttgaccataacataggattccagaacattcccgctcttgtttgaatgtttgtccctcacatagcattgcagaacactgctgctggggtctgaatgtttgtctctcacataggattccagtacactgctacgattgtcagaatgtttatccctcacctaggattacagaacactgctatgatgctctgaaagtttgtccctcacataggattccagaacactgctgctgaggtataaatgtttgtccatcacatgggattccagaacaaagctacgagtgtctgaatgttcctcacagcagattccataacactcctgctgtggtctcaatgtgtgtccctcacaaaggatttcagaacacggctaagagggtatgaatgtttgtccctcatacagaattccagaacactgctacgagggtctgaatgctggtccctcacataggacaccagaacactgctacggttgtctgaatgtttgtcccttccataggattcctgaacactgcttcgagggtctgaatgtttgtccctcacattgcattccaaaacactcctgttgtgttctgtgagtttgaccctcacataggattccagaacaatcctgctgtggtgtgaatgcttgtccctcacatatggttccagaacactgttgctgggttctgagtgtttgtccctcacaagggattccagaacactgctacgagggtgtgaatgtttgtcccacacaaaggattccagaacactgctactggggtctaaatgtttgtccgtcacatagcattcctgaacaatgttacaagaatctgaatgtttgtacctcacataggattcctgaaccactgctacgagggtctgaatgtttgtccctcacatagaattccaaaatactcctgctgtgttctgagtgtttgtccctcacatagcattccagaacactgcagctagggtctaaatgtccgtcacataggattctggaaaactactatgaggttctgaatgtttgtctctcacacagaattccagaacactgctacgagtttctgaatgacagtccctcacataggattccagaatactgctgctggggtctgaatgcttgtccctcacataggattccagaactctgctgctggggtgtacatgtatgtccgtcacataggattccagaacactgctgctgggttctgagtgtttctcactcgcataggattccagaacactgctacaagtgtctgaatgtttgtctgtcacattggattccaaaacactcctgctgtgttctgagtgtttgttcctcacataagattgcagaacactcctgctgtggccggaaagtttgtccctcacataagattccagaacactgctgctggaatctgaatatttgtccctcaagtaggtttctagaacaatgctactattgtttgaatgtttgtccctcacatgggattccagaacgctcctgctgtggtctgaaagtttgtccctcacataggattcctgaacactgctacgagtgcctgcatgtttgtccctcacatcagattccaatacattcctgctgtgttctgagtatttctccctcacatatgattctagagcaatcctgctgtgatctgaatgtttgtccctcacatagggatccagaacactgttgctgggttcttaatgtttctccctaaagtagaactccagaacactgcctcgagggtgtgaatgcttgtccgtaacacaggattccagaacactctaactgttgtttgaatgtttgtccctcaaataggattccagaacagtgctgctggggtctacatgcatgtccgtcagagaggataccagaacactgatgctcggttctgagtgtttctccctcacatcgaattctagcacactgtgaccagtttctgaatgtttttctgtaacatgggattctagaacactcccgctgttatttgaatgtttgtccctcacataggattccagaacactgctatgagtgtctgaatgtttgtccctcacttaagattccagaacactgctatgagggtctgaatgtttttccctcacataggaatccagaacaccgttacgagggtcggattgttcgttcctctcaggggattcctgaacactcctgctgtggtctgaatgattgtctgtcaaacaggattccaggacactgctacgagggtctgaatgtttgtccctcacacagaattccagaacactgctacgtgggtctgaatgattgtccctcacgtaggattccagaacactgccatgagggtcttaatgtttgctcctcacttaggactccagaacattcctgctgtggtctgaatgtttctcccccacataggattcctgaacactgctatgagggtctggatgtttgtccctcacataggattccaaaacattcctgctgtgttccgagtgtttgtccctcacatacgattccagaacaatcctgctgtggtccgaatgtttgtccctcacatgcggttccagagcacagctgctgggttctgagtgtttctccctcacatagaattccagaacactgcgacgagtttctgaacgtttgtccataacattggattccaaaacactcttgctgttgtttgaatgtttgtccgtcacacaggattccagaatactgctgctggggtctgaatgtttgtcccttacgaaagattctagaacactgctatgattgtctgaatgtttgtctctaatacagggtcccagaacactgtgacgagtgtctgaatgtttgtccataatataggtttccagaacacagctgctgttgtttgtttttccctcacaggattccagaacaatactgcaattgtatgagcgtttgtccctcacattggattccagaacactgcttcgaggttctgaatgtttgtccctcacactgaattacagaacacagctggtggggtggaaatgtttgtccgtcacataggattccaggacagtgccacgagggtctgaaagtttgttcctcacaggggattccagatcactcccgatgtgtctgaatgtttgtccctcacacaggattgcataacactgctatgatggtctgaatgattgtcactcaagcagaattccagaacactgctactaggtctgaatgactttccctcacataggattccagaacattgctgctggtttctgaatgtttgtccttcacataagattccagaacactgctgctggtgtctacatgtatgtctgtcacatagaattccagaacactgctgctgggttctgagcatttctccctcatgcagaattccagaacactacaacgaggttctgaatgtttgcccataacacaggattccagaacactcccgctgttgtttgaatgtttgtcactcacataggattccagaacactaacacgagggtctgaatgtttgttcctcacataggattccagaacactgctacaagggtttgaatgtttgttcttcgttggggattccagaacactcctgctctggtatgaatgtttatccctcacatagaattccagaacactgctatgagggtctgaattttttgtccctcacacagaattccccaacactgctatgagggtctgaataattgccctaccatagggttccagaacactgctgctggggtccaaattattgtccctcagataggattccagaacatgctgatggggtctacatgtattgccgtcacataggattccagaacactgctgctagattctgcattttgctccctcacatagaattccagaagagtgcgacgagggtctgaatgttttttcatatcataggattccagaacactcctgctgttgtttgaatgtttgttcctcacacaggattccacaacacagctaaaaatgtctgaaagtttgtccctcagataggattccagaacactgcggctgtggtctgaatgtttgtccctcacataggattccagaacactgctatgattgtctgaatgtttgtccctcacatagcattccagaccactgctacaagggtctaaaggcttgttcctcacaaaggattccagagcacacctgctgtggtctgattgtttgttcctcacataggattcctgaacactgctgctagggtctgaatgttggccttcacataggattccagaaccctgatacgattgtctgaatgtttgtccctcacacagcactacagaacactgctacgagggtctgaatgtttgttcctcacatgggattccagaacactgctatgattgtctgaatgtttgttcctcacataggtttccagaaaacttctgctatggtctgaaagtttatccctcacataggattccagaacactgctacgagggtctgaatgtttgtcccttcacataggattacagaacgctgctgctgttgtccaaacatctctctgtcacatagggttccagaacactgcaacatgtgtctgaatgttttccctcacataggattccagaacactctcattgttgtttgaatgtttgttcctcacataggattccagaacactgctgctggggtctgaatgattgttcctcacataggattccagaacactgctgctgggttctgagtgtttctccctcacgtagatttccagaaaacagggacgagggtctgaatgtttgtccataacagaggatttcaggacactctcgctgttgtttgaaagtttgtccctctctaacggggacaaattttgtgtctctatttccttcagttatgctctgattttagttatttcttgccttctgctagcttttgaatgtgtttgctcttgcttttctagttcttttaattgtgatgttagggtgtcaatcttggatctttcctgcattctcttgtgggcatttagtgctataaatttccctctacacactgctttaaatgtgtcccagagattctggtatgttgtgtctttgttctcgttggtttcaaagaacatctttatttctgccttcatttcgttatgtacccagtagtcattcaggaggaggtttttcaatttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgttgaaaaaaatgtgtattctgttgatttggggtggagagttctgtagatgtctattatgtctgcttggtgcagagctgagttcaattcctgggtatccttgttaattttctgtctcgttgatttgtccaatgttgagagtggggtgttaaagtctcccattattattgtgtgggagtctaagtctctttgtaggtcactcaggacttgctttatgaatctgggtgctcctgtattggatgcatatatatttaggatagtgagctcttcttgttgaattgatccctttaccattatgtaatggccttctttgtctcttttgaactttgttggtttaaagtctgttttatcagagactaggattgcaaaccctgccttttttcgttttccattttcttggtagatcttcctccatccctttattttgagcctaaaccctagaaggaaacctggtcaataccattcaggatatagtcatgggcaaggacttcatgtcttaaacaccaaaagtaatggcaacaaaaaccaaaattgggccgggcgcggtggctcacgcctgtaatcc

SEQ ID NO: 1991 - DNA, 2008 bp, Homo sapiens
ccaattttggtttttgttgccattacttttggtgtttaagacatgaagtccttgcccatgactatatcctgaatggtattgaccaggtttccttctagggtttaggctcaaaataaagggatggaggaagatctaccaagaaaatggaaaacgaaaaaaggcagggtttgcaatcctagtctctgataaaacagactttaaaccaacaaagttcaaaagagacaaagaaggccattacataatggtaaagggatcaattcaacaagaagagctcactatcctaaatatatatgcatccaatacaggagcacccagattcataaagcaagtcctgagtgacctacaaagagacttagactcccacacaataataatgggagactttaacaccccactctcaacattggacaaatcaacgagacagaaaattaacaaggatacccaggaattgaactcagctctgcaccaagcagacataatagacatctacagaactctccaccccaaatcaacagaatacacatttttttcaacaccacaccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccgctcaactacatggaaattgaaaaacctcctcctgaatgactactgggtacataacgaaatgaaggcagaaataaagatgttctttgaaaccaacgagaacaaagacacaacataccagaatctctgggacacatttaaagcagtgtgtagagggaaatttatagcactaaatgcccacaagagaatgcaggaaagatccaagattgacaccctaacatcacaattaaaagaactagaaaagcaagagcaaacacattcaaaagctagcagaaggcaagaaataactaaaatcagagcataactgaaggaaatagagacacaaaatttgtccccgttagagagggacaaactttcaaacaacagcgagagtgtcctgaaatcctctgttatggacaaacattcagaccctcgtccctgttttctggaaatctacgtgagggagaaacactcagaacccagcagcagtgttctggaatcctatgtgaggaacaatcattcagaccccagcagcagtgttctggaatcctatgtgaggaacaaacattcaaacaacaatgagagtgttctggaatcctatgtgagggaaaacattcagacacatgttgcagtgttctggaaccctatgtgacagagagatgtttggacaacagcagcagcgttctgtaatcctatgtgaagggacaaacattcagaccctcgtagcagtgttctggaatcctatgtgagggataaactttcagaccatagcagaagttttctggaaacctatgtgaggaacaaacattcagacaatcatagcagtgttctggaatcccatgtgaggaacaaacattcagaccctcgtagcagtgttctgtagtgctgtgtgagggacaaacattcagacaatcgtatcagggttctggaatcctatgtgaaggccaacattcagaccctagcagcagtgttcaggaatcctatgtgaggaacaaacaatcagaccacagcaggtgtgctctggaatcctttgtgaggaacaagcctttagacccttgtagcagtggtctggaatgctatgtgagggacaaacattcagacaatcatagcagtgttctggaatcctatgtgagggacaaactttcagacatttttagctgtgttgtggaatcctgtgtgaggaacaaacattcaaacaacagcaggagtgttctggaatcctatgatatgaaaaaacattcagaccctcgtcgcactcttctggaattctatgtgagggagcaaaatgcagaatctagcagcagtgttctggaatcctatgtgacggcaatacatgtagaccccatca

SEQ ID NO: 1992 - DNA, 4981 bp, Homo sapiens
ctttaaagtctggtttaatagaagaaaacttggttctcctttctgcttctatgtttaatttcttgtgacatcccatgtcaggtagcctctgggaaagtccaattatacttgtgagagaataaaagtggaaaaggtaaacaaaaacctgtgtatttttatgaaaagacttttgaccttgcagagcccctggaagggactcagggacttctcagggttctctggctcatgtgttcacagagtagaggttaagtccgcaagagaaagcagtgattggctgtgggaggtcttgctgagaggtggtagagaagaggttggatgtgtagaaagtatggtcgttcttttcatttcttttccctttcctttggcctcttgttgctgggatctcctctttagatgatcgtatcataaattagaaatagcattaatgaacattcttgatactgcctaatgaaagtttttgttttgtcttcctgagtcttgatacatttcaagaagtcttctatctcatttatttttcccaccgaaatttggaatttaggaagagtcgatatagctatatttagatgatttatctccctgaagacattttgggatcatttatacatctctataaacaatgctctgatgttcctttattttgtttagagactgggtcttgccgtgttgtctggagcggagtggctcgatcgtagctcataatacacaatacaatcaaactcctgtgctcaaagtgatccttccactcagcctccacagtagctaggtctgcagatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaataaagcacaccaattaaaagtaaacactgtttaaacctacctcaatgaatttctaaagtgtcatacatttattatattctctacttgtaaaatattttgttgtgtgtattgccaagtatttcaggattttatgggtataatgtattctattaatttaactggaaaacttgtagttattcaacaaacaaactaaaagtgttggcagagatgtaattttaaagcacaatcccactcattcgttcagtgttacagctgctccttgtttgtttaataatagaactgatgagtagttaatttgagaggaaagctggtgcaggtgtagtgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacacactgcacacccattaggatggctgctatcaaaaaagaaaaaacaaaaaaatcaggggccaggcacgctggttcacacctgtaatcccagccctttgggatcacctgaggtcaggagtttgacagcagcctggccaacatggtgaaatctcatctgtaccaaaaaataaaataaaataaaacaaaaaacaacacacacacacacaattagtcgggcatgggggcacacatgtgtaatctcagctaattgagaggctgaggcacgagaatcgcttgaacctgggaggcggaggttgcagtgagccgagatcacgccactgcactgcagcctggagacagaaggagactcggcctcaaaacaaatcaaaacaaaaacacccagaaaataacaagtgctgacaaggatgtggaaaaattgtaactcttgtgcattgagggtgggtatgaaaaatagtacatcagctgtggaaaacataccattcctcaaaaatttagacatagaattaccatatgattcagtaatcccactcacatctataaatctctatatctgtatctttatctacctatctctatcttcaaaagaatggaaagcagttactcagatacttgtacacctgtgttctctccccacccccccttttttttttaataaatgggctctcactgtgtttcccaggccggagtgcaggggctgtttataggcacgaccccctgctgcggggctgtccaccggcatgaacccctgctgcgaggctgtttataggcatgatccccctgctgcggagctgtccacaggcacggacccctgctgcagggctgtccacaggcacgacccactgctgcggggctgtccacaggcacgaccccctgctgcggggctgtccacaggcatgaccccctgctgaggggctgtccacaggcacgatttccctgctgcggggctgtccacaggcaggatctccctgctgcggggctgtccacaggcatgaccccctgctggtcaaactgggagttgtgccctgctttgtctccaatccatgccggttcgcccctccttaggcaacctggtagtcccttatcccatgaggtcactgtactaatgtctaatttcgtgcagatgtctgatcaacactgcacactgcagctcaggacccctgggctcaagtgatctgagtagcaggaactacaggcgcatgccaccacacctgcctgctacacctgtgttcattgcagcattacagcagccttatttacaggaaccacaaaatggaaacaacctaaaaagtctattgagggatagatggataaacaaaatgtggtatagatgtaaaatggaatattagtgatctttgaaaagggagggaattctgatacttgctaccacatagataaaaacattatgctaagtgagacatcaaacaaagactacctgattccatctatatgaagaacctggaacaggcaaattaatagagacacaaagtagaatagaggttttcaggaatggcaggaggtggaaatgggcgaggttagtgtctaatgggcacagagttcctatctgggatgatagaatgtttcggaaatggatagtggtgatgactgcacagcattgtgaatgtagctaatgacgttgaattctttaccagaaaacaaaaacaaaaacagaaacacattgcttaagcttctcagtccgacaggtgacgtgcttggtgtgagctggggcctaagcccaggctgccctcgccagagctgcttcaagacccctcttggttgtacttaggcctgattgctctggagagtcccatacatgaaagccagctctggttctatctcttctcactccagtcctccctgcccccaccatcccccagctgggcattatgagaaaagcaagatgactatgagttttttgattatttatatgaccaaataatctcaaggactattgctaactaacccatgggactcccactaccttcatgaggctcggatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctcccttctattcctgttaataaaggagcatcagctaagtgaatatggtgatttgcatacacttacattgattcagaaattgtgtttaattccacacaagaaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtgttggaccacacgggtttgggccacagcccaggaagacacaatcctgaacgtcataatcccaaatgttgaagtcccataagatctaaatctgtacagtctaaaatcctgaaaattacaatcctaaaaaaacaaaattctcaaaatacaattctggaaaaaaattattaacacattctttaagaagcatttattgggcagcacatggtggctcatgcctttaatcccagcacctttggaggccgaggcgggtggatcacaaagtcaggagatggagaccatcctggctaacacggtgaaaccccatctttactaaaaatacaaaaaattagccaggcatcatgacgggtgccagtagtcccagctactcgggaggctgaggcaggagaatcgcttggacccaggaggtggaggttacagtgagccgcaatcgcaccactgcactccagcctgggcgacagagtgagactctgtctaacaacaaaaacaaaaaacatttatttatatttttaagatggaatttatttgagaaacttataaaaacacaacagaacccttcctaggccactttacacaatcaataggcaataataacatgcatatatttgcaagcgtaaaactcaggtatgctaacgatagtctcacgggtataatggtaatgagcagatgagttgtatttgtaaagaaatgggtcaaaaagcaaaatgtataaaagcgtggttggtaactgggtgaactcagctttataacttaggtcatctggaatactgtgacagacaacctaagtcttttgaccagattcatcaaaagctgggatgggt

SEQ ID NO: 1993 - DNA, 4413 bp, Homo sapiens
tgaagaaatacctgagactgggtaatttgtaaggaaaagagatttaattggctcatagctctgcaggctgtacgggaagcatggtgacggcatctgcctggcgcctgtggagtctccagggagcttttactcatgatggaaggccaagagggagtaggtacttcacatggccagagcaggagcaagagagaatgggagtagggatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaataaagcacaccaattaaaagtaaacactgtttaaacctacctcaatgaatttctaaagtgtcatacatttattatattctctacttgtaaaatattttgttgtgtgtattgccaagtatttcaggattttatgggtataatgtattctattaatttaactggaaaacttgtagttattcaacaaacaaactaaaagtgttggcagagatgtaattttaaagcacaatcccactcattcgttcagtgttacagctgctccttgtttgtttaataatagaactgatgagtagttaatttgagaggaaagctggtgcaggtgtagtgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacacactgcacacccattaggatggctgctatcaaaaaagaaaaaacaaaaaaatcaggggccaggcacgctggttcacacctgtaatcccagccctttgggatcacctgaggtcaggagtttgacagcagcctggccaacatggtgaaatctcatctgtaccaaaaaataaaataaaataaaacaaaaaacaacacacacacacacaattagtcgggcatgggggcacacatgtgtaatctcagctaattgagaggctgaggcacgagaatcgcttgaacctgggaggcggaggttgcagtgagccgagatcacgccactgcactgcagcctggagacagaaggagactcggcctcaaaacaaatcaaaacaaaaacacccagaaaataacaagtgctgacaaggatgtggaaaaattgtaactcttgtgcattgagggtgggtatgaaaaatagtacatcagctgtggaaaacataccattcctcaaaaatttagacatagaattaccatatgattcagtaatcccactcacatctataaatctctatatctgtatctttatctacctatctctatcttcaaaagaatggaaagcagttactcagatacttgtacacctgtgttctctccccacccccccttttttttttaataaatgggctctcactgtgtttcccaggccggagtgcaggggctgtttataggcacgaccccctgctgcggggctgtccaccggcatgaacccctgctgcgaggctgtttataggcatgatccccctgctgcggagctgtccacaggcacggacccctgctgcagggctgtccacaggcacgacccactgctgcggggctgtccacaggcacgaccccctgctgcggggctgtccacaggcatgaccccctgctgaggggctgtccacaggcacgatttccctgctgcggggctgtccacaggcaggatctccctgctgcggggctgtccacaggcatgaccccctgctggtcaaactgggagttgtgccctgctttgtctccaatccatgccggttcgcccctccttaggcaacctggtagtcccttatcccatgaggtcactgtactaatgtctaatttcgtgcagatgtctgatcaacactgcacactgcagctcaggacccctgggctcaagtgatctgagtagcaggaactacaggcgcatgccaccacacctgcctgctacacctgtgttcattgcagcattacagcagccttatttacaggaaccacaaaatggaaacaacctaaaaagtctattgagggatagatggataaacaaaatgtggtatagatgtaaaatggaatattagtgatctttgaaaagggagggaattctgatacttgctaccacatagataaaaacattatgctaagtgagacatcaaacaaagactacctgattccatctatatgaagaacctggaacaggcaaattaatagagacacaaagtagaatagaggttttcaggaatggcaggaggtggaaatgggcgaggttagtgtctaatgggcacagagttcctatctgggatgatagaatgtttcggaaatggatagtggtgatgactgcacagcattgtgaatgtagctaatgacgttgaattctttaccagaaaacaaaaacaaaaacagaaacacattgcttaagcttctcagtccgacaggtgacgtgcttggtgtgagctggggcctaagcccaggctgccctcgccagagctgcttcaagacccctcttggttgtacttaggcctgattgctctggagagtcccatacatgaaagccagctctggttctatctcttctcactccagtcctccctgcccccaccatcccccagctgggcattatgagaaaagcaagatgactatgagttttttgattatttatatgaccaaataatctcaaggactattgctaactaacccatgggactcccactaccttcatgaggctcggatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctcccttctattcctgttaataaaggagcatcagctaagtgaatatggtgatttgcatacacttacattgattcagaaattgtgtttaattccacacaagaaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtgttggaccacacgggtttgggccacagcccaggaagacacaatcctgaacgtcataatcccaaatgttgaagtcccataagatctaaatctgtacagtctaaaatcctgaaaattacaatcctaaaaaaacaaaattctcaaaatacaattctggaaaaaaattattaacacattctttaagaagcatttattgggcagcacatggtggctcatgcctttaatcccagcacctttggaggccgaggcgggtggatcacaaagtcaggagatggagaccatcctggctaacacggtgaaaccccatctttactaaaaatacaaaaaattagccaggcatcatgacgggtgccagtagtcccagctactcgggaggctgaggcaggagaatcgcttggacccaggaggtggaggttacagtgagccgcaatcgcaccactgcactccagcctgggcgacagagtgagactctgtctaacaacaaaaacaaaaaacatttatttatatttttaagatggaatttatttgagaaacttataaaaacacaacagaacccttcctaggccactttacacaatcaataggcaataataacatgcatatatttgcaagcgtaaaactcaggtatgctaacgatagtctcacgggtataatggtaatgagcagatgagttgtatttgtaaagaaatgggtcaaaaagcaaaatgtataaaagcgtggttggtaactgggtgaactcagctttataacttaggtcatctggaatactgtgacagacaacctaagtcttttgaccagattcatcaaaagctgggatgggt

SEQ ID NO: 1994 - DNA, 4672 bp, Homo sapiens
cgtgcctcccagaggtggggaaagcccgcccgaggcgccggtgctgacggtggcggggctgccgggcacgctgtggaactgcctcccgctagagctgcgggctggcgacggtcccgtgggggcgggaagcggctcagggtgccctcgccggcctgcggcggcgcgtctgggagcgcaggccactcgtgcgcgggtcactcggggctgtgcctcgcgcgactgtgtgtgcaggaaacaaggaggaaataccctaaaatggaatgaagcgccatgttgagggccgcggatgtcgcgagtgctgtgggaatgtgggctgaggtggagagttatggtggaggaagctagtcctgtctgatggaggaaacagggcagaggcgtggagggagacgcacagtgctggtgtgaggagccgcgagcaggccaggcctgtaaagcagcgtgatgggaaccaggatagagaagatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaataaagcacaccaattaaaagtaaacactgtttaaacctacctcaatgaatttctaaagtgtcatacatttattatattctctacttgtaaaatattttgttgtgtgtattgccaagtatttcaggattttatgggtataatgtattctattaatttaactggaaaacttgtagttattcaacaaacaaactaaaagtgttggcagagatgtaattttaaagcacaatcccactcattcgttcagtgttacagctgctccttgtttgtttaataatagaactgatgagtagttaatttgagaggaaagctggtgcaggtgtagtgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacacactgcacacccattaggatggctgctatcaaaaaagaaaaaacaaaaaaatcaggggccaggcacgctggttcacacctgtaatcccagccctttgggatcacctgaggtcaggagtttgacagcagcctggccaacatggtgaaatctcatctgtaccaaaaaataaaataaaataaaacaaaaaacaacacacacacacacaattagtcgggcatgggggcacacatgtgtaatctcagctaattgagaggctgaggcacgagaatcgcttgaacctgggaggcggaggttgcagtgagccgagatcacgccactgcactgcagcctggagacagaaggagactcggcctcaaaacaaatcaaaacaaaaacacccagaaaataacaagtgctgacaaggatgtggaaaaattgtaactcttgtgcattgagggtgggtatgaaaaatagtacatcagctgtggaaaacataccattcctcaaaaatttagacatagaattaccatatgattcagtaatcccactcacatctataaatctctatatctgtatctttatctacctatctctatcttcaaaagaatggaaagcagttactcagatacttgtacacctgtgttctctccccacccccccttttttttttaataaatgggctctcactgtgtttcccaggccggagtgcaggggctgtttataggcacgaccccctgctgcggggctgtccaccggcatgaacccctgctgcgaggctgtttataggcatgatccccctgctgcggagctgtccacaggcacggacccctgctgcagggctgtccacaggcacgacccactgctgcggggctgtccacaggcacgaccccctgctgcggggctgtccacaggcatgaccccctgctgaggggctgtccacaggcacgatttccctgctgcggggctgtccacaggcaggatctccctgctgcggggctgtccacaggcatgaccccctgctggtcaaactgggagttgtgccctgctttgtctccaatccatgccggttcgcccctccttaggcaacctggtagtcccttatcccatgaggtcactgtactaatgtctaatttcgtgcagatgtctgatcaacactgcacactgcagctcaggacccctgggctcaagtgatctgagtagcaggaactacaggcgcatgccaccacacctgcctgctacacctgtgttcattgcagcattacagcagccttatttacaggaaccacaaaatggaaacaacctaaaaagtctattgagggatagatggataaacaaaatgtggtatagatgtaaaatggaatattagtgatctttgaaaagggagggaattctgatacttgctaccacatagataaaaacattatgctaagtgagacatcaaacaaagactacctgattccatctatatgaagaacctggaacaggcaaattaatagagacacaaagtagaatagaggttttcaggaatggcaggaggtggaaatgggcgaggttagtgtctaatgggcacagagttcctatctgggatgatagaatgtttcggaaatggatagtggtgatgactgcacagcattgtgaatgtagctaatgacgttgaattctttaccagaaaacaaaaacaaaaacagaaacacattgcttaagcttctcagtccgacaggtgacgtgcttggtgtgagctggggcctaagcccaggctgccctcgccagagctgcttcaagacccctcttggttgtacttaggcctgattgctctggagagtcccatacatgaaagccagctctggttctatctcttctcactccagtcctccctgcccccaccatcccccagctgggcattatgagaaaagcaagatgactatgagttttttgattatttatatgaccaaataatctcaaggactattgctaactaacccatgggactcccactaccttcatgaggctcggatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctcccttctattcctgttaataaaggagcatcagctaagtgaatatggtgatttgcatacacttacattgattcagaaattgtgtttaattccacacaagaaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtgttggaccacacgggtttgggccacagcccaggaagacacaatcctgaacgtcataatcccaaatgttgaagtcccataagatctaaatctgtacagtctaaaatcctgaaaattacaatcctaaaaaaacaaaattctcaaaatacaattctggaaaaaaattattaacacattctttaagaagcatttattgggcagcacatggtggctcatgcctttaatcccagcacctttggaggccgaggcgggtggatcacaaagtcaggagatggagaccatcctggctaacacggtgaaaccccatctttactaaaaatacaaaaaattagccaggcatcatgacgggtgccagtagtcccagctactcgggaggctgaggcaggagaatcgcttggacccaggaggtggaggttacagtgagccgcaatcgcaccactgcactccagcctgggcgacagagtgagactctgtctaacaacaaaaacaaaaaacatttatttatatttttaagatggaatttatttgagaaacttataaaaacacaacagaacccttcctaggccactttacacaatcaataggcaataataacatgcatatatttgcaagcgtaaaactcaggtatgctaacgatagtctcacgggtataatggtaatgagcagatgagttgtatttgtaaagaaatgggtcaaaaagcaaaatgtataaaagcgtggttggtaactgggtgaactcagctttataacttaggtcatctggaatactgtgacagacaacctaagtcttttgaccagattcatcaaaagctgggatgggt

SEQ ID NO: 1995 - DNA, 5442 bp, Homo sapiens
atcagactaacgcagacccaccaggcagaggcctggagagatgcctcaagggacccaaactcgtgggtacggggtcacgggtcacccgcccgtctatcctgtttccagggtcgtccgcgcaggaggctgcccctctctgcacaggcgccaggaagggcggtccggcctccatccagcccagacagggtcagagcgaagcctgggaggccacgaagccggctctccgcatcacggcttccaccggattcgcgggggtggagtgcgtccgaaaagaactgaggaggctcccgccggagctgcaggacccagctcttcacctcggttcccttgagcacaagcttggtagacttcacataagaatactaggccatggctccgggagacttctgcgcggagaggctgaagccggctcaggaagagtatgtgacctggagcagcaccagggcggggaggaacagaagtggaggcgaagtaaacactccccgacagcgtaggtctgtccagaacccgcctccgtcttcacccaaacactgaatggctgagatttccacttccgggtttctgctggggagctatggcggctgcagagggccgaaaggtgtctgcgcgcatctgctccctggcgccctctcgaggagcccctgaggattcgtgcctcccagaggtggggaaagcccgcccgaggcgccggtgctgacggtggcggggctgccgggcacgctgtggaactgcctcccgctagagctgcgggctggcgacggtcccgtgggggcgggaagcggctcagggtgccctcgccggcctgcggcggcgcgtctgggagcgcaggccactcgtgcgcgggtcactcggggctgtgcctcgcgcgactgtgtgtgcaggaaacaaggaggaaataccctaaaatggaatgaagcgccatgttgagggccgcggatgtcgcgagtgctgtgggaatgtgggctgaggtggagagttatggtggaggaagctagtcctgtctgatggaggaaacagggcagaggcgtggagggagacgcacagtgctggtgtgaggagccgcgagcaggccaggcctgtaaagcagcgtgatgggaaccaggatagagaaggcaagtcggggtcctgtggtcgctgaagaatttgaatgaaatcagtaaacaggtgagagggatccatcgcaagagcatgggatgaaacgagcagtagtccacggtgattcctctgcagcgatactgcatagtggatggattagtttgtggttcctgggatcttctgtgtattctgttgaagctcaataatcacattactgcggacctccaaaattttacaaaggactgcacagtgagtattcagccgataaactaaaccacagcttaatactgtgagatgaaataaagcacaccaattaaaagtaaacactgtttaaacctacctcaatgaatttctaaagtgtcatacatttattatattctctacttgtaaaatattttgttgtgtgtattgccaagtatttcaggattttatgggtataatgtattctattaatttaactggaaaacttgtagttattcaacaaacaaactaaaagtgttggcagagatgtaattttaaagcacaatcccactcattcgttcagtgttacagctgctccttgtttgtttaataatagaactgatgagtagttaatttgagaggaaagctggtgcaggtgtagtgctatttggatgtcatggaggacacatgtgacatctgcagctagctatatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacacacacacacacacacacacacacacacacacactgcacacccattaggatggctgctatcaaaaaagaaaaaacaaaaaaatcaggggccaggcacgctggttcacacctgtaatcccagccctttgggatcacctgaggtcaggagtttgacagcagcctggccaacatggtgaaatctcatctgtaccaaaaaataaaataaaataaaacaaaaaacaacacacacacacacaattagtcgggcatgggggcacacatgtgtaatctcagctaattgagaggctgaggcacgagaatcgcttgaacctgggaggcggaggttgcagtgagccgagatcacgccactgcactgcagcctggagacagaaggagactcggcctcaaaacaaatcaaaacaaaaacacccagaaaataacaagtgctgacaaggatgtggaaaaattgtaactcttgtgcattgagggtgggtatgaaaaatagtacatcagctgtggaaaacataccattcctcaaaaatttagacatagaattaccatatgattcagtaatcccactcacatctataaatctctatatctgtatctttatctacctatctctatcttcaaaagaatggaaagcagttactcagatacttgtacacctgtgttctctccccacccccccttttttttttaataaatgggctctcactgtgtttcccaggccggagtgcaggggctgtttataggcacgaccccctgctgcggggctgtccaccggcatgaacccctgctgcgaggctgtttataggcatgatccccctgctgcggagctgtccacaggcacggacccctgctgcagggctgtccacaggcacgacccactgctgcggggctgtccacaggcacgaccccctgctgcggggctgtccacaggcatgaccccctgctgaggggctgtccacaggcacgatttccctgctgcggggctgtccacaggcaggatctccctgctgcggggctgtccacaggcatgaccccctgctggtcaaactgggagttgtgccctgctttgtctccaatccatgccggttcgcccctccttaggcaacctggtagtcccttatcccatgaggtcactgtactaatgtctaatttcgtgcagatgtctgatcaacactgcacactgcagctcaggacccctgggctcaagtgatctgagtagcaggaactacaggcgcatgccaccacacctgcctgctacacctgtgttcattgcagcattacagcagccttatttacaggaaccacaaaatggaaacaacctaaaaagtctattgagggatagatggataaacaaaatgtggtatagatgtaaaatggaatattagtgatctttgaaaagggagggaattctgatacttgctaccacatagataaaaacattatgctaagtgagacatcaaacaaagactacctgattccatctatatgaagaacctggaacaggcaaattaatagagacacaaagtagaatagaggttttcaggaatggcaggaggtggaaatgggcgaggttagtgtctaatgggcacagagttcctatctgggatgatagaatgtttcggaaatggatagtggtgatgactgcacagcattgtgaatgtagctaatgacgttgaattctttaccagaaaacaaaaacaaaaacagaaacacattgcttaagcttctcagtccgacaggtgacgtgcttggtgtgagctggggcctaagcccaggctgccctcgccagagctgcttcaagacccctcttggttgtacttaggcctgattgctctggagagtcccatacatgaaagccagctctggttctatctcttctcactccagtcctccctgcccccaccatcccccagctgggcattatgagaaaagcaagatgactatgagttttttgattatttatatgaccaaataatctcaaggactattgctaactaacccatgggactcccactaccttcatgaggctcggatgaggtgaagggtccctaaaatcgtgccaactagtcaggaactcagttgtcaataatttctttatttgtgatacaagcaggcgtggggaaagagaaatgaacagacttggaagcttctccgaggccctagagaagacctctgggttccgaacaccagacaccaggagtaaggagggtagttgatgatttcccactctttctccagcccctgctcctctgtttctccccttcacccactgcagcttcctcaggtcctgggtcccgcgccatcatctcttcgaatgacctcccttctattcctgttaataaaggagcatcagctaagtgaatatggtgatttgcatacacttacattgattcagaaattgtgtttaattccacacaagaaaaagaatgtggatctttttcactgggaaaaaaagtcgccatgtatcatcttaatcatgttttcctgggatataatctatacgtgacgcccatttaagccttcattgcatctatgcacgtggtttgctttcctcttgtgtgaaatagtgttggaccacacgggtttgggccacagcccaggaagacacaatcctgaacgtcataatcccaaatgttgaagtcccataagatctaaatctgtacagtctaaaatcctgaaaattacaatcctaaaaaaacaaaattctcaaaatacaattctggaaaaaaattattaacacattctttaagaagcatttattgggcagcacatggtggctcatgcctttaatcccagcacctttggaggccgaggcgggtggatcacaaagtcaggagatggagaccatcctggctaacacggtgaaaccccatctttactaaaaatacaaaaaattagccaggcatcatgacgggtgccagtagtcccagctactcgggaggctgaggcaggagaatcgcttggacccaggaggtggaggttacagtgagccgcaatcgcaccactgcactccagcctgggcgacagagtgagactctgtctaacaacaaaaacaaaaaacatttatttatatttttaagatggaatttatttgagaaacttataaaaacacaacagaacccttcctaggccactttacacaatcaataggcaataataacatgcatatatttgcaagcgtaaaactcaggtatgctaacgatagtctcacgggtataatggtaatgagcagatgagttgtatttgtaaagaaatgggtcaaaaagcaaaatgtataaaagcgtggttggtaactgggtgaactcagctttataacttaggtcatctggaatactgtgacagacaacctaagtcttttgaccagattcatcaaaagctgggatgggt

SEQ ID NO: 1996 - DNA, 1780 bp, Homo sapiens
tgtgtgcagtgtgtgtggtgtctgggtggtgtctgtgtggggtgtgtgcatgtgtacatggtgtgtgtgcagtgtgtggtgtgtgtgtacgtgtgcacatggtgtgtgtgcagtgtgtgtggggtgtgtgcagtgtgtgtggtgtcttggttgtgtgtgcagtgtggtgtctgaggagtgtgtgtgtgcacgtgcatggtgtgtggtgtgtgtgcatgtgtacatggtgtgtgtgccgtgtgtgtggcttctgcatgtggggtgtgcattgtggtgtgtatgtgggtgtgtgcatgtgcacatggcatgtgtgtagtgtggtgtctgctgtgtgcagtgtgtggtgtctggggtgtgcatgtgcacatggcgtgtgtggtgtgtgtgtggtgtatggggtgtgtgtgtgcacatggtgtgtgtgtgcagtgtgtgtggtgtctggggtgcatgtgtgcacatggagtggtgtgcatagtgtgtgtgatgtctggggtgtgcatatgcacatggtgtgtgtgcagtgtgtgtggtgtctgtgtggggtgtgttcatgtgcacatggtgtgtgtgctgtgtgtggtgtatgtgtgtggggtgtgtgtgtgcacacggtgtgtgcagtgtgtttgtgtgcagtgtgagcatgtgcatatggtgtgtgtgcagtgtgtgtggtgtctgtggtgtgtgtgtgcacatggtgtgtatgtagtgtgtgtggtgtgtgtggggtgtgtgcacatagtgtgtgtgcagtgtgtgtggtgtctctgtgtggtgtgtgtgcagtgtgtggtgtctgtatggggtatatgcatgtgcacatggtgtgtgtgcagtaggtgtgtttgtggggtgtgggcagtgggtgtgaggggtgtgtgtgcatgtgcacatggtgtgtgtgctgtttgtgtggtgtctgtgtgtggggtgtgtgtgcatgtgcacacggtgtggtgtgtgcagtgtgtgtgttatgagtgactgcttctcttagcatgtggacatcagtcttccagaccagctttctccatgtgtctgggaacataagaaacaagtttctgcaataattgttacacagcttttccagagagggaccaaatctctgtcgtgagtgggtatctgcatcatttcgcaggagggaatgtgatgttctggcttggctcacaccctctgtgggtttaggcacaggttcctgctggatccctcactgtggccagagagggagggctctgcttcaccacagggcaccagaagaggactggtgtgcgggaagaccaggtaatcataatgctattaataatagcagtaatcatactgttttatacattgtatatgtcataaggattttaactttcatgtaacataactgctgtaaaattttccccagtttgttttgtgctatttacctggtgttaaaatgtataagaatttacattttaggtacgttaggtttattcctttttatatggtttctgtttgaaattttgattttagaagacattcattctcaaggtcataaaacacacacatctaattttcttttttctctctctttttttttatatttaatactggaattaacttttatgtaagatgtaggaccatgattcaattctgtcattttatattctcaaatcattacccaatattttaataccacaaatggaacaatcgctctgttttgtgggtttaaaatgttaccctgttactagataaaattacactcaatttctgtgtttttaattctcttttattaatgtgtttatttttg

SEQ ID NO: 1997 - DNA, 1514 bp, Homo sapiens
tgtgtgcagtgtgtgtggtgtctgggtggtgtctgtgtggggtgtgtgcatgtgtacatggtgtgtgtgcagtgtgtggtgtgtgtgtacgtgtgcacatggtgtgtgtgcagtgtgtgtggggtgtgtgcagtgtgtgtggtgtcttggttgtgtgtgcagtgtggtgtctgaggagtgtgtgtgtgcacgtgcatggtgtgtggtgtgtgtgcatgtgtacatggtgtgtgtgccgtgtgtgtggcttctgcatgtggggtgtgcattgtggtgtgtatgtgggtgtgtgcatgtgcacatggcatgtgtgtagtgtggtgtctgctgtgtgcagtgtgtggtgtctggggtgtgcatgtgcacatggcgtgtgtggtgtgtgtgtggtgtatggggtgtgtgtgtgcacatggtgtgtgtgtgcagtgtgtgtggtgtctggggtgcatgtgtgcacatggagtggtgtgcatagtgtgtgtgatgtctggggtgtgcatatgcacatggtgtgtgtgcagtgtgtgtggtgtctgtgtggggtgtgttcatgtgcacatggtgtgtgtgctgtgtgtgtgtttgtggggtgtgggcagtgggtgtgaggggtgtgtgtgcatgtgcacatggtgtgtgtgctgtttgtgtggtgtctgtgtgtggggtgtgtgtgcatgtgcacacggtgtggtgtgtgcagtgtgtgtgttatgagtgactgcttctcttagcatgtggacatcagtcttccagaccagctttctccatgtgtctgggaacataagaaacaagtttctgcaataattgttacacagcttttccagagagggaccaaatctctgtcgtgagtgggtatctgcatcatttcgcaggagggaatgtgatgttctggcttggctcacaccctctgtgggtttaggcacaggttcctgctggatccctcactgtggccagagagggagggctctgcttcaccacagggcaccagaagaggactggtgtgcgggaagaccaggtaatcataatgctattaataatagcagtaatcatactgttttatacattgtatatgtcataaggattttaactttcatgtaacataactgctgtaaaattttccccagtttgttttgtgctatttacctggtgttaaaatgtataagaatttacattttaggtacgttaggtttattcctttttatatggtttctgtttgaaattttgattttagaagacattcattctcaaggtcataaaacacacacatctaattttcttttttctctctctttttttttatatttaatactggaattaacttttatgtaagatgtaggaccatgattcaattctgtcattttatattctcaaatcattacccaatattttaataccacaaatggaacaatcgctctgttttgtgggtttaaaatgttaccctgttactagataaaattacactcaatttctgtgtttttaattctcttttattaatgtgtttatttttg

SEQ ID NO: 1998 - DNA, 4482 bp, Homo sapiens
cgagccgccgctttggtcacagtgaccgccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggcctctccccgcgtctctgcctgggtgttgtggccggttggcaatcgttttcccggcggttccggcttgggggtctgtgaaggcctgggcaacgtgggcatctgcgtcggagccgcaggggttttcattccctccccatccggagcagcctctttgctaggctagatccagacgaccgctccccaaccaaggacaacggcctcccaggcgctcattgtccacccgcaggagggtgcccgcagaccttccagaagatgcttctcacgcctcttgccctgccctctgccctcatggagaaatctagccacagctcgacgcagggacggagaaggaagccggcaaggggatggggcaagcctctctctcactcaaaggcagtatagaagtccaccacagaggcatatccagtatggtgcccaccacctcatcttggggctgggtgaagggcaagtggcactgcaggaaatagtagccttgttctctgtcctcaatttgttccaagattgcggcccacaccagtgcttgggcttgtgagaatggagggctctccaacagttcagaaacaagcagtctgccgcagaggtgagaagagcaaaagacacccccacctgtgcttttccatggaacatcaagtccctcagagtataatgtctgctgggttcttgcttccttatttttctgtgttcaaatttcttcttgtggtgctctagcacacttccgtctatatagatattggaattaacgattatttatccataactttgctttctctttctgagaataactagagtcaaatatctatagtcagtcatattgaagaaaaacctcagaaatatacttcttagtaactcaacacccaagagcaaatcataatggaaattataaaatatttttaattaaaaaatgtatactacattataaaatgtgtcattttagaggaaaatgtagaaccttaaattcttattttatgaggacaacaaattaatttttaaaatgttttgaatttattggtagaagttagaaatatcaacagaaataaaaggaaataataaatacatgcatagtgattaagaatacagggaaagaaaagtcaagaaatatggccaaaagtttgttagttgttgtaggagccatacaataacaaaactctggagaaatggcttgataaaattaagagaagaaacaagtatgccatctcaggaatcaaaataggaaataattatacatcaggtgtcaagaattttttttgttttttggaaaggatctgttggtaattattttaggtttttgggctatatggtttgttgcaactaatcaattctattgttgtggcataaattgacagtatgtcaatgaatgagcatgacagtgttccagtaatactttatttataaatactgtctggcttatttgccacagtttattgagttttgttataaataatacaaatatcaagaaggtaaattagtgtagtatgaaaacgtttaattcaataaatttggaaatatatgtaaaatgtgtacaattacttgaaacatgcatttttccaaaagtaacctaaagtgaaaagaaaaatctgaattgtgctacaacaaatgcatgtaatcagtagtcagaaatcatatcataaagataatttcaagccatgatgactttactggcaagttgtttcaaacatgaaacaaaacaataattccaatcttacatacaattctttctgagcatgaaacaggaaagaacatactctattttattttattatgctattatgactctgatattataacctgacaaggatagtaaagggaaagtaaattaaacaccaatgtaatttatgaaaatattgaaggaaaacttaaaaaagttccatgcagaaataagcaatgcattaaaatgtaagacatcacagccaatgtttattctaagaaaccctgggaagcaataatggcctcatgtaaaggtatcaattaatatgatacaccacaacaaataacttaacaatattataagcatatttaattttattttcttaaaaagtcatacattttaacaacccgaaattaaaagagaatctagtttaactgataacatttgttttcaaaagttctattgaaattataacacttaacaatggaatgttcaaatatttcctttgtgattgggaacaaaataaacatagatggtacaagcaattttatttatccttttgcaggtcttagacactgggataggattgtaaatattaaaaaaataagaattatgaaagagaaaacagattactatgttaccgatgacactaagtacacagaaaattcaaaatgattctaagatacattatactaatgaatatgagcttttagcaagatgctttgacacaaatatattatgcaatattgaaatgcatttcaaataagtagagaactttatttagatgtgtcagtgtggcttactctcacaaacataatatttagtggcatgattaagtcacaaaagaatatgtacagtataactcagtttaaataaagttcaaataaacatagacataacattgacataaatatattcttgaattgaaagactttaatgaaatcacttctccccaaaattaatctttgtaactagtgcatccaaagtaaaacccagtaaggtttgatttagatattgacaagctaattctagaatttatgtaaactctaaaaatattaaaattcagttaataatttattgaggaaggaaaaatatattacaggaaatataagaattaatgcaatgtggtattaacaaagtaataaataatcaatgaaatggaataggtagactacagtaaggaaaatataagaacccatgatatgtaagaaagctagtattatagatcagtggtgaaaaataaatttgccaataaatgagagtgagaaaactggctatacatatggaaaataattaaagtgattctttaccttatataatatttaacaatcaattccttggcaatcaatatttaaatgtaaagccaggcaaaaattacagaaaacccgacagtaaaacaaagaaaatggcttgcacatgtgctttataaaatgtacaatgtaagtgtccaccatacatatttagaatcactttaacttatttttaacacaaaaatgcaaatgaaaatgttttatatgtacattattacttatacaagagattgaccaaaaacggtctgacaagacagacttctggcaaacatatagagcaataataatttcatatgctttcctggaaatggaaattatatccgttttaaaaagaggcttgtattacccagtaatattgaagatgaccatatattctaatcagcaattggctttcactccttattttgtatgtacatggttggccattaagaaatgtaatccaaaatatttacaggctcagttaagtactataagcaatgcaaaagttaaacaacagtagaatgtggtagattcatacagtggaatactacactttagaaaaaaaatagataactttatttagatatgttaatgtggcttactctcacaaacataatatgcagtggtatgattaagtcacaaaagaatatgtacaatataattcagtttaaataaagttcaagaacacaaaacagcaagttggattgtttataaaaggtttactggacactaaatctataaagataataatagaaattattttaacacatccttcaattacctttcattcctccagaaatttgttgaaacctcttgaatgcctatgacctttctcatttcctccactgtttaatttccttttatactttgtttaaaactttgaatggacatatgagagatgaagtcatatttttctaaataagttcaaaaatattttgctttaaaatataagtagtgattaaatttctaagaattgagcaatagttgaatgttataaatttagttttcatgaatatttctctctccacatttcttcttctcaacttgctcatatcccttcaaatgacaaaatacttagaagtatttgagtcaagttagatatatttttgaagatattatttgcttatttatctatgagaggtcaacaacaacttccatgaatattaggaaagcaaatgtcggtagctctattcacttcaatattgaattcacctatatctgaaatttaaatgtcagtgataagactgacagaaagcgtcacacactttaggtaacacagc

SEQ ID NO: 1999 - DNA, 744 bp, Homo sapiens
gtgaccgccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcgggtcagccaaagaggagcaaagagtcatctacctcaatcatgttcaggaaatgatcaggtcaagatgtggagtgagccagcttttctcttttgtgccacattttctgacccagtatttcaaggtacttctagtacacaaagactattacaagagggaggaaagaaggaaggtcagttatctgaagaactgaggctagctagaagcccaaatttggtgtgatgagggccatcaaatctcaacagaaacagctttctctctctgttatcctggacagggcttgtgattttttttttttcctccactcagccatagactctcagctacatatcctctagcctggagtagtcaaatcagctcatctctttctctctcataccaaactttcaaaaacaaaacaaaacaaaccaaacaaacaaaacaaaacaaaacaaaacaaacactttgttattggaataaatgagaaaaatgtatttgtgtttaaatatctgtgatacatgg

SEQ ID NO: 2000 - DNA, 3951 bp, Homo sapiens
gccaccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggacagagtctagctttgtaccaggctgcagtgcagtagtgccatctcagctcactgcaacctctgcctcctgggttcaagcgattgtcctgcctcagcctcccgagtagctgggattacaggcacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccagaaccggacatgctttccttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaactttttctttaacattttttatagtgttgttttactggtgatgatttctttcaggttctaagtgcctgaaaaaatctttatttcacctacatcctgaaagatagtttctctgagtctacaattcccagctgacaatgtttatcttccagtactttaaagatgttgcttcattatcttctaattttctttgtttctaataaaatgtttgctggcattttttgttcctctgtgcaaactgtgtttttgtcattggccactttgagaatttttctttatcactagttttaagcaattttattttagtgtattttgtgcacaagacaaggatgccctctctcaccactcctgttcaacatagtattggaagtccttgccaaaacagttaggcaagagaaagaaataaagggtacccaaataggaagaaaggacgtcaaactatccctgtctgtagattacatgatcctatatgtagaaaactttataggcccaaaagcttaaggcccgaaagctccttaagatgaaaaacacctttggcagagtctcaggatacaaaaagaacatacaaaaattactcgcattcccatacaccaacaagagtcaagcggagagccaaatcaggaatgcaatctgattcacaattgctgcaaaaagaatcaaatacctaggaatacagctaactagtgaggtgaaagatctctgtaagaactaaaaacaccaaagatatcagagaggatgaaacaaatgaaaaaacattctatgctcatggataggaagaatcaatatcattaaaatggccatattgtccttattttcaagtatgctattgcactctatgactgatccaaactcctgccagatataattctaaaaatctgtttgttaattttattattttatttttggatttttaaatgcttgggaattgggagatatgcacaattgtctttgctttgtccacaaaattaaatgcgtatttgggtacttataggacactatttgtaaaaacatttatttcttcagacattgatggtcttgtcccagttattaacaacatctacatgtttaagaataaattttcttttctatctacttcttattccattgaaaattacctttctatcctcctactctggaagtctttatgattctgtcctaatcattagtatcccattgcttcttcaagagatgtctgtcagtagaatttctccattaatataagttcatacttctatgaaaactttaaatctcaaatctacagtatttctagttctaaaaaatatttaaattagttctttaattatttccatctttatgtttactttcctttttttctagcattttaaacaactttacgtcaacaattctttatcttcactttacctccctttacctttcttcattttttcctagccattggattcagagaaaattattcaacttttaaacttcaaacttgctagatctatatttaactatgtctattgttctcttcagaacatctgttgagtttttaatccaagagctattatcagtattttctaaaatgcaacctcttcttgcatgtctctgaagatatgaattacacttactgtaattacatttgtttcttttcttaattctgattctctgaaattacttattctgtttgctaagttttgtatcttctttcttgtttttcttaaaagttgggtgacaatattttacatgggtagtttttctgttaatcatagcttatctccaatgattaggaaaataacaactatgaagtaggacaaagtaacctggtttcttgtgttttagcattgctgctccctgttccttcctggttttgttaattacctgagactctgccctgttgatgttagtcagattctaagactcaccttgccaagcaagcactgctttgttattccaaagtgaagttcattcttactttgtctggaaagcagtctctgcatcttttaccttattatttccctcctttcatattatgtttcttcctttaccaattttaatggagcttccccttttttgtctctaagatctccttctctatctcaaaaacaaaacaaaaaaacattatcagcattaacatatacaacagagagcttcattgatgtggtttggctgtgtccccacccaaatctcatcttgaattcccatacgttgtgggaggaacctggtgggaggtaattgaatcatggaggtaggcttttcctgtgctgttttcctgatagtgagtaagtctcatgaggtctgatggttattataagggggagttttcctgcacaagctctctttgcctgctgccatccacgtaagatacgacttgctcctctttgccttccaccatgattgtgaggcttccccagctacatgaaactgtaagtccaattaaaccttttttcttttgtcaattgcccagtcttgggtatgtctttatcagcagcattaaaacagactaatacagtaaactggtatcagtagagtgggatgctgctgaaaagatacctgaaaatgcagaagcaattttggaactgcgtaacaggcaggggttggaacagtttgaagggctcagcagaagacaggaaaatgcaggaaagtttggaacttcctagagacgttttgaatggctttgaccaaaacgctgataatgatgtgaacaatgagatccaggctgatgtggtctcagatggagttgaggaacttgttagaaactagagcaaagttgactcttgttatgttttagcaaagagactggcagcattttgcccgtgccctaaagattagtgaaacttagaacttgacagaagaattagggtatctgacagaagaaatttctaaacagcaaagcattgaagaagtgacttgggtgcttttaaaggcattcattttataaggcaagcagagcataaaagttcagaaaatttgcagcctgacaatgtgatagaagagaaaaacccattttctgaggagaaagttaagctggctgcagaaatttgcataagtaacgaggaactgaatgtcaatccccaagacaatggtgaaaatgtctcctgggcatgtcagaagtcttcacagcagcccttcccatcacagtctcagag

SEQ ID NO: 2001 - DNA, 3945 bp, Homo sapiens
caccgttgcccgggtatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcctgggttcaagcgattgtcctgcctcagcctcccgagtagctgggattacaggcacatgccaccacacccagctaatgtttgtatttttagtagatacggggtttcatcatgttgcccaggatggtcttaatttcctgacctcgtgatccgcccatctcggcctcccaaaatgctgggattacaggcatgagccaccagaaccggacatgctttccttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaactttttctttaacattttttatagtgttgttttactggtgatgatttctttcaggttctaagtgcctgaaaaaatctttatttcacctacatcctgaaagatagtttctctgagtctacaattcccagctgacaatgtttatcttccagtactttaaagatgttgcttcattatcttctaattttctttgtttctaataaaatgtttgctggcattttttgttcctctgtgcaaactgtgtttttgtcattggccactttgagaatttttctttatcactagttttaagcaattttattttagtgtattttgtgcacaagacaaggatgccctctctcaccactcctgttcaacatagtattggaagtccttgccaaaacagttaggcaagagaaagaaataaagggtacccaaataggaagaaaggacgtcaaactatccctgtctgtagattacatgatcctatatgtagaaaactttataggcccaaaagcttaaggcccgaaagctccttaagatgaaaaacacctttggcagagtctcaggatacaaaaagaacatacaaaaattactcgcattcccatacaccaacaagagtcaagcggagagccaaatcaggaatgcaatctgattcacaattgctgcaaaaagaatcaaatacctaggaatacagctaactagtgaggtgaaagatctctgtaagaactaaaaacaccaaagatatcagagaggatgaaacaaatgaaaaaacattctatgctcatggataggaagaatcaatatcattaaaatggccatattgtccttattttcaagtatgctattgcactctatgactgatccaaactcctgccagatataattctaaaaatctgtttgttaattttattattttatttttggatttttaaatgcttgggaattgggagatatgcacaattgtctttgctttgtccacaaaattaaatgcgtatttgggtacttataggacactatttgtaaaaacatttatttcttcagacattgatggtcttgtcccagttattaacaacatctacatgtttaagaataaattttcttttctatctacttcttattccattgaaaattacctttctatcctcctactctggaagtctttatgattctgtcctaatcattagtatcccattgcttcttcaagagatgtctgtcagtagaatttctccattaatataagttcatacttctatgaaaactttaaatctcaaatctacagtatttctagttctaaaaaatatttaaattagttctttaattatttccatctttatgtttactttcctttttttctagcattttaaacaactttacgtcaacaattctttatcttcactttacctccctttacctttcttcattttttcctagccattggattcagagaaaattattcaacttttaaacttcaaacttgctagatctatatttaactatgtctattgttctcttcagaacatctgttgagtttttaatccaagagctattatcagtattttctaaaatgcaacctcttcttgcatgtctctgaagatatgaattacacttactgtaattacatttgtttcttttcttaattctgattctctgaaattacttattctgtttgctaagttttgtatcttctttcttgtttttcttaaaagttgggtgacaatattttacatgggtagtttttctgttaatcatagcttatctccaatgattaggaaaataacaactatgaagtaggacaaagtaacctggtttcttgtgttttagcattgctgctccctgttccttcctggttttgttaattacctgagactctgccctgttgatgttagtcagattctaagactcaccttgccaagcaagcactgctttgttattccaaagtgaagttcattcttactttgtctggaaagcagtctctgcatcttttaccttattatttccctcctttcatattatgtttcttcctttaccaattttaatggagcttccccttttttgtctctaagatctccttctctatctcaaaaacaaaacaaaaaaacattatcagcattaacatatacaacagagagcttcattgatgtggtttggctgtgtccccacccaaatctcatcttgaattcccatacgttgtgggaggaacctggtgggaggtaattgaatcatggaggtaggcttttcctgtgctgttttcctgatagtgagtaagtctcatgaggtctgatggttattataagggggagttttcctgcacaagctctctttgcctgctgccatccacgtaagatacgacttgctcctctttgccttccaccatgattgtgaggcttccccagctacatgaaactgtaagtccaattaaaccttttttcttttgtcaattgcccagtcttgggtatgtctttatcagcagcattaaaacagactaatacagtaaactggtatcagtagagtgggatgctgctgaaaagatacctgaaaatgcagaagcaattttggaactgcgtaacaggcaggggttggaacagtttgaagggctcagcagaagacaggaaaatgcaggaaagtttggaacttcctagagacgttttgaatggctttgaccaaaacgctgataatgatgtgaacaatgagatccaggctgatgtggtctcagatggagttgaggaacttgttagaaactagagcaaagttgactcttgttatgttttagcaaagagactggcagcattttgcccgtgccctaaagattagtgaaacttagaacttgacagaagaattagggtatctgacagaagaaatttctaaacagcaaagcattgaagaagtgacttgggtgcttttaaaggcattcattttataaggcaagcagagcataaaagttcagaaaatttgcagcctgacaatgtgatagaagagaaaaacccattttctgaggagaaagttaagctggctgcagaaatttgcataagtaacgaggaactgaatgtcaatccccaagacaatggtgaaaatgtctcctgggcatgtcagaagtcttcacagcagcccttcccatcacagtctcagag

SEQ ID NO: 2002 - DNA, 3927 bp, Homo sapiens
agcatgaatccttctgtagaataaatttcccttccttatcctgttaaatttattttgtcttaaattctatcttgtctcaatagcaaaattctgacaactatttcaggatcttgctatcatacaagatctatctttgctcttccttttacattaaaccattctgaattgccttgttcaatatgtttcttgcacacagaatagattggattctgctccattagccaatctaaaagtacgccatttaatgatggagtctttctctgttgcccagcttggagtgcagtggcccgatctcggctcactgcaagctctgcctcctggattcatgccattctcctgcctcagtctcccaagtagctgggactacaggcacctgccaccacgcccagctaatttttttgtatttttaatagagacggggtttcaccgtgttagccaggatggtcttgatcttctgacctcataatccgcccatctcagccttccaaagtgctgggattacaggtgtgagccatagcgcccggctgaatgtgtgtatatttcttaattttaaccactaagactagaagcaataacattttaatagcaatcagcacatctagcattcaaatcttggattcacttttttcttctttaaaaggatacagagctccttggatcaatgcctgattctaggtgcatgcggcagaaagaacaaaatgggtctgagacatctgttgttgttaagaaaataaggaagtctcaactaatgattgagacatgccaaagaacataggagctaactagaagtggctctcagtgacccaaactgagataaattgaacaagggaataaataatgatggcaatagattattcagattaattaaaccaaatacacatgaatccacactaatataaataaataattggataaataagaaaagtgggacaaaggaaagcttttccatacagtagaattctaatcaataaatatagaaagaatagtggaaatagattctcatttcttggcaaataccacataattgttgcagacaagtctgctaaaattagtggatacaattatgagaaacaagatatttacataatctccaagtatctctcaacaaaatactgattttaaaaatggtaactttgaagtggagaaatgtggcagacaatgtcttattcaagtgatcagagttaacgtcaacaatattaggacacaataatatcatgtgcctcctgatatgatgcactgagaaggacaacctcggcattgtggcattcttgccaaaatatattatgtgaatttaaccatgaagaaatattagaaaaaaatcaaacttcaaaataatctacaaaaaacaagtatcaagggcatgaaagacaaaaagaaaagctgaattttcttttttaacttttttttttttttgagatggagtcttgcactgttgccaaggctggagtgcagaggcgtgatctctgctcactgaaagctccgccgcctgggttcacgccattttcctgcctcagcctcccaagtagctgggactacaggtgcccgccaccacgccagctaattttttgtatttttagtagagacggggtttcaccgttttagctaggatggtctccatctcctgttctcatgatccgcccgcctcggcctcccaaagtgctgggattacaggcatgagcctccgcacccgaataaagaaaactaaagaaatgtagcagataaatgcaatatgtgaccctgattttgatcctagttaaaaaacattagtggaaccatgaacaaaatatgtaaataaggtctgtaggtaagtaactaattctgtatcaatttcctaatgtgagtaactgtactcttagatatggtgttagcagtcaagaagctgggtgaagaatatataggaattcttgatttttttaaatatatttttgtaagctttaaagtagttcaaaatgaaaattttaaaataaaatgaataaaaaagaaaaaggataggatggatcttctgaagtattgtgctaaatatgaaattcatggtccatccctgaggtcttttatattacagtgtttaagatataaaataaatgtaaagaaaaccaaagaatgatcaatagtgatgaaagttatcactatttctggataaaccatgttctacgatagcacataactggtgatagcttggagtcatgcgaagacctctccaagaaaatgaaatgtaaagtgatgacttaaatatggaaaaggaaccatttgattaaaaagccaaactatgaagcttcaaagacaggatgttaccttgtgcaaaaccctgacttggggaaaaactgtgtttcaagagtggaaagagccctgtctcattaggagtgagggtcttgaatggtgcctgtggttgtagacagcagagcagagctttagcatcctggagatttgtaattgtactccacaagtaactaaaggatttaaggcagaggagggaaagaatcttgcttacattacaaaaaataaaaaagaaaaagaagaaataaaaaaatagaaaaaaatgtaatatatattattattattacattggtttatagtaattggtttatatctaatttgtttccctgtgtttataatacatatatatctctgcctcttaaaccaagaataatttttacagggacaagaataaacacaaggaaatgaattagaaaactattaaagtgaaaggacaagaaggtggagaccttgttcaaaataatgaaatacatatttaatatatgtgcaagtttgaagaaaagagctactgatagggttttggtgtattagataagataaaatcaatgggaacaccagctgaagtaaacaaacaagcatacacacacaaactgggaagcagagaaaataacaaaactctacttaaaacattatgaatttcagttgtctataaaacaatccacatttgatattaagtaagtagatgactatgcaaagctctaactcagagaagataccaaaattggaaatattctgagatgctatcatgtaactggcctttaaactcatgaaaatgcttgagaacactcaggggaaaaagtgagtaagtagagaaaaaagaaagtactcagctaagtgggttgaagacagtacaggaaatattgaaggagactgtctattgtttgattgatttctttcaaagaaagaatacaaagtaagttgataactgaaggacaacggtaggtcaatgtaaacttttaacaaaaagggaattattcattaatgagaatgataatactaaaatgagagggagagctaagggacagaatttacttaatattgggagatctcatcaatttagcataagacatgtggtaactttgtagaaggttattgttatgaatgctgtgggagtgaatgcattgggaaactaaaatagaatgtttggcactgttgagtatccttttaagttttgtaatgaattgaaatcatgttattagttacaacgtagatgagcctggaggacattatgttaagtgaaataagacaggcacagagagagaaaaaccacatgttctcacttatatgtgggagctaaaaatgggcttataaaagtaacaagtagaattgtagttatcagaggctggaaaggatgggaataagaagaggatggaaagaggttggtaagcaaagttaactttgtaacaaagttgtagctagaagggaggaatagctctagcgttctgtagcactgcagggtgaattaagttaacaataatttagtgaatttttttaaaaacctaccagatagaattctgaatattcacatcacaaggaaatgacaaatgtacaaggtgatagtatgctaattactctgattagaatatttcatattgtatacatgtatcaaaatatcactctgtatcccataaatacgtataattatgtgccaac

SEQ ID NO: 2003 - DNA, 934 bp, Homo sapiens
ttctaacattgttgtaaccacgcccccaacccctgtattatattgtctatgctttaaaaactatattgtggacttgaataaaatttattttcccattcctggtaaaaaataattgggtcattctttactcatgtatcaattcaaatttctaagactctatttatctcttctcctcaataatgtttcttttttcttttgcttttttttagacttgtgcttttttaggtcttgtgctctcacccaggctggagtgcagtggctggaacacagctcactacagccttgacctcttgaattcaagtgatcctcacacttcagcctccagagtagctttgatgacaggatcttgagatgacgtcatactggatgatcctagtgcaccctaaatccaataagtgttcttatgaaagacagaagaggagaagatacaggaaatagaagaaggctacttgaggatggaagcagagcttggagttatgcagctacaaaccaaagaatgccttgagccaccagcagctgaaagaggtaaagtaggatccacccataaacacttgagaaggaaagtgggcctatctataccttgatttcagatttctgccctacagaactgtaagagaatatatttcttttgctttaaatgtttaggtttgtggtaatttgttataacagatccagcaaactcatatactagcactgagcagatattcaataagaattgattatgaattatagtcattaagatagtgcggcattgactcagagatgaacaatttgttcactagactatagcagaaaattcaaaaattcatggtagactttcgatattttacatatgaattgtcgtatcacccagaaaaatgaataactattcataaaatagcagtgatacatttgattaacatatagaaaaattgtaaattgtattctatcatca

SEQ ID NO: 2004 - DNA, 1672 bp, Homo sapiens
gtaaatatttctttaagttttgtaaaatatttgatgtagaatatttagctccaaattaattaggagaatttcatagtgtcttataattaagctgcccttaaatacacctgaaccttcatgcaaacgtctgtggttatttgtctccacatgtttcagcagatgaggtgatttgaatgcagcaaaaaatttaatagcttaagttgaaacaggaattatcctaagggaatctgtagaaatgcattcaagagcagatgagctatatctatttctttcatgctttggtgtagtaagtaattgttcatagccaaacgctttacgaagataaatgattgatataatgaatgacccgaagatgcccaagagcacatgaaaacagaaatgcctttgttctgaaggagaatgtcttagtatagttataaattgaatgtaaaaattgtggctgaaattattctaaaaatcacaagaagctgcatttaaactgtgctatggcatctattcaaaagatttgaaaccatttgttttctgaattgcacccaacataaagctttctcacacagaacaaaacagaagtgagcatcagtcacacttccaacatgcatacattttgctctaaaggaacagctgttacttgatgaaaagtcgatgaaagatgcccaacatttgtttttaaaaagttatcacccaaacaagaattgtttggaaccagatgctaaaatcgagagtggtctgtttatttcagttcagagtgttataaaaatgttaataaggtatttttatgtctattacccagctatatttgactttctaatgtgctttttgttataattggctgttgtttctataggctggcattattggcattagatcactgaagagtaaataaagtgagcaagaatactctcttgtcaccagattactgaggtgtactggaggaacaatcatgaagtttaagaagaaagaatactgtcagaaaagaggcaattttttttatatttaaaaagttccctttttccagtctattcatttttatgcatcaactctcattttatcttgacaatttcataataactatatttacctttattttttatccatatgcatttcatttaaaagtgaaaactttcactcaaaatgtaaaaagaacttatagaatttgcctccaaagagctctactagtctgtctttcctatttcatccaatgttacgactacaattcccatctatcaaacacagcagtcaattggtaagtcatttatgtctctttttatactatttttcatgaagtttctttattttccagttctattgtatgtcacctcaaatatccatacaacacattattttaatctccttccctctaagcattcctgttccacttaatctaacacaatgttctcaaagatatgacaaagtgcaactctgttaaaaaagcttcaaagactttccactgaactgaacagaattagaatagatgattatttcagtcatgtgttggtatataacaaaataccccaatcacctattcttcctcctcttaaagtcaatgtattattaaaacgtccaacttccttttatgaaatatttcacacatacccaaaactgaaaaataattgatacagcaacataaccagaaacaagattataagaaattctacaagggataactacaggc

SEQ ID NO: 2005 - DNA, 4426 bp, Homo sapiens
acaaggtcaggagttcaagaccagcctggccaagatggtgaacgcagtctctactaaaaatacaaaaattagccaggcacagtggcgggcacctgtagttccagctactcgggaggccgaggcaggagactcgcttgaacccgggaggcggaggttgcagtaagccgagatcgtgccactgcactcctgccttgcgacagagcaagactccatcaaaaaaaaatgtaatttaaaagattaaaagttaagatagatttttacaaatgtatatatctaccattatagtatcatacagaatggttttactgccgtgaagattctctgtgctctgtgtatccatctcttccttccccttggtccatggcaaccactgatctttctactgatcccatagtttcaccgtttccagaacgtcatataattggaatcgaacagtacgtagacttttcggattggcttcttcttttagcaatatgcatttaagtttcctccatgtatttttttgtggcttgatagttcatctcctgttagcagtgaataatatcccgttgccattatacttttgtcaagactcagaacgtacaacgtgaagagtaaacgtgaatgtgcactgtaagctttgagtgataatgaaggatcaaggtaggttcctggttgtcacaggtgtgctcctgtgaggcaggaagctgtagtggggaggctgtgtgtggggaaagggacatatgagaagtctgtactctctgctacgtttagctgtgaacctgcacttctctaaaaaataaaattagttaaaattaaaagcaaaaaattagaaaaattaaaacattacaatgtgttatatagttttcaaatcacaagacagaaaaagacataataaaagaaactatagaaaacaacaaggataggaataaaacatcagtgatagaaggcagaagacagaaatgtggagccaaacacattaatttattttaatcattagttatactcatttatactaatttatattgatttaacatattaattctgactaaatggcattaaaggaggtctgaggaatttgcatgtcacattctggatgacaggactcaataatattaactctttagttggctgtaaatcatttaaaaatatgctcaaattccaataaaaattccaagaaaaatattttcgaacaagaacatgtgattttaaatccatatattgaacacacacatacaatgagagccattattataaaatttactataagatatttaagattattatcactatccaaaattaaacaaatttgaaatggcacaaaaataaacacattaatgaaagagaattaaaaacacagaaattgagtgtaattttatctagtaacagggtaacattttaaacccacaaaacagagcgattgttccatttgtggtattaaaatattgggtaatgatttcagaatataaaatgacagaattgaatcatggtcctacaccttacataaaagttaattccagtattaaatgtaaaaaaaaaagagagagaaaaaagaaaattagatgtgtgtgttttatgaccttgagaatgaatgtcttctaaaaccaaaatttcaaacagaaaccatataaaaaggaataaacctaacgtacctaatatgtaaattcttaaacattttaacaccaggtaaatagcacaaaacaaactggggaaacttttacagcaattatgttacatgaaagttaaaatccttatgacatatacaatgtataaaacaatatgattactgctattattaatagcattatgattacctggtcttcccacgcaccagtcctcttctggtgccctgtggtgaaacagagccctccctctctggccacagtgagggatccagcaggaacccgtgcctaaacccacagagggtgtgagccaagccaggacatcacattccctcctgcgaaatgatgcagatacccactcacgacagagatttggtccctctctggaaaagctgtgtaacaattattgcagaaacttgtttcttatgttcccagacacatggagaaagctggtctggaagactgatgtccacatgctaaaagcagtcactcataacacacacactgcacacaccacaccatgtgcacatgcacacacaccccacacacagacaccacacaaacagcacacacaccatgtgcgcatgcacacacacaccccatacccactgcccacaccccacaaacacacctactgcacacacaccatgtgcacatgcatacaccccatacagacaccacacacagacaccacactgcacccacaccatgtatacatgcacacaccccacacactgtacacacacgatgtgcacacatgcatacctctgacaccacacacactgtgtacacatcatgtgcacacacacccccccacagacatcacacacaccacacagtacatgtacccgtgcacatacccccacaccacacacgaatctactacacatacatcacacacatacagcaccacacacatcacacaccccatacatactccccacacacaccacacaccccacacatactccccacacactgcacacgtacatacagtgccacacacatagagcaaacacatacctcacatacatacaccacaccacacacacattctacaaacacatcaagcacacatcaaacactacacacactgcacacacacagcatcatacacacacaaaacacacacatcacatacaccacacacatatcacatgcacacatcacatatagtacacatacacaccaaacacacatacaccacaaacacagcacatatacacaccatgcaccacccacatactacacacagtatacacacataacacccacaatacactccacacacacatatacataccccgtgtacctactacacacacagaccacacacacatatcatgcatacacctgcacacacctcacagaatacatacaatcctcacttttagaaattaatttggcttttaaggagcctggatagtaaagtattttattggcgtttgagtgagccaagaaaatgcgtataaatacacatgcataactatgagggcccaagcagcactttcgaaatcacaacatgagattaaaccgtgtaaattttttattgtttttaaaaagtcaactctttctcattttactagaaactatttaccagagtaaactaatgagattcttcctgaggtcaaaagactttctggaaaaacttctccttgatgaaattgcacttaaaacatcactttcatcgtgaagtatttctttaagatgttcttggtccttttcctgttatgtggaatcgtcaattcaaatttttaaaagtgactctgatatgtttttcatctattatttaaaaaatgttgaagggctttttaattctgccttcagcagagatcgacacactctgattatgatgtaaaactgaatacgttactctgacaggctttctcctctgcagcgccgctaccatcattattaataatgattgaatgcttttactccatgcacaatctatattccctgctttataaagaatagaaatctaattctcactatgaaggcagataaaagtaatcccttcaatctacagatgactgaatcatttaccaaagcactcagactttaaatagaatttatcaaatgtgtctatatttctatgcatataattcatataaagaacatgtagtttaaatcattgcacattttatgcttttaatcagttgtgatggtcattagtatttttatcacatttctccaaaggtaggctaatcactgttattattttcagctagaaatataaaaggtattttctatttttgatgactttgaaacataacccttggaatataatatctgtgtataatatctgtggaaagcatgaaagtaatattcaaacagtatgcattttttccagaatgaaaatttcctctacaataacattcatccttttttcctgatggacacataaaagtcaacatttctaacattgctggacgttatttacattaaacttgcctcagcttcaggtgttgcagaaactgggcaagaggccacaaggtacacaatacacacacacacacacaaacttgtattattatacttacctaagtgtctaaagaggtggataaatatattagattgctccagaacaaggatgttacagggaagcactgtcctacatcatatgtgacgggctctcatagtcaccatcatcacgggaatcttctgcatgttacagggaagcactgtcctacatcgtatgtgacaggctctcatagtcaccatcatcacgggaatcttgcgcatgtttcagaggaagcagtggggccctacatcatatgtgacaggctctcatagtcaccatcatcacgggaatcttgtgcatg

SEQ ID NO: 2006 - DNA, 209 bp, Homo sapiens
agaaaaaatataagaaagaagttgaagcaaacaacttgaaccaactgttcaatcactagagatgaaaccgaagactgcaagaaatactccaaatcaggattttcataatcatgaagaaatgaaagatctgatggatgaaaattgcattttgaagacagatatttctatactcagacaggaaatatgctcaatgaaaaatgacaaccggg

SEQ ID NO: 2007 - DNA, 856 bp, Homo sapiens
ctggggtttttaatcaagagtgtatcccaaccttgaaggttttttgtttttttgtgggtttttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctatgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaactttaaaacaaaaaaaaacctcttcctggcaatggacagcctgtccgtgttagaccaagaaacagactgtaaa

SEQ ID NO: 2008 - DNA, 761 bp, Homo sapiens
gtggttgtgagacaacttcaacaagaagtggctgacagcgtaaaaaaattaacgacgttagagtctccactggaaggtatatcacgttgtcacattaatttggatgagacacaggcctcaaataagaaattatttcaagtgaaaagtcaaatataagaaactcctggaaatgacaataaatatgttaaatgtatttggaaatgaagactttgattgccatggagacttaaaaacagatcaactgaaaatggatattctgattaagaagctaaaacagaaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaagttaacaaaatcaaataagaaaatagcagtgattagcatgaagctcctcatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtgatggagctggactgtgtagaacaaataactagagaaacaaagagaa

SEQ ID NO: 2009 - DNA, 892 bp, Homo sapiens
taaaaaagaaaatgaagaattaagaaaactttttgagttaatatcatcactgaaatataatgtgaatcgaataagaaagaaaaatgatgaattagaagaagaggcaactggatataagaaactcctggaaatgacaataaatatgttaaatgtatttggaaatgaagactttgattgccatggagacttaaaaacagatcaactgaaaatggatattctgattaagaagctaaaacagaagtttgatgatcttacagcacagaaggaagctttatcttcaaaatgtgtcaatttggctaaagacaatcaagttcttcaacaggagtttttatctatgaaaaaagtacaacagcaatgtgaaaaacttgaggaggataaaaagatgttgaaagaagaaatattaaatcttaagacacatatggaaaacaatagggtagaaattagtaaactacaagaatataaattggagctagatgaaaaggcaatgcaggcagtagaaaaattagaagaaatccatttacaggttagttttttaaatcaggtaagtttatctgtaatgtgctttcatttatttcaccacaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgacc

SEQ ID NO: 2010 - DNA, 2330 bp, Homo sapiens
taaaaaagaaaatgaagaattaagaaaactttttgagttaatatcatcactgaaatataatgtgaatcgaataagaaagaaaaatgatgaattagaagaagaggcaactggatataagaaactcctggaaatgacaataaatatgttaaatgtatttggaaatgaagactttgattgccatggagacttaaaaacagatcaactgaaaatggatattctgattaagaagctaaaacagaagtttgatgatcttacagcacagaaggaagctttatcttcaaaatgtgtcaatttggctaaagacaatcaagttcttcaacaggagtttttatctatgaaaaaagtacaacagcaatgtgaaaaacttgaggaggataaaaagatgttgaaagaagaaatattaaatcttaagacacatatggaaaacaatagggtagaaattagtaaactacaagaatataaattggagctagatgaaaaggcaatgcaggcagtagaaaaattagaagaaatccatttacaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaagttaacaaaatcaaataagaaaatagcagtgattagcatgaagctcctcatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtgttgttgctgtgttgaacacttgctcccgtctacttacttctctataatccactgccatggaatgagtgatttttcttagaagcagaggtggagccactgaggaagcacaggcgagccctccccagcacgtgatcactggtccccaacagaacaaccgctgccgcatccatgaggtatcaagaaactagcaaagggccttctggctgtctgggcacagtcctcatgtggtccctggctcagcctcaagggtcctgcattagtcttcctgtagcctctgtgctgtgtctgtagatcgggactctgtgggaagggccctgggatgcccaacagcacaagatgtctcatctgccaaatgtccctgccttcctcccactctgacactcaggaataggctacatggcatgtccaggcagtgccaggccacctcactatctcctttgagattggcccagagggcttttggggtgagtgtggagctgggcacctggagcctgaggccagctgtctctccctctgtcttggaggaaaagccatgtcccaaaaaaaaccccagggcctgacctctggacacacatacagggagggagggtctgtgggctgaggggggcattgtaatgagactttgagcacgctgctcaggggcctggtcagtggaccatgctcagagatgacctggtcatcaggacctagtcagttgggacctggttagtggtggcctcctcagtaaacgcctcctcagtggggacctggtgacctagtcattggaagcccggttcatggggacctggtcactgatggtcttcttagtgaggcctgatgggctggaacataaacaatgaaaaactggttggtggggcctatgcagtatactaggggcctggtcagtgtggggccttagtggcttggagcctcgtcagtgagggcctggtcagagggggcttggtcagctggggactgatccatggaaaattgtttagtgggggtcaggtgagcagcgacctggtcaactgtggtcttgtcagtgggaacctggtcagtggggaccaggtcagtgggaaattggtcagtgaggtctggcctatgaggcctattaagtgtgagcctggttaggaagacatggtcagtggggacttggtcagtgggaactggtaaatggaggagtggtcattagaggcctcatcagtgggaaactggtcctgggcggctggtcagtaggaacctggccagctggccactgtgtgacctcaggcagggggtttgtctgtggagtctccttgcctccatctgcagggaaggtgagtcagggcaccttggagggtggctggaaagagaaggtgagaagatgtgttgaatccagcaccacttggcagac

SEQ ID NO: 2011 - DNA, 1433 bp, Homo sapiens
taaaaaagaaaatgaagaattaagaaaactttttgagttaatatcatcactgaaatataatgtgaatcgaataagaaagaaaaatgatgaattagaagaagaggcaactggatataagaaactcctggaaatgacaataaatatgttaaatgtatttggaaatgaagactttgattgccatggagacttaaaaacagatcaactgaaaatggatattctgattaagaagctaaaacagaagtttgatgatcttacagcacagaaggaagctttatcttcaaaatgtgtcaatttggctaaagacaatcaagttcttcaacaggagtttttatctatgaaaaaagtacaacagcaatgtgaaaaacttgaggaggataaaaagatgttgaaagaagaaatattaaatcttaagacacatatggaaaacaatagggtagaaattagtaaactacaagaatataaattggagctagatgaaaaggcaatgcaggcagtagaaaaattagaagaaatccatttacaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaagttaacaaaatcaaataagaaaatagcagtgattagcatgaagctcctcatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtgatggagctggactgtgtagaacaaataactagagaaacaaagagaattgttgctgtgttgaacacttgctcccgtctacttacttctctataatccactgccatggaatgagtgatttttcttagaagcagaggtggagccactgaggaagcacaggcgagccctccccagcacgtgatcactggtccccaacagaacaaccgctgccgcatccatgaggctcccattgtggtgggttgtgtcaccccacaatgtcactgttgctgagcccccatcgcctctgtgttgtggagcagttagagacacactgtggtgtctgagtggctctgtgtgaaggaccgttttctaggtgagaggcacatctcaacacagctgactgatcagactcagcaattccattctgcatcttttctgatcacccccgtgattacccaggacaaccccatcaggccctctcacccaggcccagtccagc

SEQ ID NO: 2012 - DNA, 2407 bp, Homo sapiens
gtttgtctacaggagtagaaacagttctgtttctaaagaaatgtgatgtaaccaatgtaaccatggatgatctatatctgcctttacacatttcatctctgttttaaaatatttttatgataatcatatttaaaattgtttttagattataaggaagctgcatgttaaaaattgagctgtataagaaagaggaaatatagtgaaaactttggggttttaatctgtgcatgtgagagagaatgagaaatatagtgttttcattgtgtatgcattaaactgtcttgctaaaactcagatctaagattgttaagtagatatttggggaacttttttatcactttaaatgaaaaatttcagctttactgggcattctggaagcaaaatatgttatgctgatgataaagtgagaaccttaagaatacactcatttgatggcggaaaatgtgatggaccaaaatgcagaagctatacacgtcctagtcagctctcttcaggatgcgcatttatttctccctttggaggaggcctcagtccagctcagccaaggactgaaaggcacatctggctaattcaagactgagaaaggcttttacatcaaatattgataatgataataataatgaacacatgttgaacacttaccatgtctcaagcactgctctagagcttcccatgaaagaacccctctaatcttcagaacaaccctgtgaggagctgctgttaaatgaacaccttgatatcttcgttcttggagagaaatgagccaaggaggaagaccatctaaaaaaaccactagacaatttgtgctcactggagtggtctctgctgggcaaaaggtctttagaatgactcgtggattttctggcaagtggcaaaccatacaagtgctatgtcaggccagggagacaggtgcagccctgtcagtgtcaaagaagaacactggtagcagaagagctaagagtgaatgaaaattgaattatctttatttctaggacttgtctattgagaaacaacagtgctggcaacgatttactaccaacaagaggcagttccaagagaagaatataaaatatgctctgctcaatcccatgaaactcagagtgtctcacaatggccaatttcttatttttaccctgtccagagacaaggaaggatgcatcagggagctgctagcctctgtgatgaataacttgagtcaggctgcaacatgtgaaagaattcagctgatcaggatttataacactagctggattttttgctttctttggggttcatgaaacatggtgttgtgagataccacaggagtcccagagtaaagttacatacctatttctcttccttatttttatttttttggcatgttcatactattttattaccaacatcgttggcatccctgagtatgagagttcagaagaaacttagaggctattgtctgattcaatccttgcagcttacaaaaagaaatgtggggagcagtcactgtgtgactagcctaggtcactcaggaagttagaggcagaactgcagccagggtcacctctctttactgctactagtgtgctctttctactgcaccctgatcataaaacatctcccaacccaggaacaaggtctaccgcataggtgggcacagcagcgtgatcactctctcagtcatctgtactcctcctttgctttgaccaaagacacaggaagggaccttttgccccacataaaacacctctcagaggctttgcaacaacaacagataatagagagcattgacctaagaccaacatttcaaccatggtgtcaaaacaatattttatttcagcaaagaaaaactatgtcacaagtggattattattactaataatcagactagtggtacttgtgaatgacttggtttcatactcacacttggacaactatgcacactgagtataactgaccttatgagaacatcattctcactaagattatgatgtgctttctcacgtgggaactgtacataatattgcgtgtacacttgggaggaagtcctgcctgtggtgttgtctttcaggggaagaagaatggttgacaagtgagggtatattaaacatttactcctccagatttttcaagatttctgttaagccagatcagaagaaagccatctatttggattgcatcactctaacctggtaagtcgaattgtctacacagaattataatttcacgatatgtccagattacttaccgagagccaatttgagacaccaacaggactagtaaaacatctttgcactgtgggtagcgttgctatcaaagaccttatacattatgtcattcaagaacctttatattaagatccttatggaaaatccttcccaaagtttaaccctatgataaagggttttttcctcctggtaacatagtgggc

SEQ ID NO: 2013 - DNA, 7117 bp, Homo sapiens
aactgctcaatctaaagaaaggttcaactctgtgagatgtaagcacacatcacaaagaagtttctcagaatttttctgtctagtttctatgtgaaaatatttacttttccaccataggcctcaaagcgctccaaatgtccacttgcagattttacaataagagagtttcaagacagctcaatcaaaagaaagttttaactctgtgagatgaatgcacacatcacaaagaagtttctcagattcatattatctagattttatggtaatatatttccttttctaacataggctgcaaagcgctccaaatgtccacttgcagattccacaaaaagagtgtttccaaactgctcaatcaaaagaaaggttcaactctgtgagataaacgcatgcatcacaaagaagcttctccgaattcttctgtgtagttttgatgtcaaaatatttccttttcctccacaggcctcaaagcgctccaaatgttaacttgcagattctacaaaaagagagattcaaaactgctcaatcaaaacaaaggcttaactctgtgagatcagtgcacacatcacaaagaagtttctaagagtgcttctgtctagtttctatgtgaagatatttccttttccaccataagcctcaaagcgctccaaatgtccacttccacattcaacaaaaagagagtttcaaaactgctcaatcaaaagtaagagttaaccctgtgagatgaatgcacacatcccaaggaagtttctcacattgcttctgtctagattttatgtgaggatatttccttttctaacttaggctgcaaagcgcttcaaatgcccacttacagaatctacaaaaagagtgcttccataattcttaatcaaaagaaaggttcaactctgtgagatgaacgcacacatcacaaagaagtttctcagaattcttgtctctagtttttatgtgaagatatttccttttccaccataggcctaaaagcactccaaatgttcacttgcagattctacaaaaaaagagtttcaaaactgctcaatcaaaagaatgctttaactctgtgagatgaatgcacacatcacaaagaggtttctcacattggttctgtctagattttatgtgaagatatttccttttataacagaggcaacaaagcactccaatagtccacttgcagattctacaaaaagagtgtctgcaaactgctcaatcaaaaggaagttttaactctgtgagaagaacgtgcacatcacaaagaagtttctcaaaattcttctgtctagtttttatgtgaagatatttcctttcccactgtaggcctcaaagcactcaaaatgtccacttgcagattctacaaaaagagagcttcaaaactactcaaccaaaagaaaggtttaactctctgagatgaatgcacacatcacaaagaagtttctgagattgcttctgtctagattttatgtgaagatatttccttttctaccataggcaacaaagcactccaatagtccacttgcagattctacaaaaagaatgtttctaaactgctcaatcaaaaggaaggttcaaatttgtgagataaactgatacatcacaaaggagattctcagaattcttctgtcaagtttttatgtgaagatatttccttttccaccataggcctcaaaatgatccaaatgtccacttgcaaattctacaaaaacagagtttcaaaactgctcagtcaaaagaaagtttgaactctgtgagatgaatgcacacatgccaaagaagtttctcagattccttctgtctagatttttttgaagatattaccttttctaccatagtcctcatagcgctgcaaatgtccacttgcagaatctccaaaaagagtgtttccaaactgctgaatcaaaataaactttcaactatttgagttgaaggcacacatcacaaagaagattctgagaatacttctgtctagtttttatgtgaagatatttccttttccactatatgcccaaaagcgctacaaatgtccactagcagattctacaaaaagagtgtttcagaacttctcaatcaaaagaatggtttaactctgtgagttgaatgtacacatcacaaagaagtttctgaggatgctgctgtctagattttatgtgaagatattcccgtttccaaggagggcctcaaggggtacctaatatccacttgcagattctactaaaggagtgtttcaaaacgactctatgataaggtatgttccactctgtgagttgaaggcaaacatcaaaaagaagtttctgagaatgcttctctctagtttagatgggaagatatttccttttccactataggcctcaaagtgttccaagtgtccacttgcagattctacaaaaagagtgtttcaaaactgctctatcaaaagaaagtttcaactctgtgaagtgaatgcacacattacaaacaagtttctgagaatgattctgtctagtttttaggtgaagatattcccgtttccaacgaaggcctcaaagcagtccaaatatccactagcatattctacaacaagagtgtttcaaaactgccccatgaaaatgaatattcaactctgtgagtagaatgcaaacatcacaaagaagtttctgagaatgcttctgtctagtttctatgtgaagatatttccttttccaccataagcctcaaagcgctccaaatgtccacttccacattcaacaaaaagagagtttcaaaactgctctatcaaaagaaaggttcaactctgtgagttgaatgcaaacatcacaaagaagtttctgagaatgcttctgtctagattttatgtgaagatatttccttttctaacttaggctgcaaagcgcttcaaatgtccacttacagaatctacaaaaagagtttttccgtaattctcaatcaaaagaaaggttcaactctgtgagatgaacgcacacatcacaaagaagtttctcagaactcttctctttagtttttatgtgaagatatttccttttccaccataggcctcaaagcactccaaatgtccacttgcagattctacaaaaaaagaggttcaaaactgctcgatcaaaagaaaggtttaactctgtgagatgaatacacacatcacaaagaggtttctcacattggttctgtctagattttatgtgaagatatttccttttataacataggtcgcaaagcgctcctaatgcccaattgcagattctacaaaaagagtgtctgtaaactgctcaatcaaaaggaagtttcaactctgtgagaagaacgcacacatcacaaagaagtttctcagaattcttctgtctagttttcatgtgaagatatttcctttcccaccataggcctcaaagcgctccaaatgtccacttgcagattctacaaaaagagtgtttcaaacctgctctatcaaaagaaaggttcaactcagtgagttgaatgcaaacatcacaaagaagtttctgaaaatggttctgtctagtttttatgtgaagatacttccttttccaacataggtctcaaagggatccgaatgtccaatgcagattctgcaaaaacagtgtttcaaacctgctctatcaaaagaaaggttcaactctgtgagttggatgcatacatcaccatcacaaagaagtttctgagaatgcttctgtctagtttttatgtgaagatatttccttttccaccataggcctcaaagcgctcagaatgttcacttgcagatactacaaaaagagtgtttgaaacctgttctatcaaaagaaaggttcaactctgtgagttgaatgtacatagccaaagaagtttcggagaaaacttctgtctaatgtttatgtgaagatattcccgtttccaacgaatgcctcaacgcattccaaatatccacttacggattctacaaaaagagtgtttcaaaactgttccataaaaagaaagtttcaactctatgagttgaatgtacacatcacaagaagtttctgaggatgctgctgtcagtttttatgtgaagatattcccatttccaacgaaggcttcaaagcgatccaaatatccacttgcagatcctactaaaagagtgtttcaaaactactctatcataaggtatgttcaactccatgagttgaaggcaaacatcacaaagaagtttctgagaatgcttctctctagtttttgtgggaagatatttgtttttccaccataggcctcaaagcgctccaaatgtccacttgcagattctataaaaaaagtgtttcaaatctgccctgtcaaaagaaaggatcaactctgtgagttgaatgcgcacagaaaaaagaagtttcagagaaacttctatctagtgattatgtgaagatattcccatttccaacgaaggcctcaaagcggtccaaatatccacttgcagattctactaaaagagtgtttcaaaactgctctattataaagtatgttcaagtctctgagttgaatgcaaacagcacacagaagtttctgagaatgcttctgtctagtttttatgggaagatatttgtttttccaccatagccttcaaatctctccaaatgtccacttgcagattctgcaaaaagagtgtttcaaacctgctctatcaaaagaaaagtttaactctgtgagttgaatgcacacatcacaaagatgtttctaagaatgcttctgtctaatttttatgtgaagatatttccttttccaccacaggcccaaaagtcctccaaatgtccacttgcagattccacaaaaagagagtttctaaactgctctatcaaaagaaacgtttaactctgtgagatgaatgcacacatcacaaagaagtatctcagactgcttctgtctagatattatgtaaagatgtttccttttctaccataggacacaaagcactccaaatgtccccttgcagattctggaaaaagagtgtttcctaactgctcaatcaaaagaaagtttcaactctgtgagatgaatacacacgtatcacaaagaagtttctcagaattcttctgtctagtttttatgtgaagatatttccttttccactataggcctcaaagcacttcaaatatccacttgcagtttctacaaaaagagagtttcaaaacagctcattcaaaagaaaggtttaactctctgagatgaatgcagacataacaaagatgtttctcagactgattctgcctagattttatgtgaaggtatttccttttctaccataggccgcaaagctcttcaaatgtccaattgcagcttctaaaaaaagggtgtttccaaactgctcagtcaaaagaaatgttcaattctgtgaaatgaatgcaggcatcacaaagaagtttctcagatagctgctgtctagattttatgtgaagaaacttccttttctaccacaggcagtgaagccctccaaatgtccacttgaagattcttcaaaaagagagtttcaaaactgctcaatcaaaagaaatgtttaactctgagagatgaacacacacatcacaaagaagtttctcagaatgtttttgtccagttattatgtaaagatatttcgttaaccaccatatgcctcaaaacacttcaaatgtccacttgcagattttacaaaagagagtttcaaaactgctctatgaaaagaaagattcaactctgtgagatgaatgcacacatcacaaagaagtttgtcagaattcttctgtctggtttttatgtgaagatatttccttttccaccacaggcctcaaagggctccaaatgtccacttgcagattctacaaaagagagtctcaaaaatgctcaatcaaaagaaagttttaacactgtgagatgaatgcacacatcacaagaagtttctcagattgcttttgtctagattttatgtgaagatatttccttttctgccataggccgcaaagcgctccaaatgtccagttgcagattctacaaaaatcatgtttccaaactgctcaatcaaaagaaagtttcaactctgtgagatgaacccacgtatcacaaagacgtttctcagaatttttctgtctagtttttatatgaagatatttcattttccaccataggtctcaaggcactcgaaatctccacttgcagattctacaaaaagcgtatgtcaaaactgatccatgaatagaaatgttcaactctgggagataaacgtacacatcacaaagaagtttctcagattgcttctgtctagattttatgtgaagacatttcattttctaccaaaggccacaaagtgctccaaatgtccacttgcagattctacaaaaagggtgtttccaacctggtcaaccaaaagaaaagttcaattctctgagatgaacgcacgcatcacaaaaaagtttctcagaatttttctgtctcgtttttatgtgaagatatttccttttccaccataggctgtaaagcgctcaaaatatccacttgcagattctacaaaaatagagtttccaaaccgccccatcaaaagaaatctctcactctgtgagttgaatgcacacatcaaaaagacgtttctcagatttcttctattagattttatgtgaagatatttacttttctaccataggccacaacgcgctccaaatgtcaacttgcagattctacaaaaagtgtgtttccaaactgctctatcaaaataaaggttcaactctgcgagatgaacgcacacatcacaaaggagtttctcagaattcttctgtctagtttttatatgcagatattttcttttccaccataggcctcaagtgctctagatgtccacatgcagattcttcaaaaagagagtttcaaaacgactcaatcaaaagaaagctttacctctatgagatgaatgtaaacatcacaaagtagtttctcagattgcttctgtctacattttatgtgaagatattttcttttctaccatcggccacaaaccgctccaaatgtccacttgcagattctactaaaagagagtttccaaactgcttaatcaaaacaaagttcaactctgtgagatgaacgcacacatcacaaagaagtttctcagaattcttctgtctggtttttatatgaagatatttccttttcc

SEQ ID NO: 2014 - DNA, 8052 bp, Homo sapiens
ctcaaagggctccaaatatccaattgcagatttcacgaagagagtgtttcaaaactgctcaatcaaaagaaagtttcaactctgtgagatgaatgcacacatcacaaaggagtttctcagattgcttccttctagattttatgtgaagatatttccttttctatcataggccgcaaagtgctccaaatgtccacttgccgattctacaaaaagggtgttcccaaactacgcaatcaaaagaaaggttcaactctgttagatgaacgtacacatcataaaaaagattctcagaattcttctgttttttttgtgaacatatttccttttccaacttaagcctcaaggtgcttgaaatgtccccttgcagattctccaaaaagagtatttgaaaactggttctcctaaagaaagttggaactccaggagatgagtgcagacatcacagagaactttctcagaatgcttctatctactttttatgtgaagatatttccttctccaccacaggcctcaaagcgctgccaaatgtccacttgcaggttctacaaaaagagagtttccaatctgctcaatcaaaagaaaggtttaactctgtgagattaatgcacgcatcacaaagaagtttctcagattgcttctgtctagattttatgtgaagatatttccttttctaccattggccgcaaagagttccaaatgtccacttgcagattctacaaaaaaagagtgtttccaaactactcaatcaaaagaaatgttcaactctgtgagatgaacacactcatcacaaagaagtttctcagaattcttctgtctaatttttatgtgaagatatttcctgttccatcataggcctcaagacgctctaaatgtcggcttgcagattctacaaaaagagagtttcaaaactgctcaatcaaaagaaagggttatctctgtgagatgaatgcatatatcacaaacaagtttctcatattgcttctgtgtagattttatgtgaagatatttacttttctaccatagacggcaaagctctccaaatgcccacctgcagactctacaagaaagagtggtaccaaactgctcaatcaaaagaacggttccactctgtgagaagaacgcacacatcacaaagaagtttgtcagaattcttctttctagtttttatgtgaagatatttccttttccaccataggcctcaaagcgttccaaatgtccacttgcagattctacaaaaagagagtttcaaaactgctgaatcaaaagaaagtttaaactctgtgagatgaatgcacccatcactaagaagtttctccgattgcttctctctagattttatgtgaaggtgttactttttctaccataggtcgcaaagcgcttcaaatgtccatttgcagattctacaaaaaagagtgtttccaaactgctcaatcaaaagaaaggttcaagtctgtgagatgaacgcacacattcccaagaagtttgtcagaattcttctgtctagtttttatgtgaagatattaccttttccaccacaggcctcaaagcgctccaaatgtccacttgcagattctatgaaaagagagtttcaaaaccgctcaatcaaaagaaaggtttaactctgtgagatgaatgcacacatcacaaagaagtttctcagattgtttctctctaggttttatgtgaagatatttctgtttcaaccataggccgcaaagcattgcaaatgtccacttgcagattctacaaaaagagtgtttccaaactgctcaatcaaaagaaaatttcagctttgtgagatgaacgcacacatcgcaaagaagattatcagaattcttctgtctagtttttatgtgaagatatttccttttccaccataggcctctaagcgctccaaatgtccacttcgagattctacaaaaagagtgtttccaaactgctcaatcaaaaaaaaggtttaactctgtgagataaatgcacacatcacaaagaagtttctcagatggcttctgtctagattttatgtgaggatatttccttttctaccatatgccacaaagttctccaaatgtccacttgcatattctacagaaagagtgtttccaaacggttcaatcaaaagataggttcaaatctgtgagatgaatgcacacgtcccaaagtagtttctcagaattcttctgtctagtttttatgtgcagatatttccttttccactgttggcctcaaagagctccaaatatccacttgcggattctacaaaaagagagcttcaagactgctcaatcaaaagaaaagtttaactccatgagatgaatgcacacatcacaaagaagtttctcagattgcttcagtctagactttatgtgaagatatttccttttctactacaggccacaaagcgctccgaatgtgcacttgcagattctacaaaagagtgtttccaacctgctgtatcaaaataaagtttcaactgtgggagatgaaagcacgcatcacaaagaagtttttcagaattcttctgtctagtttttatgtgaagagatttccttttctaccacaggcctaaaagggctccaaatgtccacttgcagatactacaaaaagagagtttcaaaactgctcaataaaaagaaaggtttaactctgtgagatgaatgaacacatcacaaagaagtttgtcagattgcttctgtctagattttatgtgaagatatttccttttctaccataggccgcaaagcgctaaaattgtccacatgtagattctgcaaaaagagtgtttccaaacagcccaatgaaaagaaactttcaactctgtgtgatgaacgcacgcatcacaaagtgatttcacagtattcttctgtctagtttttatgtgaagatatttccttttccaccacagttctcaaagagcttcaaatgtcgacttgcagattgttcaaaaagtgtttccaaactgctcgatcaaaaaaagtttaactctgtaagatgaacgcacacgtcacatagatgtttctcagttttcttctgtctagtttttatgtgaatgtatttcattttccacagtaggcctcaaggggcttgaaatgtccacttgcagattccacaaaaagagtaataaataactggcccatcaaaagaaagattcaaatctgggagatgaacgcacatatcacaaagtagtttctcatattgattctatctagtttttatgtgaatatatttccttttccaccgtaggtctcaaaccgctccaaacgttcacttgcagaatctacaaaaagagagtttcaaaactgctcaatcaaaagaaaggtttaactttgtgagatgagcgcgcacatcacaaagaagtttcccagattgcttctgtgtagattttacgtcaagatatttccttttctaccattggctccaaagtgctacaaatgtccacttgcagattctacaaaaacagtgttttcaaacggctcaataaaaagaaaagttcaactctgtgagatgaacgcacacatcacaaagaagtttctcagaattcttctgtctagttcttatgtgaagatatttccttttccaccattgaactcaaagcactgcaaatgtccacttgcagatcctacaaaaagagagtttccaaactgctcaatcaaaagaaaattttaactctgtgagatgaatgcacacaacacacagaagtttctgagattgcttctgtctagattttatgtgaagatatttcctgttcttccataggccacaaagccctccaaatgtccacttgcaggttcgacaaaaagagtggttgcaaactgcttaatcaaaagaaaggttcaactctgtgagattaatgcacgcatcacaaagaagtttctcagaattcttctgtctggtttttatgggaagatatttccttttccaccattggactcaaagggctccaaaagtccacttgcagattttacaaaaacagagtttcaatactcctcaatcaaaagaaagttttaactctctgggatgaatgcacatatcacaaagatgcttctcagattgcttctgtcaagattttatatgaagatatttccttttctaccatagggcacaaagcactccaaatgtccagttgcagattctacaaaaagagagtttcaaaactgctaaatcaaaagaaacttttaattctgtgggatgaatgcacacatcacaaagaagtttctcagattgcttctgtctagactttatgtgaagatatttccttttctaccattggccgcaaagctctccaaatgtccacttgcagattctacaaaaagagtgtttccaaactgctcaatctaaggaaagtttcaactctgtgagatgaacgcagacatctcaaagaagtttctcagaattcttctgtctagtttttatatgaagatattaacttttccaccacatgcatcaaatcgctccaaatgtccacttgcagattctacaaaaagagagtttcaaatctgctctatcaaaagaaagctttacctctttgagatgaatgcacacatcacaaagaagtttcacagattgcttctgtctacaatttatgtgaagatatttcctgttgtaacataggcctcagagcgctccaaatgtccacttgcagattctaccaaaagagtgtttccaaactgctcattcaaagaaatgttcaactttctagatgaatgcgcacatcataaagaactttctcagaattcttctttctagtttttatggaagatatttcctttcgtaccgtagacccgaaggcactcaaaatgtccacttgcagattctacaaaaagagtatttcaaaactggtccttcaaaggaatgttcaaatctgggggttgaatgcacacatcacaaagtagtttctcagaatgcttctatgtactttttatgtgaagatatttcatttttcaccataggcctgaacgcccttcaaatgtccatttagagattatacaaaaagggagttttaaaactgctctatcaaaagaaaggtttcaatccgttagatgaatgcacacatcacaaagatgtttctaaaaatgcttctatttattttttatgtgaagatatttccttttccaccgtaggcctcaaagcgctccaaatgtccacttgcagattccacaaaaagagagtttcaagactgctcaatcaaaagaaacgtttaactctgtgagatgaatgcacacatcataaagaaggttttcagattacttctgtctacatcttatgtgaagatatttccttttccaccataggctgcaaacagctccaaaggtccacttgcagattcttcaaaaagagtgtttccaaactgctccatcaaaagaaatgttcaacttcgtgagctgaatgcacacatccaaagaagtttgtcataattcttctgtctagtttgtatttgaagataattccttttccacaataggcctcaaagccttcaaaatgtccacttgcagattctacaaaaagagagtttccaaagtgctcagtcaaaagaaaggtttactctgtgagatgaatgcacacaccacaaagaagtttgtcagattgcttttatctagattttatgtgaagatattttcttttctaccataggccacaaagcgctccaaatgtccagttgcaaattctacaaaaagagtctttccaaactgctcaatcaaaagtaaagttcaaccctgtcatatgaacacacacatcacaaagtagtttctcagaattctgctgtctactttttatgtgaagatatttccttttccatcataggcctcatggcgctccaaatgtccacttgcagattttacaaaaagggagtttcaagacagctccatcaaaagaaagttttaactctgtgagatgcatgcacacatcacaaagaagtttttcagattgcttctgtctagattttattttaatatatatccttttctaacgtaggcgacaaagtgctccaaatgtccacttgcagattctacaaaaagagtgattccaaactgcttaatcaaaagaaagtttcaactctgtgagatgaatgcacacatcacaaagaagtttctcagaattattctgtgtagtttttatctgaagatgtttccttttacaccataggcctcaaagcgctccaaatgtacactggcagattctacaaaaagagagtttcaaaactgcttaatcaaaataaatgtttaactctgtgagatgaatgcacacatcataaagaagtttgtcagactgcttttatctagattttctgtgaagatatttccttttctaccagaggtcgcaaagcgctccaaatgaccgcttgcagattctacaaaaagagtgcttccaaactgctcaatctaaagaaaggttcaactctgtgagatgcctcaaagcgctccaaatgttaacttgcagattctacaaaaagagagattcaaaactgctcaatcaaaacaaaggcttaactctgtgagatcagtgcacacatcacaaagaagtttctaagagtgcttctgtctagtttctatgtgaagatatttccttttccaccataagcctcaaagcgctccaaatgtccacttccacattcaacaaaaagagagtttcaaaactgctcaatcaaaagtaagagttaaccctgtgagatgaatgcacacatcccaaggaagtttctcacattgcttctgtctagattttatgtgaggatatttccttttctaacttaggctgcaaagcgcttcaaatgcccacttacagaatctacaaaaagagtgcttccataattcttaatcaaaagaaaggttcaactctgtgagatgaacgcacacatcacaaagaagtttctcagaattcttgtctctagtttttatgtgaagatatttccttttccaccataggcctaaaagcactccaaatgttcacttgcagattctacaaaaaaagagtttcaaaactgctcaatcaaaagaatgctttaactctgtgagatgaatgcacacatcacaaagaggtttctcacattggttctgtctagattttatgtgaagatatttccttttataacagaggcaacaaagcactccaatagtccacttgcagattctacaaaaagagtgtctgcaaactgctcaatcaaaaggaagttttaactctgtgagaagaacgtgcacatcacaaagaagtttctcaaaattcttctgtctagtttttatgtgaagatatttcctttcccactgtaggcctcaaagcactcaaaatgtccacttgcagattctacaaaaagagagcttcaaaactactcaaccaaaagaaaggtttaactctctgagatgaatgcacacatcacaaagaagtttctgagattgcttctgtctagattttatgtgaagatatttccttttctaccataggcaacaaagcactccaatagtccacttgcagattctacaaaaagaatgtttctaaactgctcaatcaaaaggaaggttcaaatttgtgagataaactgatacatcacaaaggagattctcagaattcttctgtcaagtttttatgtgaagatatttccttttccaccataggcctcaaaatgatccaaatgtccacttgcaaattctacaaaaacagagtttcaaaactgctcagtcaaaagaaagtttgaactctgtgagatgaatgcacacatgccaaagaagtttctcagattccttctgtctagatttttttgaagatattaccttttctaccatagtcctcatagcgctgcaaatgtccacttgcagaatctccaaaaagagtgtttccaaactgctgaatcaaaataaactttcaactatttgagttgaaggcacacatcacaaagaagattctgagaatacttctgtctagtttttatgtgaagatatttccttttccactatatgcccaaaagcgctacaaatgtccactagcagattctacaaaaagagtgtttcagaacttctcaatcaaaagaatggtttaactctgtgagttgaatgtacacatcac

SEQ ID NO: 2015 - DNA, 3625 bp, Homo sapiens
cacaaagaagtttctgtgaatgcttctgtctggcttttatgtgaggatattcccgtttccagcgaaagcctcaaagctgtccaaatatccagcttgaaaattctacaagaagagtgtttcaaaactgctccatcaaaacaaagtttaactctgtgagttgagtacacatatcaaaaagaagtttctgagaatgcttctgtctagtttttatacgaagatatttccttttccaccataggcctcaaagcgctccaaatgtcaacttgcagattctacaaaaagagagtttcaaacctgctctatcaaagaaatattcaaatatgtgaggtgaatgcacacagccaaaggaagtttctgagaaaacttctgtgtcgtgatcatgtgaaggtactcccgtttccaatgatgtcctcaaagtggcccaaataaccacttggagatactactaaaagagtgtttcaaaactgctctaggataaagtatgttcaactctgagaattgaaggcaaacatcacaaagaagtttctgagaatgctgctgtttagttttaatgtgaagatatttccttttccaccatagacatcaaatcgctcataatgtccacttgcagattctgcaaaaagagtattaaacctgctctatcaatagaagggtcaactctctgagttgaatgcacacatcaaactgaattttcctagaatgcttctgtctagtttttatgtgaagaaacccccgtttccagggaaggcctcaaagctgtccaaatatccacttgcaaattctacaaaaagagtgtttcaaatctgctccatcaaaagaaaatttcaaatctgtgagttgaatgcacacagcacaaagacgtttttgagaaagcttcattgtgtgaagatactcccgtttccaacgaaagcctcaaagccgtccaattatacacttgcagatactactaaaagagtgtttcaaaactgatctatgataaagtatgttaaactctgagagttgaatgcaaacgtcacaaataagtttatgagaatgcttctgtctagtttttatgtgaagatatttccttttcctccataggccacaaagcgctcctaatgtccacttgtagattccgcaaaagagtgtttcaaacctgctctataaaaagaaaggttcaactctgtgagttgaatacacacagcacaaagaaatttctgagaaagcatcattatataaagatactcccgtttccaatgaaggcctcaaagccctccaattatccacttgcagatactactaaaagagtgtttcaaaactgctctatgataaagtatgttagactctgagaggtgaatgcaaacgtcacaaataagtttatgagaatgcttctgtctagtttttatgtgaagatatatccttttccaccatatgccaaaaagagctccaaatgtccacttgcggatcctgcaaaaagagtgtttcaaccctgctctatgaaaaggaaggttcaactctgtgagttgaatggacacatcacaaagtagtttctgagaatgcttctgtctagtttttatgtgaagatattcccgtttccaacgaaggcctcaaagcggtccaaatatccacttgcagattctacgaaaatagtgtttcaaaactactctatgaaaagggaggttcaactctgtgagttgaatgcaaacatcacaaagaagtttctgacaatgcttctgtctagtttttatttatagatatttccttttccaccatagacctccaagctctccaaatgtctgcttgcagattctacaaaaaaagtgcttcaaacctgctctatcaaaagaaaggttcaattctgtgagtgaaatgaacacatcacaaagaagtttctgagaatgattctgtctagtgtttatgtgaagatatccccttttccaacgaaggcctcaaagtggttcaaatatccacttgcagattctacaaaaagagtgtttcaaacctgctttattaaaggaaagcttcaactctgtgagttgaacgcacacatcacaaagaagtttctgagaatgcttctatctagtgtttatttgaagatattcccgtttccaacgaaggcttcaaagcgttccaaatatccacttgcagattctgcaaaaagagtgcttcaaaactgctctatgaagaggcctcaaagcttgccatatgtccacttgaagattctgcaaaaagacggtttcaaacctgctctatgaaaagaaaggttcaactctgtgagttgaatgcacacatcacaaaggagttgctgagaatgcttctgtctagtgtttatgtgaagataatccccttgccaaggaaggcctcaaagcagtgcaaatatccactctcagattctactaaaagagtgtttcaaaagtgctctatgataaggtatgttcaactctgtgaattgaatgcacacatcataagaactttctgagaatgcttctgtctggtttttatgggaagatatttccttttccaccataggcctcaaagcactccaaatgtccacttgcagattctggaaaaagagtgtttcaaacctgctccatcaaaagaaaggtacaactccgtgagttgaatgcacacagtacaaaaaagtttttgagaaagcttctatctagtgattatgtgaagatatttccatttccaatgaaggcctcaaagcggtccaaatattcacttgcagattctacaaaaagagtgtttcaacactgctctatcaaaaggcctcatagctctaaaaatgtccggtgccgattctacaaaaagagtgtttcaaacatgctctatcaaaagaaagtttcaactctttgagttgaatgcacacatcacaaagatgtttctgagaatgcttctgcccgtttttgtgtgaacataatcccgtttccaacgaaggcctcaaagcgttccaaatatccacttgcagaatctaggaaaagagtgtttcaaaactgttctatgaaaaggtacgttcaactctgagttgaatgcaaacatcacaaagaagtttctgagaattcttctctctaatttttatatgaagatataaccttttacaccataggcctcaaagctctccagatatccacttgcagattctactaaaagagtatttcaaagctactctatcaaaagaaaggttcaactctttgagtttaatgcacgcatgacaaagaagtttttgagaatgcttctgtctagtgtttatgagaagatatttccatttctaacgaaggcctcatagcggtccaaatatccacttgcagattctacaaaaagagtgtctcaaaactgctccatggaaaggtatcttcaactttgtgagttgaatgcaaacatcacaaagacgtttctgagaatgcttctgtctagtttttgtgtgaagatatttccttttccaccataggcctcaaagctctccaaatgtccatttgcagattctacaaaaagagtatttcaaacctgctatatcaaaagaaaccttcaactctttgtgttgaatgaacacatcacaaagttgtttctgagaatgcttctgtctagtttttatgagaagataattccttttccaccataggcctcaaagctctccaaatgtcca

SEQ ID NO: 2016 - DNA, 6768 bp, Homo sapiens
acattacaaagaagtttctgagaatgtttctgtctggtttttatgtggagataatcccgtttccagtgaaggcctcaaagctgttcaaatatccacttgcaaattctacaaaaagagtgtttccaatctgctatatcaaaatagagtttcaacactgtgggttgaatgcacacatcgcaaagaagattctgagaatgcttctatttttcacatgaagacattcccgtttccaatgaaagcctcaaagctgtctaatatccacttgcaaattctacaaaaatagtgtttcaaaactgctctatcaaatgagtggttcaactctgggagttgaatacactcatcacaaagaagtttctgagaatgcttctctctagtttttatgtgaagatatttcctttttcaccataggcctcaaagagctccaaatatccagttgcagattctacaaacggtgtgtttcaaaactgctctatgaaaaggcatgttcaactctgtgagttgaatggaaacatcacaaagaaatttctgagaatgcttctgtctagtttttatgtgaagctactcgcgtttccagcgaaggcttcaaagctgtccaaatatccacttgtaaattctgcaaaaagagtgtttcaaagctgctctaacaaagtaaagattcaactctttgagttgaatgcgcaaatcacaaagaagtttctgtgaatgcttctgtctggcttttatgtgaggatattcccgtttccagcgaaagcctcaaagctgtccaaatatccagcttgaaaattctacaagaagagtgtttcaaaactgctccatcaaaacaaagtttaactctgtgagttgagtacacatatcaaaaagaagtttctgagaatgcttctgtctagtttttatacgaagatatttccttttccaccataggcctcaaagcgctccaaatgtcaacttgcagattctacaaaaagagagtttcaaacctgctctatcaaagaaatattcaaatatgtgaggtgaatgcacacagccaaaggaagtttctgagaaaacttctgtgtcgtgatcatgtgaaggtactcccgtttccaatgatgtcctcaaagtggcccaaataaccacttggagatactactaaaagagtgtttcaaaactgctctaggataaagtatgttcaactctgagaattgaaggcaaacatcacaaagaagtttctgagaatgctgctgtttagttttaatgtgaagatatttccttttccaccatagacatcaaatcgctcataatgtccacttgcagattctgcaaaaagagtattaaacctgctctatcaatagaagggtcaactctctgagttgaatgcacacatcaaactgaattttcctagaatgcttctgtctagtttttatgtgaagaaacccccgtttccagggaaggcctcaaagctgtccaaatatccacttgcaaattctacaaaaagagtgtttcaaatctgctccatcaaaagaaaatttcaaatctgtgagttgaatgcacacagcacaaagacgtttttgagaaagcttcattgtgtgaagatactcccgtttccaacgaaagcctcaaagccgtccaattatacacttgcagatactactaaaagagtgtttcaaaactgatctatgataaagtatgttaaactctgagagttgaatgcaaacgtcacaaataagtttatgagaatgcttctgtctagtttttatgtgaagatatttccttttcctccataggccacaaagcgctcctaatgtccacttgtagattccgcaaaagagtgtttcaaacctgctctataaaaagaaaggttcaactctgtgagttgaatacacacagcacaaagaaatttctgagaaagcatcattatataaagatactcccgtttccaatgaaggcctcaaagccctccaattatccacttgcagatactactaaaagagtgtttcaaaactgctctatgataaagtatgttagactctgagaggtgaatgcaaacgtcacaaataagtttatgagaatgcttctgtctagtttttatgtgaagatatatccttttccaccatatgccaaaaagagctccaaatgtccacttgcggatcctgcaaaaagagtgtttcaaccctgctctatgaaaaggaaggttcaactctgtgagttgaatggacacatcacaaagtagtttctgagaatgcttctgtctagtttttatgtgaagatattcccgtttccaacgaaggcctcaaagcggtccaaatatccacttgcagattctacgaaaatagtgtttcaaaactactctatgaaaagggaggttcaactctgtgagttgaatgcaaacatcacaaagaagtttctgacaatgcttctgtctagtttttatttatagatatttccttttccaccatagacctccaagctctccaaatgtctgcttgcagattctacaaaaaaagtgcttcaaacctgctctatcaaaagaaaggttcaattctgtgagtgaaatgaacacatcacaaagaagtttctgagaatgattctgtctagtgtttatgtgaagatatccccttttccaacgaaggcctcaaagtggttcaaatatccacttgcagattctacaaaaagagtgtttcaaacctgctttattaaaggaaagcttcaactctgtgagttgaacgcacacatcacaaagaagtttctgagaatgcttctatctagtgtttatttgaagatattcccgtttccaacgaaggcttcaaagcgttccaaatatccacttgcagattctgcaaaaagagtgcttcaaaactgctctatgaagaggcctcaaagctcgccatttgtccacttgaagattctacaaaaagagggcttcaaacctgctctatgaaaagaaaggctcaactctgttagttgaatgcacacatcacaaagaagttcctgagaatgcttctgtctagtgtttatgtgaagataatcccgttgccaatgaaggcctcaaagcagtgcaaatatccacttgcagattctacaaaaagagtgtttcaaaagtactctatgataaggtatgtccaaccttgtgatttgaatgcacacatcataagaagtttctgagaatgcctctgtctagtttttaatgggaagatatttccttttccaccataggcctcaaagcgctccaaatgtccacttgcagattctagaaaaagagtgtttcaaacctgctctatcaaaagaaaagttcaactctgtgagttgaatgcacacagttcaaaaaagtttttgagaaagcttctgtctagtgattatgtgaagatattcccgtttccaacaaaggcctcaaagcggtccaaatgttcacttgcagattctacaaaaagagtgtttcaaaactgctctatcaaaagaaaggtacaactctgtgagtagaatgcacacatcacaaagtagtttctgagaatgcttctctctagtttatatgtgagatatttacttttccacgataggcctcaatgctctccaaatgtccacttgcagattctacaaaaagagtgtttcaaacatgctctatgaaaagaaagtttcaactcttggggttgaatgcacacatcacaaagaagtttctgagaatgcttctgcctgtttttgtgtgaacatattcccgtttccaactaaggcctcaaagcgtttcaaatatccacttgcatattctacaaaaagagtgtttcaaaactgctctatgaaaaggtatcttcaaatctgtgagttgaatgcaaacatcgtaaagaattttctgagaattcttctctcttatttttatatgaagataattccttttccaccataggcctcaaagctctccaaatgtcaacttgcagattctacaaaaagagtgtttcaaagctgctctatgaaaagaaaggttcaactctttgagtttaatgcacgcctgaaaaagaagtttttgagaatgcttctgtctagtgtttatgtgaagacattcccgtttccaacgaaggcctcatagcggtccaaatatccgcttgcagattctataaaaagagtgtctaaaaactgctccaaggaaaggtatcttcaactctgtgagttgaatgcaaacatcacaaagacgtttctgagaacgcttctgtctagtttttgtgtgaagatatttccttttccaccataggactcaaagctctccaaatatccacttgcagatactaagaaaagaatgtttcaaacctgctctatgaaaagagaggttcaactctgtgagttgaatgcacacaccacaaagaagtttctgagaacgcttctctctagtttttatgtgaagatacttccttttccaccataggcctcaaagctctccaaatgtgcacttcagattctacaaaatgaatgtttcaaacctgctctatcaaaagaaaggttcaactctgtgagttgaatgcacacatcacaaataagtttatgagaatgcttccgtctagtttttatgtgaagatatatcctttttcaccataggcctcaaagagctccaaatatccacttgcagatcctgcaaaaagagtgtttcaaccctgctctatgaaaagaaaggttcaactctgtgagttgaatgcatacatcaaaagtagtttctgagaatgcttctgtctagtttttatgtgaagatattcctgtttccaacgaaggcctcaaagcagtccaaatatccacttgcagattataagagaagagtgtttcaaaattgctctatgaaaagggaggtttaactctgtgagttgaatgcaaacatcacagagaagtttctgagaatgcttctgtctagtttttatttatagatatttccttttccaccataggcctcaaagctctccaacagtcaacttgcagattctacaaaaaaagtgtttcaaacctgctctatcaaaagaaaggttcaattctgtgagtggaatgcacacatcacaaagaagtttctgagaacgattctgtctagtgtttatgtgaagatatctccttttccaatgaaggcctcaaagtagttcaaatatccacttgcagattctacaaaaagagtgtttcaaacctgctctatcaaaagaaagcttcaactctgtgagttgaatgcacacatcacaaagaagtttctgaaatgcttctatctagtgtttatttgaagatattcccgtttccaacgaaggcttcaaagcattccaaatatccacttgcagattctgcaaaaagagtgcttcaaaactgctctatgaagaggcctcaaagcttgccatatgtccacttgaagattctgcaaaaagacggtttcaaacctgctctatgaaaagaaaggttcaactctgtgagttgaatgcacacatcacaaaggagttgctgagaatgcttctgtctagtgtttatgtgaagataatccccttgccaaggaaggcctcaaagcagtgcaaatatccactctcagattctactaaaagagtgtttcaaaagtgctctatgataaggtatgttcaactctgtgaattgaatgcacacatcataagaactttctgagaatgcttctgtctggtttttatgggaagatatttccttttccaccataggcctcaaagcactccaaatgtccacttgcagattctggaaaaagagtgtttcaaacctgctccatcaaaagaaaggtacaactccgtgagttgaatgcacacagtacaaaaaagtttttgagaaagcttctatctagtgattatgtgaagatatttccatttccaatgaaggcctcaaagcggtccaaatattcacttgcagattctacaaaaagagtgtttcaacactgctctatcaaaaggcctcatagctctaaaaatgtccggtgccgattctacaaaaagagtgtttcaaacatgctctatcaaaagaaagtttcaactctttgagttgaatgcacacatcacaaagatgtttctgagaatgcttctgcccgtttttgtgtgaacataatcccgtttccaacgaaggcctcaaagcgttccaaatatccacttgcagaatctaggaaaagagtgtttcaaaactgttctatgaaaaggtacgttcaactctgagttgaatgcaaacatcacaaagaagtttctgagaattcttctctctaatttttatatgaagatataaccttttacaccataggcctcaaagctctccagatatccacttgcagattctactaaaagagtatttcaaagctactctatcaaaagaaaggttcaactctttgagtttaatgcacgcatgacaaagaagtttttgagaatgcttctgtctagtgtttatgagaagatatttccatttctaacgaaggcctcatagcggtccaaatatccacttgcagattctacaaaaagagtgtctcaaaactgctccatggaaaggtatcttcaactttgtgagttgaatgcaaacatcacaaagacgtttctgagaatgcttctgtctagtttttgtgtgaagatatttccttttccaccataggcctcaaagctctccaaatgtccatttgcagattctacaaaaagagtatttcaaacctgctatatcaaaagaaaccttcaactctttgtgttgaatgaacacatcacaaagttgtttctgagaatgcttctgtctagtttttatgagaagataattccttttccaccataggcctcaaagctctccaaatgtcca

SEQ ID NO: 2017 - DNA, 2087 bp, Homo sapiens
ctgctctatgaaagggaatgttcaactctgtgagttgaattcaaacatcacgaaggagtttctgagaatgactctgtgtagtttttatgtgaggatattcccgtttccaacgaaggccacaaagcgctccaaatgtcctcgtgcagattccacaaaaagagtgtttcaaaactgctctatcaaaataaaggttcaactctgtgagttgagttaacacttcacaaataagtttctgagaatgcatctgcctagtttttatgttaagatatttcctttttcaccataggcctcaaagcacaccaaatatccacttgcagattctacaaagagagtgtttcaaaactgctctatcaaaagaagggttcaactctgtgagttaaatgcacacatcacaaagaagtttctgacaatgcttctgtatagttttcatgtgaagatactcccgtttccaaagaaggtcacaaagcactccaagtgtccacttgcagattccacttaaagagtgtttgacaactgctctatcaaaagaaaggttcaactctgtgagttgagtacacacatcacaaagaagtttctgagaatgatcctgtctagtttttatgtgaagatatttcctttttcaccataaaccaaaaacacaccaaatgtccacttgcagattctacaaagagagtgtttcaaaactgctctatcaaaagaagagttcaaatctgtgagttgaaaggacacatcagaaagaagtttctgataatgcttctgtctagtttttatgtgacgatattcccatttcgagcgaaggcctcagagcgctccaaatgtccacttgcagattctacaaaaggagtgtttcaaatctgctctatgaaaaagaattttcaactctgtgagttgaatgtacacatcacagagaagtttctgagaatgcttctgtctaatttttatttgaagatattttctttatcaccataggactcaaagtgctccaaatgtcgacttgcagatactataaaaagaatgtttcaaaactactctatgaaaacgaatgttcaactctttgagtttaatccaaacatcagaaagatgtttccaagaaatcttctgtctagtttttatgagaagatactcccgattcaagtgaaagcctcaaagttgtcgaaatatccacttgcaaattccacaaaagcagtgtttcaaatgaaaataaaagtttcaactctgtgagttgaatgcaaacatcgcaaagaagtttctgagaatgcttctgtctagttttttgtgaagttattcccgtttccaatgaaggccacacagcactccaaatgtccacttgcagattccacaaaaagagtgtttcaaaactgctctgtgaaaagaaaggttcaactctgtgagttgagtgcacacatcacaaacaagtttttgagaatgcttctgtctagtttttatgtgaagatattcccgtttccaatgaaagcctcaaacctgtccaaatattcatttgcagtttccacaaagacagtgtttcaaaactgctttatcaaaagaaagattcaactctgtgagttgagtacacacatcacaaagaggtttctgagaatgattctgtacagtttttatgtgaagatattcccgtttccaacgaagacttcaaagcgttccaaatgtccacttgcagattctacaaaaagactgtttaaaaacgctccatcaaagaaaattttcaactctttttgttgagtgcgcacatcacaaagatgtttctgataatgattctgtctagtttttatgtgaagatatttcctttttctccagaggcctaaaagtgctccaaatgtccactagcagatactacaaacagagtgtttcaatactgctctattgaaaggaatgttcaactatgtgagttgaatgtaaacatcacaaagatgtttttgagaatacttccgtctagtttttatgtgaagataccccggtttccagcgaaggcgacaaagctgtccaaatatccacttgcaatttctacaaaaagagtgtttcaaatctgctctatcaaaagaaagtatcaactctttgagttgaatacacac

SEQ ID NO: 2018 - DNA, 3332 bp, Homo sapiens
ctcgaagctgtccaaatatcaacttgcaaattctacaaaaagagtttttccaatctgctctatgaaaagaaaagttcaactctgtgagtttaatgcacacgttgcaaagaagtttctgagaatgtttccgtctggtttttatgagaagatatttcatttttcaccataggcctcaaagcgctccaaatgtccacttccagatgttacaaaaagagtgtttcaaacctgctctgtgaaaaggaatgttcaactcggtgaaatgaatgcaaacatcacaaagaagtttctgagaattcttctgtctatttttttgtgtgaagatatttctttcccaccatactcctcaaagctctccaaatgtccactttcagattccacaaaaagggagtttcaaaactgctctgtcaaaagaaaggttcaactctgtgagttgagtgcacacatcacaaacaagcttatgagaatgcttctgactagtttttattttaagatatttcctttttcaccataggcctcaaagcacaccaaatgtccacttgcagattctacaaagacagtgtttcaaaactgctgtatcaaaggaggggctcaactctgtgagttgaaggcacacatcacaaagatgattctgataatgattctgtctagcttttatgtgaagatattccctttttgaacgaaggcctcaaagcgctccaaatgaccacttgcacattctacaaaaagagtgtttcaaaactgctctatgaaaaggaatgttcaactctgtgagttgaatgcaaacatcacaaagaagtttctgagacagcttctgacttgtttttatgtgaaaatattcccgtttccaatgagagcctcaaatctctccaaatatcaacttgcagatcgtacaaagagtgtttcaaaatttccctatcaaaagaaatgttcaactctgtgagttgaggacacacatcacgaagaagtttcttagaatgcttctgtcttgtttttatgtgaagatattcccgtttcctgtgaaggcctcaaatttgtccaaatacccacttgtaaatactacaaaaagagtgtttccaatctgctctatcaaaagaaaggtttaactctgtgagttgactgcacacatctcaaagaagtttctgagaatgcttctgtctagttttcatatgaagacatttcctttttcactgtaggtctcatagcacaacaaatgtccacttgcagattctacaaagagagtgtttcaaaactgctctataaaaagaaaggttcatctctctgacttcactacacacatcacaaagaagtttccgaggatgcttctgtctagttttcatgtgaaggtatttcctttttcgccataggcctcaaagccccccaaatatccacttccagatactacaaaagagtgtttcaaaactgctctatgaagaggaatgttcaattctgtgagttgaatgcaagcatcacaaaaagttactgagaatgcttctgtctagtttttttgttaagatatttctttttcaccatagacctcaaagcacacccaatgtccacttgcagatctacaaagagagtgtttcaaaactgctctatcaaaagaagggttcaactctgtgagttaaatgcacacatcacaaagaagtttctgacaatgcttctgtatagttttcatgtgaagatactcccgtttccaaagaaggtcacaaagcactccaagtgtccacttgcagattccacttaaagagtgtttgacaactgctctatcaaaagaaaggttcaactctgtgagttgagtacacacatcacaaagaagtttctgagaatgatcctgtctagtttttatgtgaagatatttcctttttcaccataaaccaaaaacacaccaaatgtccacttgcagattctacaaagagagtgtttcaaaactgctctatcaaaagaagagttcaaatctgtgagttgaaaggacacatcagaaagaagtttctgataatgcttctgtctagtttttatgtgacgatattcccatttcgagcgaaggcctcagagcgctccaaatgtccacttgcagattctacaaaaggagtgtttcaaatctgctctatgaaaaagaattttcaactctgtgagttgaatgtacacatcacagagaagtttctgagaatgcttctgtctaatttttatttgaagatattttctttatcaccataggactcaaagtgctccaaatgtcgacttgcagatactataaaaagaatgtttcaaaactactctatgaaaacgaatgttcaactctttgagtttaatccaaacatcagaaagatgtttccaagaaatcttctgtctagtttttatgagaagatactcccgattcaagtgaaagcctcaaagttgtcgaaatatccacttgcaaattccacaaaagcagtgtttcaaatgaaaataaaagtttcaactctgtgagttgaatgcaaacatcgcaaagaagtttctgagaatgcttctgtctagttttttgtgaagttattcccgtttccaatgaaggccacacagcactccaaatgtccacttgcagattccacaaaaagagtgtttcaaaactgctctgtgaaaagaaaggttcaactctgtgagttgagtgcacacatcacaaacaagtttttgagaatgcttctgtctagtttttatgtgaagatattcccgtttccaatgaaagcctcaaacctgtccaaatattcatttgcagtttccacaaagacagtgtttcaaaactgctttatcaaaagaaagattcaactctgtgagttgagtacacacatcacaaagaggtttctgagaatgattctgtacagtttttatgtgaagatattcccgtttccaacgaagacttcaaagcgttccaaatgtccacttgcagattctacaaaaagactgtttaaaaacgctccatcaaagaaaattttcaactctttttgttgagtgcgcacatcacaaagatgtttctgataatgattctgtctagtttttatgtgaagatatttcctttttctccagaggcctaaaagtgctccaaatgtccactagcagatactacaaacagagtgtttcaatactgctctattgaaaggaatgttcaactatgtgagttgaatgtaaacatcacaaagatgtttttgagaatacttccgtctagtttttatgtgaagataccccggtttccagcgaaggcgacaaagctgtccaaatatccacttgcaatttctacaaaaagagtgtttcaaatctgctctatcaaaagaaagtatcaactctttgagttgaatacacac

SEQ ID NO: 2019 - DNA, 219 bp, Homo sapiens
gggacttttggagcactttgaggccattgttgaaaaaggaaatatcttcacataaatactagacagaagcattctcagaaacttctttgtgatgtgtacattcaactcacagagttgaacattactttccatggagcagttttggaacactctttttgtagtatctggaagtggatattttgaacgctttgaggcctatgatgaaaaaggaaatatctt

SEQ ID NO: 2020 - DNA, 9562 bp, Homo sapiens
gcctcccaaagtgctgggattacaggcgtgagccaccgcacctggcccagacactgtaagttttggggaggattaaatgggatcatccatgtaaatgcgcctatcccagtctctagcacacactgaacactcaaaaatgggaggttttggtatttcagaagaaaatcaggtgtcggggagtgttagtagtaaccttgaactatatgcaaagactaaagctaggaagataggaagagttttacaagatccttttggctatatagttaaagttattagcagttagagtttcccttacagttgacaagtgaaccatacaagtgaatgacttgtggttcctcagataaaagcacgagtcagagttgtaatttctgttttgtggacgtaattgttgaccaagtgcactgaaggtagggatggccagtaacaaaattataaagcaggcctgtttgtcttcaaacactcctgagtaaacttgtcatttccttgtaaaaatgcaaaatagactactgagtagaggtgatcaattacagaaatgcacttactttggctttcttctgaaacctaataaaatgacagtaaagggattatttttttaaggcagaaacccacaatgatgatgaaattagaaaggaagacaagaacaacaaggttgtggaattcagaagccatatagacaagaggtaacacacctgagaaagatgatccctaaatttgtcttggagaaaactcagaagtacctgactacatcatagacctcccaaacagcttccaaatgtcagataccactgaaaatggggataaaggtagggtcaaaaataggaggattgggttataagtctgtataagaagttgttagatccctacatcctctcttcaaacctgtatagccagataatggtccctctcccagcctggcagaggctggaaaaggtaaatagagaaacttacttcctggagaacatttggcacatttggggatggagttcagtaatataaatgaaggggtagtgaaaatttatgggaacatttataagctaacagaaccccatgtcttttaccccattctaattccagaccactagagattagaaaattattctctggggtatctgaccacttccagaggaaagacataaagatgctgatgtcgagaatgacccaactaaatggcccagccagatgacccagttgaagctggtggacaagaagtttcattcatggaatcagaacttccaataaggtcttttagtacctcactcctaaatttgaatagactaccaaagattatcagacatctaaggggaactaccagcatgaaaggtagagaccaaagcaaacaaacaaacaaagaaaataatttggaactaaccaagactatgctgggagaagaaaactattattaatatccacagagcgtagtacagccactatggagaacagtatggaggttcctgtaaagactaaaaatagaaccatcatataattcaacaatcccactgctagatatataccccaaagaaaggaaatcagtatattgaaaagatatctgcactctcatgtttactgtagcactattcataatagccaagatttggaagcaacttaagtgtccatcaacagatgaatagatttttttaaaatgtggtacatatacacaatggagtactattcagccataaaaaagaatgagaaatgtcatttgcaacaacatggttggaactggaggaccttatgttaagtgaaataagccaggcccaaaaaaacaaatttcacatgttctcactcatttgtgggacctaaaaatgaaaacagttgaactcagggagatagagtaggatgatggttaccagaggctggaagggtagttgtggtgggaggtgggtggttaatgagtacaaaaatatagttagatagaatgaataaatctaatagttgctagcacaacagggtgactacagtcaacaataatttaccatacatttaaaataactaaaagagtataattggcatgttagttacacaaaaaaaggataaatgcttgaggcaacggatataccatttacctgaatttggttatcacacattgtatacttgcattaaaatgcctgccgggcacatggctcatgcctgtaatcccagcactttgggaggctgaggcgggcagatcacctgaggtcgggagtttgagaccagcctgactaacatggagaaacccatctctactaaaaatacaaagttagctgggcatggcggctcattcctgtaatccaagctactcgggaggctgaggcaggagaatcacttgaacctgggaggcggaggttgcagtgagccgagaccgcaccattgcactccagcctgggcaacaagagcaaaactccgtctcaaaaaaaaaaaaaaaaacttatgttccccataaatataaatacctattatgtaccaataaaagtaaaaagtaaaaagtttcaattgattcacaactttaaaaaatatccacagaggcgtaagaggagatattgtattgcacccacgaaccagtcttatgctatttcagaaagggacattcaagaaacaaaaagggagctcttggaaatttgaacaataaataatagtagaataaaaaattcagagaaagtttggatgataaatttgagccaatctcccagtaagcagagcaaaaatatagaaaatgagagttagaaaagaaaaagaaaaaaattaaaggactaaaataagaagtccaacatctaaataagaggagatccacaaagagcaacagagataagagaagaaaggaaataatcaataaaataattcaagaaaatccaaggacatgagttctcagattgtaagagactacttgagtgaaaaaaaaaaaaaaagaatggagttagacccatcccaaggcacattatttgtgcgattttaaaataccgatatattagtttgctagagctgcagtaacaaaacaccacagactgggtggcttgaacagcagaaatttgttttctcatggttctggatgctagaagtctaagatcgaggtgacagcagtttcgtttttcctgacgcttctctccttagctcacagatggctgccttctagttgtgtcctcatactgtcttcccttggtcagtgttgtctgtgtcctcgtctcctcttcttaaagggacaccagtcatattaggttaagaattgcccattagacctcattttaccttaattacctctttaaaggccccacgtctaaatacagtcatattctaaactactgggggttagggcttcactgagtgaattttggtggaaagtggggcaggggacacaattcagcctacaaaaactggaaacaaagtgaaaatcctatgtgtttccgtgctcagaagacaggaagtactcatacccaagagtcaataattaaactggtttctcaccagcaatttgggagactggaagttggaagacacagagcagtgcctaccacattcaaaagagaaaagaggccaggcatggtggctcacgcctgtaatcccagaactttaggaggcgaggaggatggatcaccaggtcaggtgttcaagaccagcctgaccaacatggtgaaacgctgtctctactaaaaatacaaaaattagccaggcgtggtggcgcatgcctgtaatcccagctactcagaaggctgagacagaagaatcacttgaacccaggaggtggaggttgcagtgagccgagatcatgccactgcactccatcctgggtgacagaatgagactccgtctcaaaaaaaaaaaaaaaaaaaagagagagaaaagaattccaacccagaattctcaacttcactgtgtcagaggatatgaagtaaacaaatattcatctctacatttgccagtccctgtggacttaggccagatagtataaataatagtcacaaaaggagtatgaatgggataagaagccacttctagtctgagacaattaagagtagtagtgccttctctgcactctcaccccctcattctgacagctgaagtgaaggactcccaacttctggaactgcccaatgaaagtagccttgtgtgagtgttagctggcctgctttggtctgggatgcaagtagaaataaactcctctcatattaagccactaagactttagggatatgttgctgtagcatagcctaatgtagcctgattactgaacgagccaccccatcaactgaatctatgtatatactaaaaacattttaagatatgcaaggtctcaaagagttcactcgatgcacactttttctcaggaagctactagaggatgtgctccacaaaaaataaaggtataaattgtgaaagaggaaaacataggatttaggaatcaagggaattcagcacaagacagaagaaaagggaatctgcagcaagatccctgagctgtgcatgtaacataaagggcaacaatttccaacacagagcagatcacaagaccctaggatagatttcttgaagaaaatgaaattaaaagaatactggattcatctgaacatatgaaaaggagatttaagcaactttttaagagcttgggaatgaattaatgataatatatatggtattatgcaaccaaaactacaataaaaactcattaaaaattataactcataaaattattaatttcagggaaaataaaaagttgagtaggaatgaaaaaagaatcagaggatactataaagctcatctgtggatattgtttacatagtcatgataatgaaaaagaaataatctaaccaaaattaaacgttggaagtgtggggagatagaaatggtagagtgtattcggtatttatgtgttggggaggatacctgtaactttaacattagtgagctttactttactaaggctaaataaacaaactcaagtgtccagaaaggctagagaagaagcttacaagaatgaagctattgtggtgtgattcaatagggaataggtggggccttggcaacatcaatttgtagtatccctgccaattgatactacaacatcaatttgtagtatccctgccaaaatttaactatggaaaatagttaaattttaatatgcacacatctgtggttgtggttatacagatatatatatatatatatatatatataaaataaaaatttatatataaataaatacataaacaaactcaagtgtccaacagggctagataaggagcttacaagaatgaagcagttgtgatgtgattcaatagggaataggtggggccttggcaaaccaaaaaacatattctatctaaagtggatggccacaacttgctccagctgtggaaacttgggccatgtactgctagatctaaggattttcttttgagagatgctagatatatacgttttttaaaaataaaattatcctgattttaacaacattgccttattatataaaacataccttggagggtgtgggtaagacacaatgtccttgaaattatatttcactaggttaataaaattggctccggaagaaaataattttaaacagcaaaccaaaaagtgaaggccttcaaaactaacaaaccaaaggaaaacaaaacaaaatgacaacaagaaaaaaacaaagaaacaaaacccctggaccttaccatttttctaaggcatgttgacatgataaaatcaaaattgctttgtgcttataaggatcaaaggttatgcttttgactttataaattcagagaaagaatttaattggaattatttttatgaattaactgaagatctaaggcaactggataatttaggttctgctaatatctagaatattcaaagtttatgtttagtctgacactaaagaatccattatttctcttgacttccaggctggtcagtgtctttcctgtgtcatataccaaacaatgtgttagaaattgtcttctcactcataaactaatatttgttcagagtaaaaagtcaagcaagtaaataatgagaaaaaattcagtgtattgtataaacaaagacagaaggcagaccaatggttacctggggcctaagctaaagagattaattgtacacagacacaaaggaattttttgggatggtgaaagtgttctaaaactggattgggatgattgtggcacaactgtataaatgttattaaaactcattgagttgtacacttaaatgagtggctaagttgtgctttaataaagctgtaattttgaaaaagaataatggatgatcaactgtgggctagagtatgatgaaaacacaagacatttacatagtttcaaagtatctccccatcaggtacttattaactgcatcagggaaacagtaattttcttgtggcagaaccctgctgacaaagttaacattctagtaaaagcacaggtggatgtcatgtgcctcctgaagtgatgcacagagaaggatgcaacatcaacttgtagtatccctgccaaaaatataaaacctgaatttaaccatgctgaaacataagacaaatccaagtgaaggaacattctacaaaacaactgaccagtactcctcaagagtgtcaaggtcctggaagacaaagactgagcaatgcttctgattaaagtagactgagaggtgacaactgaatgcaatgtgggattctggattaggtcttggcccagaaacaggtcttcggtgggacaactggcaaaatgtgaataaggtctctggttttgtgaatggtagcgtatcgacgctcattacctgcttttgatcatggtagtgatagtaagatattaacattcaggaaagcacagtgaagggtatatgggaacctctactatttttgtagcttttgtaagttgaaattgtttcaaaatgagttagaaaattaaaaggaagttttctctttcagctgggaaaacggcaatggattaataacaagaaattaatggtgaagtggtgacgaaaattctacattgcttagaaagcaagtaagaaaatcagtggttgtagagaagttcttacatgaagtaataaaaataaaaattgttatgttaagcattttctattttcttttcctcccctccaaatgaaacagcatactattctgcatgtttttctacctaacaatgtatctttttaatgactcttgtattttaaacctaaaattttgattaagcttcacttaatattaaaaaagatagtataggtcacgatgttatttgatgcaaacgttggaaagacagaatcttcttgatccaagagcttttagaattcaaagtctgattctggttattactctgctcatttaagatagtgaaatgaacatttacattctggcaacctcagaagtacaacgaacaaaggacaccagccagatgtgccttttgccttccgccatgattgtgaggcctccccagccatgtggaactgtaagtccaataaacctctttcttttgcaaattgcccagtctcaggtatgtctttatcagcagcataaaaatgaaacaatacagtaaattggtacaagtagagtggggcgctgctgaaaagatacctgaaaatgtggaagaaactttggaactgggcaacaagcagaggttggaacagttttgagggctcagaagacaggaatatgtgggaaagtttggagcttcctagagacctgttgaacgactttgcccaaaatgctgatagtgatatggacaataaagtccaggctgaggtggtcttagatggaaacaagaaacttgttgggaactggagcaatggtgactcttcttatgttttagtaaagatactaggggcattttgcccctgccatagatatatgtgaaacttttaacttgagagagatgatttagggtacctggcagaagaaatttctaagcagcaaagcattcaagaggtgacttgggtgctgttaaaggtattcagttttataagggaagcagagcacaaaagtttggaaaatttgcagcctgacaatgtgctagaaaagaaaatcccattttctgaggagaaattcaagctggctgcagaaatttgcataagtaacaaggagctgaatgttaatccccaagacaatggggaaagtgtctccagggcatgtcagagttcttcatggcagcccctcccatcacaggcccagaggtttaggaggaaaaagtggtttcgtgggctgggcccagggtccctctgctgtatgcagtctagggacttcataccctgcatcccagccatgaatgaaaggagccaaagtacagctctgtctgttgcttcagagggtgcaagccccaagccttggcagcttccacatggctttgagcctgcgggtgcacagaagtcaagaattgaggtttgggaaactccgcctagatatcagaagatgtagaagtttgctgtaggggtgggtccctcatggagaacctctgctagggcagtgtgaaagggaaatgtgagattggagcccccaaacagagtccctactggggcaccatctagtggagcagtgagaagagggccactgttctttagaccctggaatggtagatccatggacggcttgcactgtgcacctagaaaagccacagacactcaatgccagcctgtgaaagcaacctggagagaggctgtaccctgcaaaacctcaggggcagagctgcccaagaccataggaaccaaccccttgcatcagcatgacctggatgtgagacatggaggcaaaggagatcattttggagctttaagatttgactgtcccactggatttcagactttcatggggcctgtatcccctttgttttggccaatttctcccatttgggatggctgtatttaccaatgctgtacccccattatatctaggaagtaactaactcgcttttgattttacaggcccataggtggaagggacttgccttgtctcagatgagactttggactttggactgtggacttttgagttaacactgaaatgaattaatgctgaaatgaattaagactttgggagacggttgagaagccatgactcattttaaaatgtgagaacatgagatttgggaggggctggggtggaatggtatggtttggctgtgtccccacccaaatcttatcttggattcccatgtattgtgggagggacccggtgggaggtaactgaatcatgggggcaggcctttctcatgctgtttttgtgatagtgaataagtctcatgagatctgatggttttgaaaaggggagtttccctgcacaagctctcttctcttgtctgcttccaggtgagacatgcctttcaccttctgccatgattgtgaggcctctccagccatgtggaactgtaagtccaataaacctctttcttttgcaaattgcccagcaatgtgaaaacagactaatacagtgggagattacttctccataccctctttgtctgccaaccatatcacctctgctgtttcctctccccaaaaggtaacccatgttaacctctgattatgatcaaataattatatgtatttatttatataaataccatttctttatatattttgaacatattaatgcatacacaagtgtgctaaaatttat

SEQ ID NO: 2021 - DNA, 618 bp, Homo sapiens
gctccactttgcagtacttattttctgtgtggtcataatgaaaaggggattcattggctcatgggtcttcaggctgtaaagaaagcatggtggcttctgcttctgggaagactcaggaagcctcccaatcataccagaaggaaagcagcaatgaaatgtttcatacggcaggagtaggagcaagactcacagaggaaagaggtgccacagcctgttatacaaccagatctcatgagaactcactatcactaagtcagcatcaagaagatggtgcttaaccattggtgaaggatccaccccccaacacacctccaccccctactgtttccagacagaagcctgctgcagaggcagagcctcttggaaatcctgttctgtggcagtgcagaaggaaaacaagggctttgagtcgctctgcaggaggccgccctcctctagaccccagattcatagacctaccaacagttcacaccctcagtatggaaaagccataggcactcaataccagcccagcccataaaggcagccatgggggctaaagcctgcaaagccacaggtgcactgccctggtagaggttttccatgagcctctacctctgcagcaggctactccccctt

SEQ ID NO: 2022 - DNA, 1486 bp, Homo sapiens
cactgactcaaaatgaaaggcaacaaacatataataattaggttataattgttttaaaagtgtattcttttcctttgttttaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaaatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcctagactgtgttgttgctgtgttgaacacttgctcccgtctacttacttctctataatccactgccatggaatgagtgatttttcttagaagcagaggtggagccactgaggaagcacaggcgagccctccccagcacgtgctcactggtccccaacagaacaaccgctgccacatccatgaggctcccattgtggtgggttgtgtcaccccacaatgtcactgttgctgagcccccatcgcctctgtgttgtggagcagttagagacacactgtggtgtctgagtggctctgcgtgaaggaccgttttctaggtgagaggcacatctcaacacagctgactgatcagactcaggtgagtgggacctgctctcttctcttgctcctagcttggggacagtcgctatcagttgggtggttttggcctctgagcagctactgagggtaatccctgaacactcaccggctgcctattctgtgctgacagtcatctcgttcatcctcgcagcaattccattctgcatcttttctgatcacccccgtgattacccaggacaaccccatcaggccctctcacccaggcccagtccagctccatgataacaaagacgcaggtccagagacaactgccctgcatggtgcctgcatctgaccccccttggtgggtagtgaccagcacgacatggaagaagccagggcagcatgcagccagctgccctgcagccccagatggctcctaggccttgggaagtcattctcaaaggggaagctggtcattttgaggtccctggagggaagggtgaatgtgtcatcccaacagccctggaagccagcagcatgccatacatcttacccaacctgtgtgacagaggccccctcctggggcacaagtcccatacctaaagggtcctgtcctagttgaacctcatcctgagccctgggaggggaggagcaccatgggcctccctgcagcagccag

SEQ ID NO: 2023 - DNA, 2464 bp, Homo sapiens
gtcggcctcgccagtgcgcatgcgcgaggcccgagccgccgctttggtcacagtgaccgccaccgtcgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggagtctagctttgtaccaggctgcagtgcagtagtgccatctcagctcactgcaacctctgcctcccgggttcaagcgattgtcctgcctcagcctcccgagtagctgggattacagccacatgccaccacacccagctaatgtttgtatttttagtagatacggggtttcatcatgttgcccaggatgctcttaatttcctgacctcgtgatccgcccatctcggcctcccaaaatgctgggattacaggcatgagccaccagaaccggacatgctttgcttaaaagctaaatattttaggcttgtgtgccattaggctctgttacaactacttaattctgcttttgtaattctatagcacccattgataatacataaacaaatgagcatgaatgtgtctcagtaaaaatttgttcacataaacaggcagtccacccatgaagctatagcttgctgaccccttgtttaaacaatcaattgaattcaaacagaaataaaaggatcttatatatttaaccatgttgataccatttccagtgcttttcattcttctatgtagatccaaatttccttttgatattattttacttctgcctgaaacattttctttaacattttttatagtgttgttttactggtgatgatttctttcaggttctaagtgcctgaacaaaatctttatttcacctacatcttgaaagatagtttctctgagtctacaattcccagctgacaatgtttatcttccagtactttaaagatgttgcttcattatcttctaattttctttgtttccaataaaatgtttgctggcattttttgttcctctgtgcaaactgtgtttttgtcattggccgctttgagaatttttctttatcactagttttaagcaattttattttagtgtattttgtgcacaagacaaggatgccctctctcaccactcctgttcaacatagtattggaagtccttgccaaaacagttaggcaagagaaagaaataaagggtacccaaataggaagaaaggacgtcaaactatccctgtctgtggattacatgatcctatatgtagaaaactttataggcccaaaagcttaaggcccgaaagctccttaagatgaaaaacacctttggcagagtctcaggatacaaaaagaacatacaaaaattactcgcattcccatacaccaacaagagtcaagcggagagccaaatcaggaatgcaatctgattcacaattgctgcaaaaagaatcaaatacctaggaatacaactaactagtgaggtgaaagatctctgtaagaactaaaaacaccaaagatatcagagaggatgaaacaaatgaaaaaacattctatgctcatggataggaagaatcaatatcattaaaatggccatattgtccttattttcaagtatgctattgcgctctatgactgatccaaactcctgccagatataattctaaaaatctgtttgttaattttattattttatttttggatttttaaatgcttgggaattgggagatatgcacaattgcctttgctttgttcacaaaattaaatgcgtatttgggtacttataggacactatttgtaaaaacatttatttcttcagacattgatggtcttgtcccagttattaacaacatctacatgtttaagaataaattttctatctacttcttattccattgaaaattacctttctatcctcctactctggaagtctttatgattctgtcctaatcattagtatcccattgcttcttcaagagatgtctgtcagtagaatttctccattaatataagttcatacttctatgaaaactttaaatctcaaatctacagtatttctagttctaaaaaatatttaaattagttctttaattatttccatctttatgtttactttcctttttttctagcattttaaacaactttacgtcaacaattctttatcttcactttacctccctttacctttcttcattttttcctagccattgggttcagagaaaattattcaacttttaaacttcaaacttgctagatctatatttaactatgtctattgttctcttcagaacatctgttgagtttttaatccaagagctattatcagtattttctaaaatgtaacctcttcttgcatgtctctga

SEQ ID NO: 2024 - DNA, 3336 bp, Homo sapiens
tgcgcatgcgcgaggcccgagccgccgctttggtcacagtgaccgccaccgtcgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggcctctccccgcgtctctgcctgggtgttgtggccggttggcaatcgttttcccggcggttccggcttgggggtctgtgaaggcctgggcaacgtgggcatctgcgtcggagccgcaggggttttcattccctccccatccggagcagcctctttgctaggctagatccagacgaccgctccccaaccaaggacaacggcctcccaggcgctcattgtccacccgcaggagggtgcccgcagaccttccagaagatgcttctcacgcctcttgccctgccctctgccctcatggagaaatctagccacagctcgacgcagggacggagaaggaagccggcaaggggatggggcaagcctctctctcactcaaaggcagtatagaagtccaccacagaggcatatccagtatggtgcccaccacctcatcttggggctgggtgaagggcaagtggcactgcaggaaatagtagccttgttctctgtcctcaatttgttccaagattgcggcccacaccagtgcttgggcttgtgagaatggagggctctccaacagttcagaaacaagcagtctgccgcagaggtgagaagagcaaaagacacccccacctatgcttttccatggaacatcaagtccctcagagtataatgtctgctgggttcttgcttccttatttttctgtgttcaaatttcttcttgtggtgctctagcacacttccgtctatatagatattggaattaacgattatttatccataactttgctttctctttctgagaataactagagtcaaatatctatagtcagtcatattgaagaaaaacctcagaaatatacttcttagtaactcaacacccaagagcaaatcataatggaaattataaaatatttttaattaaaaaatgtatactacattataaaatgtgtcattttagaggaaaatgtagaaccttaaattcttattttatgaggacaacaaattaatttttaaaatgttttgaatttattggtagaagttagaaatatcaacagaaataaaaggaaataataaatacatgcatagtgattaagaatacagggaaagaaaagtcaagaaatatggccaaaagtttgttagttgttgtaggagccatacaataacaaaactctggagaaatggcttgataaaattaagagaagaaacaagtatgccatctcaggaatcaaaataggaaataattatacatcaggtgtcaagaattttttttgttttttggaaaggatctgttggtaattattttaggtttttgggctatatggtttgttgcaactaatcaattctattgttgtggcataaattgacagtatgtcaatgaatgagcatgacagtgttccagtaatactttatttataaatactgtctggcttatttgccacagtttattgagttttgttataaataatacaaatatcaagaaggtaaattagtatagtatgaaaacgtttaattcaataaatttggaaatatatgtaaaatgtgtacaattacttgaaacatgcatttttccaaaagtaacctaaagtgaaaagaaaaatctgaattgtgctacaacaaatgcatgtaatcagtagtcagaaatcatatcataaagataatttcaagccatgatgactttactggcaagttgtttcaaacatgaaacaaaacaataattccaatcttacatacaattctttctgagcatgaaacaggaaagaacatactctattttattttattatgctattatgactctgatattataacctgacaaggatagtaaagggaaagtaaattaaacaccaatgtaatttatgaaaatattgaaggaaaacttaaaaaagttccatgcagaaataagcaatgcattaaaatgtaagacatcacagccaatgtttattctaagaaaccctgggaagcaataatggcctcatgtaaaggtatcaattaatatgatacaccacaacaaataacttaacaatattataagcatatttaattttattttcttaaaaagtcatacattttaacaacccgaaattaaaagagaatctagtttaactgataacatttgttttcaaaagttctattgaaattataacacttaacaatggaatgttcaaatatttcctttgtgattgggaacaaaataaacatagatggtacaagcaattttatttatccttttgcaggtcttagacactgggataggattgtaaatattaaaaaaataagaattatgaaagagaaaacagattactatgttaccgatgacactaagtacacagaaaattcaaaatgattctaagatacattatactaatgaatatgagcttttagcaagatgctttgacacaaacgtattatgcaatattgaaatgcatttcaaataagtagagaactttatttagatgtgtcaatgtggcttactctcacaaacatagtatttagtggcatgattaagtcacaaaagaatacgtacagtataactcagtttaaataaagttcaaataaacatagacataacattgacataaatatattcttaattgaaagactttaatgaaatcacttctccccaaaattaatctttgtaactagtgcatccaaagtaaaacccagtaaggtttgatttagatattgacaagctaattctagaatttatgtaaactctaaaaatattaaaattcagttaataatttattgaggaaggaaaaatatattacaggaaatataagaattaatgcaatgtggtattaacaaagtaataaataatcaatgaaatggaataggtagactacagtaaggaaaatataagaacccatgatatgtaagaaagctagtattatagatcagtggtgaaaaataaatttgccaataaatgagagtgagaaaactggctatacatatggaaaataattaaagtgattctttaccttatataatatttaacaatcaattccttggcaatcaatatttaaatgtaaagccaggcaaaaattacagaaaacccgacagtaaaacaaagaaaat

SEQ ID NO: 2025 - DNA, 289 bp, Homo sapiens
ttggtcacagtgaccgccaccgtcgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcgggcttagcagaggaaaaaaaaaaactaagaagatg

SEQ ID NO: 2026 - DNA, 970 bp, Homo sapiens
ttggtcacagtgaccgccaccgtcgccgggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcgggtcacaaagcctactgcctgctaatcagcaagtggacctgtttctctaacaatggcccgaaacttcacaacatcaaaggagaaatcattgccagcaaaagcatttccgggtagtaggaaagaatacaagtgaataacattagtccagaagttttaataatattctttgctggttgaaattcatgtttaatatgatgtaaattacttgataagcaaattaagaactatgctactacagactccaaataagacgcaagaaaaatgagaggaaatacattaaaggaaaatcttaaaaaaacagctgcacagaagataaattatttttccaggagttttaaacatagttgcttttgtttgtttgctttgctgttttttcttaataattgttttagtaagctcaggctgctatataaaaataagataggcgctggtctgaacaatagacatttatttcttatagttcttgaacctggcaagtctgaggagggtcatcttctgggctttcaaagggctgcctttttcctatgtacgtacatagtgaatagaaagcgttagctctctggtctcttcctgtaagagcactaatcccatcatgaagaccccatccttatgggctcatctaaacctaattacttccaaaggtcccacctccaaatgctaacacattgagagttaaggcttcaatatattaattttggggaaacaagacacagtcc

SEQ ID NO: 2027 - DNA, 228 bp, Homo sapiens
cttgggaaaaaagaatgagtactgcataccatggggagtgaggagttgtgtccatttggaatggtgggtacttgctgaattggtagaatgggtccagaattgtctggtattcttgaggaagagtctgctctgcacccaggttacatacttgcctagctcttttcataagttccttgcatttctgcaataatctctgtctattttcatccaattcaatgaaatgttgct

SEQ ID NO: 2028 - DNA, 940 bp, Homo sapiens
gggcgggggcgcggggcgcttccgactcgcaggagcgccgaggcgacctcagcccctcatctttacgtaaccggcagcgcctccgcacgcagcatccacggccccgggctccgccgcgccgccgcctctagccgccgcccctgccccgcgccggccgcgatcccccgacgggcgcgccggcccctctgagccggctcccttggaaagatgccacacgtggcggtcgcaagtttattcgactgaaaacgcccccgaggcgctgggagaggaaactgcaagagaggtgcacgccctcggccgcctcgccgtcgagccaaagccccaggacattcacccgatcaccccgacgcgggtggcgagggtcccgccgagcgccaggtctaagagacactttttcccgagtccactgacggcttctgaacccctgctccggccggtccgcaccgttccggcattctcttgctcagtaacaatttcgcagaatcccatcacgtcacaaaccaaaccccctccaattggccagtggggagggtgattcaactctgtttactttctccccctgccagtcagaacggccttcggtggagaggtgcgtctagaactgaggcgtgcggccaatccgactgttccgtttcgctgcctcgtgctacccctacagcctcgaacactgacatttaaaagggtaacagctgggaggcagggaaggggcagccgcacactttcggagtgcctcgcggtcccgtggccggtccgggcctcctggctcacgttccagcttgcggagctttgggacacatctttcctagtcagttgcgctcgttcctatggcaaaagagaacttcagcttcggttttccagctcccaaacagttaagtgacttcctgcaaacgctacagtcccagcaaccagccttccaatcaaaatgaataaaccagcagac

SEQ ID NO: 2029 - DNA, 343 bp, Homo sapiens
gatgaacaatggtaatcagatatcctaaagttatctttagggcactggcaaaatagcagcaatgcctggtggaagctgactttgtgcatacacatgagagcccacagaaaacttcaaacttcatggaaataaaaccttcagctgcagctaagaatttggaggttactgaaggaggttactttttcaagagcagaagtaaggattccactgaatttgctcaccaaagataagtcagcaaagaaaacttactgaagaatacaggttgtctactgtgtttttcttattttttttgtggaggttatttgatcatgtttatttgaaaattgacccctatatgacaacc

SEQ ID NO: 2030 - DNA, 618 bp, Homo sapiens
gggatgatacagcatgaaggccctcaccagatatgcaccccttgattttggacttcccagactccagaacttacattttcatgctgctgataaagatgtacccaagactgaacaatttacaaaagaaaggtttaattggacttacagctccatgtgactggagaagcctcacaatcatggtggaagacaaggaggaacaagtaacatcttacatggatggcagtagggaaaaagagagagagcgagcttgtgcaggggaatgcctctttttagaaccatcagatcttgtgagacttattcactatcacaagaacagcatgggaaagacccacccccatgtttcaattacccacccaccaggtccctcctacaatacatgggaattcaagatgagatttgggtggggacacagccaaaccatatcattgtgcccctggcccctcccaaatctcatgtcctcacatttcaaaaccaatcatgccttcccaacagtcccccaaagtcttaactcatttcagcattaactcaaaagtccacagtccaaagtctcatctgagacaaagcaagtcccttccgcctatgagtctgtaaatcaaaagtaagttagttacttattag

SEQ ID NO: 2031 - DNA, 652 bp, Homo sapiens
gatcaagtgatcctcctaaataaacctcctgagtagctgggactacagcttccaccatgggatgatacagcatgaaggccctcaccagatatgcaccccttgattttggacttcccagactccagaactatgtacccaagactgaacaatttacaaaagaaaggtttaattggacttacagctccatgtgactggagaagcctcacaatcatggtggaagacaaggaggaacaagtaacatcttacatggatggcagtagggaaaaagagagagagcgagcttgtgcaggggaatgcctctttttagaaccatcagatcttgtgagacttattcactatcacaagaacagcatgggaaagacccacccccatgtttcaattacccacccaccaggtccctcctacaatacatgggaattcaagatgagatttgggtggggacacagccaaaccatatcattgtgcccctggcccctcccaaatctcatgtcctcacatttcaaaaccaatcatgccttcccaacagtcccccaaagtcttaactcatttcagcattaactcaaaagtccacagtccaaagtctcatctgagacaaagcaagtcccttccgcctatgagtctgtaaatcaaaagtaagttagttacttattag

SEQ ID NO: 2032 - DNA, 886 bp, Homo sapiens
acctcctgagctcaagtgatccttccatctcagcctcccaagtaactgggaccacaggcagatgccaccatgcccagtgactccgttcacatgctcccgtcttgtcatcaagccctgttcatctctcaccatctctcacctggaccattgccagtttctgagctgcctgctcttgaataccagcttcctgaaaatatcaccaaaacgatctggtcctcagacaaagcagagtctattgctcactgcagtaacagagagctccgtcttcagagtcttggtaacatttcgctgagaggacaacccaatcacactgtttaggagattttggattctgactaaggtgcctggagcaaaaatgtgtccagaattggtgggttgttggtctcgctgacctcaagaacggagccgtggaccctcgcgggacaaggggagtcagaggcagaagagaaggtgttgtgatgacagaagcagagatctgagtgactcactttgaagatggaggaagaggtcacaggccaagtgatacagatgccaggagaagctgaaaacaggaggaaatggattcttccctcagagcttctggaaaagatcagtcttgctgataacttgactttagcccactgaaactgattttgaacttttgacttccagaactacagggtctcattattgttgcccagactcatctcaaactcctggctcaaatgatcctcccacctcagcctcctgtatagctgggattacaggtgcatgccaccatgtccagctttactaaataaatggtcacatatccatctctgagtctgtcactgggagaatgggatgcttttttggaccaggcctgacttacatacccatctgggacaataggactttctatggggac

SEQ ID NO: 2033 - DNA, 334 bp, Homo sapiens
ccgtgccgccggctcggccctcctctccctcctccccccgccgccgcctctcccgcggctccccgggcggccgcactgggcgttgggactggtctgggtcaagtgtcggcagagctgggggcaggctcgcgccgggcgggggtcgcggtcggcccacaggctgggcactaacgggtcccggggcgccggggcggaccgcggagctggaccctggacacggtgactctgattcaattatgcagatgaccacaaacctctggggttggcagagccacaagaaagaaggtgcctggatgaaggagagctacccactgacctggacacccaattatgt

SEQ ID NO: 2034 - DNA, 1224 bp, Homo sapiens
ggaagaggaggaataagagaagttgatcttactgtctcaaaggtggcagaggtaaagaaaatccacatataaatggacccacacactttaaacccatgttgttcaaggatgaactgtaaatgcaacaaggtagagaacattctgtgaccttgacagctggaaccagatttccacccagtgacaatgaagaaggatctgtgtttccacatgtgaggcatcccacagacaatgatgaacaagctggagttgaagaggccaaagaagcaggagaacttaagacttccaggaattctcagaaatatttggacgagctttggactgtctcgtctcctcaaatctcaaggactgacatgcggttcagaattgacatgcctgaattatgtaagaaaaccccaaaacaaaattgcacctaccttaaaagcaagatattctaattaaatcagtactagaattaatgtgaaaaaagcaaaattcatcagtggaatttccaacatcctctccctaaacatttgactctctgatgcaatattccctctagacaccaaccagtgttctgtgtggtcacaattgtcccatcttttaatcatagtaaaacttacttcaggaatagcctatgaatttgtctatataaaagtctgagagctgacaatgttaagaccacttcaaaggaatatggaccagagcctcagaattaaagcctaaaatgcatgcagtgggatttcatggacaattggcatgcaggaaacattctgggcagaggcacatccaagtgttcttaaaatcacatcaaggcagaaaactttaagttggagcactacctcacaccatatagcaaaatatattttaaatgaatcaaagaatgatacccttaactatgaaaaaaattatgagccttttacattgcaaaaaataaaaatagcaaagccaaagaaatatggcacagtgggaaacaagttatttgcaacccacattaacagtcatagggcctaatttccttaatatatcatgatttaacaacgtctccattcatgtaacaaatactgattgtttgcccactatgtatcagcaaaattccaggcattgatttgtggatacagtgagtaaacaaaatagataaagtccctcttctcatgcagcctatattctggaaggtgtgtacacaagttgtgagagattttaaaaaaagaaacccaaacacatcaatgaacaaaagcataaaccggc

SEQ ID NO: 2035 - DNA, 332 bp, Homo sapiens
atctgagtcatttttggaatgacatgtgttggttgtctttttccttgtgaataggtcatacttacctggttgcttgcgcatctagtaatgttggatcatattctggatgttttgaataccaagtcccaagagtctgcaacttgttaaaatccctggagaagactgattgctggaatgcaatggcgcaatctcagctcactgcaaactccgcctcccgagttaaagtgattctcctgcctcaccctcccaagtagctgggattacaggtatgtgccactatgcccagctcattttgtatttttagtagagacagggtttctccacattggtca

SEQ ID NO: 2036 - DNA, 829 bp, Homo sapiens
gggaggcgggagcgggagcggtaggccccgcccacagaggagggtaccccgccggaagccccctgctctgtgggaaccggagggaggacagcgcgaggtccccggacaaagcgtggcgcataagtccggcccgtaacttggtgggcaggcaacttaggggatgtgggcctggttatagctgagcatgcttttctattcctcccagaccacagttcttcagacctggagccactttcagagaagagtataagttgcactgaattgaaaaagggaaaagtttaggactgcagaagatggaattcctggggacgttaaactgggctaagatggagcagataagatttccttaattagagcaagacacacctagtatctagagcctggaagtcttggtcaaggattctccctaacatctcagtttctcagcactaacattcctgctactaaaatgaagtgagaaattaatttctgaagttaagtaaagaaataaactaaaattcctagaaaagaggtaagaagaatgagcctttgaaaaatgtcttcacaaagactggcatgatggcatggaagaaagagccccagatatccagtatacatctcaaggtcaacttgtccaaaacagagctactgatgattttccccttgaaatctactcttcctacagcttattcatctcaaatagtaagtctgtccttgcagttactcaagcagaaacctttgggtttttggtttggcctctttgttccacacctcacatctaatccatctggagattgactctacctttaaagacatcctaactttcaccagttaacacacctcccctgct

SEQ ID NO: 2037 - DNA, 452 bp, Homo sapiens
cccatgcagaccacatggactcagaggaatagactgttgttatatatatataaaaaaaagatatattattttaccagaagaggtgatgctgtacaacaaagcaacagatgttctattcaaaatgacggataaaggagaccaagaagacagaagaaagataaaggaagtagatgaagaagggaagaggaggaaggtcaagaaagaggaggacatggagaagagggagagaaaaaattaattctcaagatggaagagagaataaacacataggagataaaaattaagaggaatcaccaataaaacaatacttgacactgtcattataaacacatttatggagatatctgagcatatgactttaagaagagccaggatctcacaggtaagatgatcaatgatattattcccacagaaaggcaacatcattgtcagaactgttcgcaatagggagg

SEQ ID NO: 2038 - DNA, 1955 bp, Homo sapiens
tgtttacatggtattttggatatttgggttaaaaattattaaaacaaatttcatgtttctttttaatttttcttgtgcctgttagaattttttttttttttttttttgagacagggtcttgctctgtcacccaggctggagtgtagtggtggagatcacaggcttactgcagcctcaacctcctgggctccggtggtcctcccaccttccacctcctgagtagctgggaccacaggcatgtgacaccagctaatttatttgtattttttttaagagatgaggtctcactgtgttgcccaggatggtctcaaactccttgggctcaagtgatcttcccgccttggcctgccaaagtgctgaaattacaggcatgagccactgtgcctagcctaggaaatttcaaattatatatgtgtgtcacgttctgtttctcttggacagtgctgatctagaagaagaactgttactaagagtgagttaatggtacttgggaatagctttatgattcaaatcatttccttgtaatgtcaaaattgtaagggaattttattaattaatggctttctgatttcagaatggtgaggggaaaaaacttaaaaaggaagaggctattttcatgccttggctctaagctctgatgtgaaaagtgctcgatttagttgcaatattaacagaagatagtcttccggtcactcagaatttcaaaattcaccatctatcttaattcaaagtctgaatcctgtccataatatcctttaaaaagtgctcttagcatattataaagggcacattaaacagaagtaggaacccgggcatggtggctcatgcctgtaatcttggcactttgggaggctaaggcaagtggatcacccaaggtcaggaattcaagaccagcctggccaaaatggtgacaccccatctctactaaaaatacaaaaattagccaggcgtagtggtgcatgcctgtagtctgttcttttttctgttttttgttttgttttgtttcagcctgggtgatagagcaagactgtctcaaaaaaaaaaaaaaaaaaaaacaaagtgggaaagtactaaaaataaataaataataaagaaaaaagaattttgaattttgaaagggcactatcattacttaaatgtcatcagctacaggagtaatcttgtattatctaacttagtaatcatctatagtgcccatggccctaaaatgttcatatttactctccacaagttggggcaaaaccaactgtttcggtatctcttatatctctaagataccacagagttaaagcaagtagaatgtataaataaatgcattgagaaataaatccaatgaaaagaaagcttttatgtaacctgatttgctactattttcatccacctagtagtatttatcacttgatagttctaatccctctggtcctcttacagatactttgttttgcttcctattcccatcctttagttagactctgcatgatttatacgaatttgaggataattgcaaaattgatcattttttcagataggcctcctccacatactatgcaggtaagattcttcctctttcccccagttccaacagaaaccaaacaagttgacaataacacaagaaaaagcaatctaatactaacaagagatctaaattatagttaattatagatgttatttcccaatttttttatagatgttatttcccacttcttttttttttgagacagagtctcactctgtcacccaggctaaagtgcagtggtgcaatctcggctcactgcaacctccacctcctgggttcaagcgattctcgtgcctcagcctcctgagtagctgagtagctgggactacaggcgcacaccaccacacccagctaattttttgtagagatggggtctcactatgttgcccaggctggtctgaagctcccagcctcatgtgatcctcccacttcagcctcc

SEQ ID NO: 2039 - DNA, 2519 bp, Homo sapiens
ttcatcgcaaaaaaaaaaaaaaatacatttttaatcacacttaaggtatgctggctctgacaagagaattcactgtaaccacagatgaataccttagttttataaaattcagtggtagaaaagttcaaattctaactgctaagaattccctttttttttttttttaatatcattaacacaactttacatcttcaggaatgctcacagtttggtctccaacctttgcaaatagcagtaaaaatgttttcccatagctgctctctaactgagaagaaatttcaaataaatattatttatttagttagttatttttgagacagagtctggctctgtcacctaggctggagtgcactggcacaatctcggctcactgcaacctccgcctcctgggttccagcaattctcctgcctcagcctcccgaatagctgggattataggcgtgcaccaccacgcccggctaattttgtatttttagtagagacggggtttcaccatgttggccaggctagtctcgaactcctgacctcctgatccacccacctcagcctcccaaagtgctgggattacagtcgtgaagcaccacgcccggccccatcacagacttttgagtgcaatgccaacaggttagaggcagacttcaggagggttaaaccagttttatgtgcagaatggtgggggcgcgaagcagacacactagggatcggtacaaagccctgctgcctgctatgtgatcacctcacctaaatgccttccctcttctgtgtcactgaagtctttcctacttcatggcttgactctataaaagctgtccttgatggctgtggcccacctgatgtccacattcataaaactttctggactatacaatgaacatatcattctctctgcagagagactcaaaggacgtacagaatctgagcttatccttcatttgttagatgcatgagcccaatcagaatacaagttctcacataccacatttaagtcacctggcagcactaggctgtgtacagtgtaaagatacattagatgctttcagaaacagacgggcttcggaatatttattcttttccagagtgacagattccgccacatggctctccagctagaagactacatttcttagtctcccttgaagctaggtcattgtaactatgtttttgccaaaggaatgtgaacagcagtaatgtgggcagccagcctaaaaggtaactacttgccctgaacttctctttttctttccctcaatcttgaacaaggacatgcaacctggcttctactgtactgatgaggacaaagcctcagggggatggcagagcaacaagatggaaagaacccgggtccctgaatgaccttgcggaacagagtcatcccaccagccccagaccaaccagactcttatcagagagaaaaataaactagcttatttaaaccactatatgttaaaatctctaattcagcagttaagcctctacttaatacatttccccaaatccattctctccatcttctttaatacaataattctgatttttgaactgggcatattatgtctcagctaataggctctattttacatcctcctttgtacctatgtgcaaccatatgattaagttgtggccaaagaagtataaaaattgttatatgaaacttccgagtaatccctttataaagtagtcagtgaccttcttcctgcttcatttttcccactgtctagaatgtgaacataatggctgtagctcaagcagttattttgaaccatgaagttacatgctaagaattgtgaagaaacagaagggcaggatccagagacactggtgaccaaggagcctccagaccagttctggattacctatttctagttttctttctgtaagagagaaacttctatcttgttgaagctattaatgtttgcttgttgtatacagctgaacttaatcctaacaacagacacatccactaacagatatgagctcctgggactcaacacttcaaaccccagcttgatggttggatatccctcttagcagaagaaaaggaaagtcactacttcccaaagttgcttaaagaggccagtttccattccttctgaccaccatccgcttggcttttgtgctcgttgaagcagctctacagggaggcccttggctgacaaactcccagtctgcgggcccagcaggccacaacaatggtggctcgcactaggggaccataacatatgtggcgtcataaaagaggagggatgggagtggggaggctgatgtgacccagctctgacgggtcagtgagcaggaacagaatgctacgaggtgggcgctggtcactgcaaatttaagtcaatacagacagggaggaaataaggcaacctctctctttaggttggggtttttctgcttccccctagctgccctggccagatggcggcctcctcccctataacccaaccccaggcggcaaaggtggaagccagatctaagaactgggggagcttagactcagcacccacccctatccacag

SEQ ID NO: 2040 - DNA, 691 bp, Homo sapiens
gtggcatcataaattgtcgaggggattcaagcattcagagggggtggggaggctaaactagatgacctttaaggtccttccaacccaaagattggatctttctagaaagcaatctggcaatataaaacaagagctataaaatacttcatgctctttgaccttgtaatccctctttggagatattcctaagggaataatccaaaagaaggagcagttttttttttttacagacattcatagcagcactatttataagagtgaaaaattagatataactcaaatatctaataatggggtgaagtgaggttacccatgttacatggatataaagacatttaaattggtgagagtagaatctgtgttgacaagaggagacaagtgttaggccgagaagtaaaacaaaggagaatgtacacaacgatcatagctatgtaaaaatatgtgtgtattcattgagaaagctagggaactaatttagagggatattttgtggttagggggttgctttattcctgcaaagttgttcaagtgcattaataaaaatctcaaaattgccagaataggcctgaaattgcctttttgactcaggtgagagaaggacccttggggtgaagtcttggggtacattctcctcttgttgcctattgagtcagcatggtgctctgagaccaatatcctagcagaaagtaac

SEQ ID NO: 2041 - DNA, 1220 bp, Homo sapiens
gccttctgttagaagaagatgccaacgaggactttcatagctagaaagaagtcaatgtctgtgttcaaacttcaaaggacaagctgactctcttgctagaagctaatgcagttggtgattttaagttgaagctaatgctcatttaccattctgaaaatcccagggcccttaagaattatactaaatctaccctgtctatgctctataaatggaataacaaagcctggatgatggcacatgtatttacaacatggtttaccgaatattttaagcctattgttgagacctacttttgggggaaaaaaaagattactttaaaaatattaccgcttgttgataatgcacctggccacccaagagctctgatggagatgtacaaggagattaatgttttcaaatatgtattctgcagcctatggatcaaggagtcatttcaactttaaggtcttatagaaataaatacattttgtaaggatatagctgccatagatggtgattcctctgatagatctaggcaaagtcaattgaaaacctttgagaagggagaaccattctggatgccattaagaacattcgtgatcatcagaggaggtcaaaatatcaacatgaacagaagtttgaaagaagttgattccaacctgcatggatgactttcagggattcaagacttaagtggaggaagtacataactatagaggtgatagaaatagcaagagaatttgaattaaaaatggagcctgaagttgtggttgaattactgcaatctcatgataaaacttgaacagatgaggagctgcttcttatggatgagcaaaggaaggggtttcttgagatggaatctgctcctggtgaagacactgtaaacattgtttaaatgacaacaaaggattcagattattccataaacttagttgataaagcagcagcagagtttgagaggattgagtctaattttcaaagaagttctgtgagtaaaatgctatcaaacagcactgcatgctacagagaaatctttggtgactgaaagaatcaatgtagcaaacttcattgttgccttaagaaattgccacagccaccactctgatcagtcagcagccgtcaacttcaaggcaagatgctccaccagcaaaaagattatgactcactaaagactcgggaaaaccatccaaagatgtatacagagaaagtaatcgccattcccaccccaactcccaggtaac

SEQ ID NO: 2042 - DNA, 1284 bp, Homo sapiens
gccttctgttagaagaagatgccaacgaggactttcatagctagaaagaagtcaatgtctgtgttcaaacttcaaaggacaagctgactctcttgctagaagctaatgcagttggtgattttaagttgaagctaatgctcatttaccattctgaaaatcccagggcccttaagaattatactaaatctaccctgtctatgctctataaatggaataacaaagcctggatgatggcacatgtatttacaacatggtttaccgaatattttaagcctattgttgagacctacttttgggggaaaaaaaagattactttaaaaatattaccgcttgttgataatgcacctggccacccaagagctctgatggagatgtacaaggagattaatgttttcaaatatgtattctgcagcctatggatcaaggagtcatttcaactttaaggtcttatagaaataaatacattttgtaaggatatagctgccatagatggtgattcctctgatagatctaggcaaagtcaattgaaaacctttgagaagggagaaccattctggatgccattaagaacattcgtgatcatcagaggaggtcaaaatatcaacatgaacagaagtttgaaagaagttgattccaacctgcatggatgactttcagggattcaagacttaagtggaggaagtacataactatagaggtgatagaaatagcaagagaatttgaattaaaaatggagcctgaagttgtggttgaattactgcaatctcatgataaaacttgaacagatgaggagctgcttcttatggatgagcaaaggaaggggtttcttgagatggaatctgctcctggtgaagacactgtaaacattgtttaaatgacaacaaaggattcagattattccataaacttagttgataaagcagcagcagagtttgagaggattgagtctaattttcaaagaagttctgtgagtaaaatgctatcaaacagcactgcatgctacagagaaatctttggtgactgaaagaatcaatgtagcaaacttcattgttgccttaagaaattgccacagccaccactctgatcagtcagcagccgtcaacttcaaggcaagatgctccaccagcaaaaagattatgactcactaaagactcggaaaaaccaacaacaaaaaaaaccaaaaaacaaaaataacacatgcttatccttactataaacaggaaaaccatccaaagatgtatacagagaaagtaatcgccattcccaccccaactcccaggtaac

SEQ ID NO: 2043 - DNA, 429 bp, Homo sapiens
ttattaagtgttatctttttgtcctctgagatttctagagctattagtctgtctaaattgaggccaattaaagaattgcaaaagtgtttctagagtctttgttggtggccagggcagttagtctgggacacgagggaggcaggagccatctagggcagagggattgtctgcactaggacagctctgttaaaaaggaggacttttttgtttatgggaagatttccataaagatgatcttctgagtgaaggctgggctttaagacgaaatgagagacagtgttggtggaagaagagaacttaaggccagaagttgaattaagaaaaagaagagaagtacaggagatatcattaaattatatagttctctcttcgactgtagccttataacagggacattaatagaattaacaggtaagaacaggtcagccc

SEQ ID NO: 2044 - DNA, 328 bp, Homo sapiens
ctctctgtgaagacatggcttggatttaattgggttgtaatgcacacaaagtaatcaagtcaaatccacaaatggccgttgaggacaactattacaaggaaataagcttgacaaaatgcccctttactaatttctggcctgaaatctacagaccttgcaccccagttgataaatagcagaattggaatttaaacaggcctggtgacccaaaaacttgactctatatcttaccctgaagaaatatgcaagtgatatcaagcctgatattgaaactttagtccacttcatcagactttggaaaaaaacgtgacactcaacatagcaggtg

SEQ ID NO: 2045 - DNA, 1160 bp, Homo sapiens
gcttcatggttgtcagaggctagtgtgcattatttctgaggattatatccaatgacacgacgcagaaaacacaaatggacggacagacggatggacataatcattaagacaagagactctaaaacgtgccttagtgtccacgtgattgatctaaggcggggacccttctaaggtggggacccgagtgatctaaagcagggtggcttccagccaccaggtgccgactgggctgtgtgcactccaggcgccagggacgggaaccggcttggaaccaacgcctgccctcccaggggcgacctccccattcccgaccagcctctaagtgtctgctcttcatgaaggaccaggtggtgacagggctgatggaagcagcggaggccagcggtggcactggacacacccatgccgcaggcggtggggaaacaaagtctgggcgaagtggctcctcttggctccttaacactgtgcgtggagaggcagggcaggcacgaggaggggaggtgcgaatggagcaccgttcatccggggattagccaacccgagtctcctccctccttggcagctccagaacattccctctggccgacagccacagaaatgagtgcctgccaagacacatggaggagaaagaaaacaagacaccaaaaaaacccaaaaaacaaacaaaaaaacctccctccccaggaacaaatagaactcctggaccaaggtcacaccagatccggaagacaccctgcaccctgcgcccagggaaaggaaacacagttcaacgtctggctgctttgctcaagggaaactgccaccctgccctgagactccaactcactggccgttagtgtctttttttttttaagttttttttttctttttaatacccaaaccatccattttcaaagctttttttttaaaaaaattgttttttgattaaaaaaaaaaaaacaaaaaactaaaactgccacaaatactgaagaggcaagctccaggcctggcctttccagctggaggcctgctctcccgtggaccgcaccgcagagcccagcccggcactgctgggtgaccgtcccatggctggttcgccccggaccactctgctgaagtccaggtgcagggcccgcagcttccggcactggaagagctccggagggagcgtctcgatctgg

SEQ ID NO: 2046 - DNA, 532 bp, Homo sapiens
gtccccttccccacacagcgccggcctcaactagggctagaatctccctttttcagattactagagagctcccccatcctgagttggtcattttcagtgtcctctttgtgtttgccaccctgtgctcagcccccacggagaccccgacagcctgtgcagagtggacagtccctgtgttcctgccacaccatcaccattttcaatccgaatatgctcctccctcatcctctggcagcctggagttcttttgtctctggaagggcagcccaggaccaagtgcggcagcagggacgggcacactggccagcccccactcacctcggccttatacatgcggatgagaccctggttcactttggaccaggaagggacggcgctgatgttccacagctggttggagtgctctgcaaatgggccagtcttcatctgaaaaagagaagccacaagctgaagagacaggttctggctgggagctcatccctcctcccctgcagcaaagtcacacccatgcatgcacacacacacacacaca

SEQ ID NO: 2047 - DNA, 1226 bp, Homo sapiens
gtggtttcaaaatgtggtttcaatccatatctgggcattaactctcaaaaagaaaagaaaatcaggcttatacccaggatcctaggtagtttaaaaaatgaacgtatgcttatagttcatatcaattgtatcaagcacaagacaaagttcacatgtacaaataaggcttttgtaagcacaggcttaccgttcccagtgctgtgtggctggctgctagaaaaaaaggaggatgcgctgctttgaatacaattagataatttaatcatttgcgggaactgggggagaaacatttatgttagattcagagactgtcagaaatcataatgggagatgacattaaataatgataagaactaaaactgcctccagttagcttgacgctgacataagccttcacaggcaacaaagtaaaaaactgacagaacagtcaaagtactgggtgttttgggaaattacagtgtttcaagtcaaatccaaagcaaaataacttaagaatttcaatgtttagacattgctgctccctcagcttcaatgtttgtgatgccaaaattgggtaattcatcatatccttggaaaggaggtaagtggcactttcataaaaatagcaaaacgatgctcccagtgtaagaaaaagtactagatctttggaaatattcaaatagttgaggatagcaattcaatttggcagcacaagttaaaagtcctaaaatcacctttggattcagcaagtgcactttttaaaagttaaaactgccttggatctggcctcagggagaaaaacaaagaaaaaagtcatcctggaaatttctgaaccacaaacagccagaactcagagcatgtgtggagtccaaaccctaagttgaaaactgacattaatgcagcttggtaatgaacccaggtaatgcccgcttcgggagaacccactttaagtctaggcctccatcaccatagattaaagatccacgaaacacacattcataattacacacagtctgctctgaacctcacagttttctctactacgacttgtacctttttcttttttttgagacagggtcttgctctgtcacccaggctggagtgcagtggtgcgatcactgatcactgcagcctccacctccagagctcaagcgatcctcccacctcagcctcctaagtagctgggattacaggcatgcgccaccacgcccggctaatttttgtgtttttagtagagacagggtttc

SEQ ID NO: 2048 - DNA, 702 bp, Homo sapiens
cagagctcatccaccacccgtaccagcacgaagaacgtgttcttgctgacgcgcttcttgaatgtgtcggcaaagggagagaatttctcatatgtggagcacggcttcttgatgagctcctctggggagatgaaggtcctgtaggtggtcaggaatgcctcgcagtacaacaccaaatctagagggaaaaaacaatgcaaactgcttgtctgggtgcagagtgctggggggtggtagccagggtggatttgagtccttgctctgagagaggcaggggagatggcacggggagtgggatgggcgagggagccgagggcttgggaaccccctctggtgtctccgcctgcatgtcccagagaagtcacacgtcctctctgtccatctctcaaaggaaacggcagatcagagaggggaaacaggaaagggttttatctcatgggcactttctaccgatgatggtgctgcctggagaaccgtgctgtgggagctgaggccaactctggtcccagcggaaaagggcacttaggctgacgagtgacgcctgccctaggcatcaaaacccggtggcatgcctgttccaggtaggagccagccctggattagactctgagaggctctgcctgtcctaaggctttatgcttcagagggtctcagccatcatgggaacaaagaaaatcgtctgttcaaacccgtcagcaggat

SEQ ID NO: 2049 - DNA, 6390 bp, Homo sapiens
gaccaactcactggcgctcccaatacctgccccagccccctccctcaatgtggctggggtcaggaaaatctactggaaagctgctgggtgtggtggtctgagccctggctgtctgtcacagctggggtctgccccaggcaaaagcactattggtgcctgtgaagcatgaggacccacttctggcccctggagggagtcacaggcagatggaagccctctttgcccctcttgtggagtgccccagagtggctacaaaggaggaggcctgtgtgcctttcctgggcaccaaggggccagctgtgtctcagcctccgaggcctgagtggtgcctggcaggacacaggtgccccagggcgacggtgccaaggaggagacggtggcagctggcacacaccacaccccggcactgttgtgaggaggagccattctcacccctgggggccgtgggccatgcggcaaacattaacactgtgggaatcttttgactgggcaattccacttttaagaatccatcttgggaagtcaccggacaaatgcttagctctgacgtgtcaacacaggctggtgcgtgacaaggcaaagacgaactggctggtgtgcaagctcccgacgccaacacagctttgtaaacaccaagtatgtgctgtcagcatgggctcaacacaacctcgtaaggtccatgctagcactcccattctacagatgaggaaactgaggcccagagaggtgaagtgactcgccagagctgacacagctactgcatctcagtgctgggatggaccaacctcacagacacagttcccagaagctcctccaggccctctgctcctcccggggcgcccgccttgtgccagtccagaccctggtcctgcaatgccctccatctcctgatgcccccacctctgctccagtgaggccaccctcctctcccacctcccccacctcccgcccccgatctagggagcagctggaggccccctctcaaggagggccttcccagggacctaccccaggaagctcgcggcctctgccctgccactgtcccctgcaaacctgttacacttgccagctgctagtactggtctcacctccctgggccaatcgcatcctggcctcagttccagccccgctggctcacttccaagttccacaggtgaaagtgggtctgggtgaacatgggtggccttatccacacacacagctgggagaggtcccaagacacctttgaaagatgcccatttaaccgggccttggcacccagccacctagcacgggcacgctgagcccagcctgcctttccccagactcatgaccggtgacttcaaggtcacacaagctggctggcgggccccacacatcctcctccagctctcacacacgtgcccacggtgcgcctgcctggctcacggagcgcccaggttcacatgcacacacagcacttgtttttgggtacacgatacccgttcagcatccctcacccatgcagggctgggacacacttggacaaactttcctgttgcagagaaacctgggattgtttgtgggagacacagaagtgccaccctttccagggccgatggcacctgggtcaaagcctgcaagtttgcatcccggggaagcaggacaaaaagcctcaggggagagcccgagatgccccccaacaccctccgagggcatgagatggccccacagcaaggccccactactgccacaccaggctcgtcccaagtaattttctgtgttaatcaagagctccccatacggtgggtgaaccagaccagcacacttggaggctgccgggtgcgaggacacaggccacacccaggccagccactggaacagaagcagaggccctcgtggggaccctgtctgctcccttctcactcacctctgtcctcctgagctgttactgtggccactcctgggccacagcagacccctgagttccctgtggcctgagccgtccctcctgccggccagtgctgggcggtatcttgggccctcaaacctttcccatgagccctgagctacttcctgctgctgaaggcactgctccctaatatgggcctggagggctggccaggaccttgggccaggcatgtaccctggcaggatgccagggcctgatcccatcagggcctagagggtcccaggcccgccctggagcacagctgctgggaagtggtatttccaggaaaggcctggcaggggctctgatgcgaagtgcgctgggcagggggtgggcacttgccagctctggggccaccagggccactggtccctccctgtcctacaacagctgtcatctccagggcctgtggggaggcagctgagggcctgggactccatggcatggaggtgggagcagggagcctggaggccagaggcccgtgaagacccctgcaaactggaaggccaggagctcctctctggagccccactttccggcctgatggccttgaggctgactcagggacaccactagcgtggagctgggggtttgagctggggcactggagtggggtggggtgtccaagcacctcctggcccctctgaaccatagcaccaaggctggcatcctccagcacccaggaaagacagaggcctgctcaaggcctggcaccaagacctatggactccagggcctgggttctgaccacgctgttgcctggcaccctcctccccatgtgagagctggtggggaaacccgccccacagagctccccccaccaccaggcagcacgaaggttcttctttctgcagctgaagccacctgcctgggccgcaagccttggcctcacctggagctcagctccccgctcccgagcccagccaagcccaggtcctgctccctccccaagcctgacgcctgacatccctccactgccggcggctgctctgcctgcagtgtgacagggaatctctgttgcaacggaggccagctcagtccagcggggaggaggagctgtcccgggccggtgggcagggccaattgggagagacaggtgtctggaaggacccggaggatgaggcctggagctaaaggctggaccctgaggacactgtcctgccggctcgtctggagcaggtcaggcccagcagggcatcccccggatagtccctcagagcacgtccaggctgtgcccacttcccaaggacatcaccaagtcactgtccaccctcagagcacctgctcctcacacacgctgtaccccggactcccccgggtgccagggataggccagcggggaacgaggagtgaccagaacccaggactcccgccctcatctgacagccacttagcccacttcccactggggactcttccttggaaggttgctctggaaaccccctactgtgtggggtaacctcgccgggcaccccaccctggccgagcactgccatgccacacaagaaggatggaaccttcctccccaagctggggtggggcaggggctgggggagatggaaggccctgcaccgcccccagcctccctgccactccccacacctgggagatgctcaggacccccatgtagccacggccgctccccccagcttcttaccaggtcgaggacagatggggacggacgctgctgcctcggcacctgctgattagtgcggcccaccctgaggggcgcccctgttccccaaggtggttgggagggcactcgcgggtcctggggaagttggatggccctgggaatggcgggtcctggagggtgcgggagcctgagggggaacttgggggtcttaggttagaccggggcctccccgcgtggggagggcgcagcagactgtacctgggggcgcattggccgtcgtcaaactcgaaggtccggttggtgtagcccccgccgcgcgcctcccggcagacgccccccggggtccgcgccccgtcagggagtggcatgcggcctggcagctcggacccgacccgagggagaagcgagtgggagccgccaccttcttccctcgcgttgccctgaaaaacattttttttttcctcgcagattagcgaggaaaagacgccagttccagggtcgggtgcaggcgtctgtccgcgcgcgccccctgccggccgcgccgggacccgcggcggctctggcccaggctgggacgggggtgcggggtagggagggcgatccgctcccgccgcggccctctgagccctcaaaactccgaaaaacaggacggggttcgtcaatggctagaaaagcccaagcgcgccgccaccgggccctacacccctgggagggctccgtggtgggcgggggctcagggggctctgggtccttggcgggcagcagggcacatgcgctgctcggaccgccagcgtccagccgctgcgcccagggaccgtcagcacctcccgcttgtgctgctctgccgtggtcaacactggtcattgaacacaagccagattcaagacgactccccgcccccccgcccccacaccccccgcaggctgcggcatctgtgggtgggcgccacatcctgggcttggcctgggggagggggatgactgcaccccgccctgtgctctcacccagacgggcacacacagcacctttagacgggtggggaggggccccaacttaagatgctgcaggccaaagactaggaagcagagggtccccctgcgggccccctttcccgtgcacgtgctcacactgttacacatgcgtcaccctggctcagcctcacacagagctctggagaactgcgatttctgtccccagagctttgttggtttgcagggtggaccaggcccctcactaagccaggactgtgcccacgagggccagggggagggccaggtccatttggagggcgcatgccatgtactttgtggtccctggcctccccagtgtctctccagagggtccttccctgtttctccaggaggcagcaggctgaacacagatgcttttgaggggtgggtggggaacactcggggaagtctaggatgctaagtccccagcagaggttcagcctgtgcccccgccacacagctcgtgggcatcttgggggtttttcctcaggtccctagattggccggtgctgctgccggggtcccaccacccctgggcgggtgccgccggggcaagatggtggcctttctgccaacgccctcctgcctggggaactcagaaaaaactgagaggccgcaccatctgcatctgtgattaattagcagtaattacacgtgttgtcaacggcaggagagtcacaggtttgatgacattccgagggctttagggaaacaaaaacttggccccactctgccactgaggagccccagatcgccagcccgtccatccctccctggccaggggcagggccgggagaggggcccaggtccccgagagcttttgccctcctctccaaccccgtcctcctccatgtctgacctgcagccaaggctgggcggagcagggatggagacaccaccttatattacataacctccctctgctccaaacacccttcacccatctttggcccaaagtccaggatgccagcccgaggcccagagccgcgccttctccacaggagactggggcaccccggacagacgtccccgtgtggtggcacctgcccgggctccttcttgcctcccctctcgggaggagagcccctgccacccaccccacctcctcccgctacgacctcagcacgagccaggccagggatgtcctcccaacagtccagcctcaccccccaccctcgtcccctctgcttccctgagggccccccgcaacctccgtgaaagaggaagggtctccacctcccccttccctccgtcatccccccaaaagtatgtactgggggactcaagcccagcgcagggcggctcctggagttcagcggggaggtgagcaaacacctggcgccggagctttctgaatttggatgggcaggacccccgcgatcccgcagaaacctgttgagagtgtgaggtgaggggtcgagctggggccccagggcataaagcggggatggtgcttgggcagggccaggtgaagggacagacggttccgagggtgcccggcagagctcagcgggaggaagagcacggacgatggtggcctggggtggggacaagatgcccctggttctgggcgacccagaagtgtggatggtgaccctaccctgaggcgcagcgtctgcaagcgtactagatttgggggaaaatggaggcgtgggcgactggggagcaggcgggtacccttccccctccctgtgtccctgggtcccccaggcctgggctaaacaactcagcccagcccgcccactcccaccaggggctgggctcctaagggcagagcccgcatctccaaagtgcccaagggcaccgagaccaccgcataagtgggaaccgaggcg

SEQ ID NO: 2050 - DNA, 6917 bp, Homo sapiens
gaccaactcactggcgctcccaatacctgccccagccccctccctcaatgtggctggggtcaggaaaatctactggaaagctgctgggtgtggtggtctgagccctggctgtctgtcacagctggggtctgccccaggcaaaagcactattggtgcctgtgaagcatgaggacccacttctggcccctggagggagtcacaggcagatggaagccctctttgcccctcttgtggagtgccccagagtggctacaaaggaggaggcctgtgtgcctttcctgggcaccaaggggccagctgtgtctcagcctccgaggcctgagtggtgcctggcaggacacaggtgccccagggcgacggtgccaaggaggagacggtggcagctggcacacaccacaccccggcactgttgtgaggaggagccattctcacccctgggggccgtgggccatgcggcaaacattaacactgtgggaatcttttgactgggcaattccacttttaagaatccatcttgggaagtcaccggacaaatgcttagctctgacgtgtcaacacaggctggtgcgtgacaaggcaaagacgaactggctggtgtgcaagctcccgacgccaacacagctttgtaaacaccaagtatgtgctgtcagcatgggctcaacacaacctcgtaaggtccatgctagcactcccattctacagatgaggaaactgaggcccagagaggtgaagtgactcgccagagctgacacagctactgcatctcagtgctgggatggaccaacctcacagacacagttcccagaagctcctccaggccctctgctcctcccggggcgcccgccttgtgccagtccagaccctggtcctgcaatgccctccatctcctgatgcccccacctctgctccagtgaggccaccctcctctcccacctcccccacctcccgcccccgatctagggagcagctggaggccccctctcaaggagggccttcccagggacctaccccaggaagctcgcggcctctgccctgccactgtcccctgcaaacctgttacacttgccagctgctagtactggtctcacctccctgggccaatcgcatcctggcctcagttccagccccgctggctcacttccaagttccacaggtgaaagtgggtctgggtgaacatgggtggccttatccacacacacagctgggagaggtcccaagacacctttgaaagatgcccatttaaccgggccttggcacccagccacctagcacgggcacgctgagcccagcctgcctttccccagactcatgaccggtgacttcaaggtcacacaagctggctggcgggccccacacatcctcctccagctctcacacacgtgcccacggtgcgcctgcctggctcacggagcgcccaggttcacatgcacacacagcacttgtttttgggtacacgatacccgttcagcatccctcacccatgcagggctgggacacacttggacaaactttcctgttgcagagaaacctgggattgtttgtgggagacacagaagtgccaccctttccagggccgatggcacctgggtcaaagcctgcaagtttgcatcccggggaagcaggacaaaaagcctcaggggagagcccgagatgccccccaacaccctccgagggcatgagatggccccacagcaaggccccactactgccacaccaggctcgtcccaagtaattttctgtgttaatcaagagctccccatacggtgggtgaaccagaccagcacacttggaggctgccgggtgcgaggacacaggccacacccaggccagccactggaacagaagcagaggccctcgtggggaccctgtctgctcccttctcactcacctctgtcctcctgagctgttactgtggccactcctgggccacagcagacccctgagttccctgtggcctgagccgtccctcctgccggccagtgctgggcggtatcttgggccctcaaacctttcccatgagccctgagctacttcctgctgctgaaggcactgctccctaatatgggcctggagggctggccaggaccttgggccaggcatgtaccctggcaggatgccagggcctgatcccatcagggcctagagggtcccaggcccgccctggagcacagctgctgggaagtggtatttccaggaaaggcctggcaggggctctgatgcgaagtgcgctgggcagggggtgggcacttgccagctctggggccaccagggccactggtccctccctgtcctacaacagctgtcatctccagggcctgtggggaggcagctgagggcctgggactccatggcatggaggtgggagcagggagcctggaggccagaggcccgtgaagacccctgcaaactggaaggccaggagctcctctctggagccccactttccggcctgatggccttgaggctgactcagggacaccactagcgtggagctgggggtttgagctggggcactggagtggggtggggtgtccaagcacctcctggcccctctgaaccatagcaccaaggctggcatcctccagcacccaggaaagacagaggcctgctcaaggcctggcaccaagacctatggactccagggcctgggttctgaccacgctgttgcctggcaccctcctccccatgtgagagctggtggggaaacccgccccacagagctccccccaccaccaggcagcacgaaggttcttctttctgcagctgaagccacctgcctgggccgcaagccttggcctcacctggagctcagctccccgctcccgagcccagccaagcccaggtcctgctccctccccaagcctgacgcctgacatccctccactgccggcggctgctctgcctgcagtgtgacagggaatctctgttgcaacggaggccagctcagtccagcggggaggaggagctgtcccgggccggtgggcagggccaattgggagagacaggtgtctggaaggacccggaggatgaggcctggagctaaaggctggaccctgaggacactgtcctgccggctcgtctggagcaggcatcccccggatagtccctcagagcacgtccaggctgtgcccacttcccaaggacatcaccaagtcactgtccaccctcagagcacctgctcctcacacacgctgtaccccggactcccccgggtgccaggtgggtgctgtgcctgcctcttgattctgggaacctcctctccagcctggtccctcaccagaggcagcccttaaagaccatccgccctacctcctcattttacactcggggaaactgagtcccatagaacaaacaggcagccgcaccaggcctcccgctctcaggtatgctcttccacccccttctctggcctcaggacagcctgagactgggcaggatccagaagaaagggctctgtcctggtggggaggggttcgcccaaggcagtgaccggctctgcccagggttccctggagtctggctctggggacagggtgaggggcagacttgcctgttttcaagagctgagggatgggggagaggatggggaacctggaccctggggcaacctccgctcaggactgtcccactcagctgccggtccgtgcctctgcactggtcactgggtggacggcagacgcatggcatcccaggacactgcacagggaacagctagctccaggtcacctgaatgccattctcaactggccctctcctcccagggataggccagcggggaacgaggagtgaccagaacccaggactcccgccctcatctgacagccacttagcccacttcccactggggactcttccttggaaggttgctctggaaaccccctactgtgtggggtaacctcgccgggcaccccaccctggccgagcactgccatgccacacaagaaggatggaaccttcctccccaagctggggtggggcaggggctgggggagatggaaggccctgcaccgcccccagcctccctgccactccccacacctgggagatgctcaggacccccatgtagccacggccgctccccccagcttcttaccaggtcgaggacagatggggacggacgctgctgcctcggcacctgctgattagtgcggcccaccctgaggggcgcccctgttccccaaggtggttgggagggcactcgcgggtcctggggaagttggatggccctgggaatggcgggtcctggagggtgcgggagcctgagggggaacttgggggtcttaggttagaccggggcctccccgcgtggggagggcgcagcagactgtacctgggggcgcattggccgtcgtcaaactcgaaggtccggttggtgtagcccccgccgcgcgcctcccggcagacgccccccggggtccgcgccccgtcagggagtggcatgcggcctggcagctcggacccgacccgagggagaagcgagtgggagccgccaccttcttccctcgcgttgccctgaaaaacattttttttttcctcgcagattagcgaggaaaagacgccagttccagggtcgggtgcaggcgtctgtccgcgcgcgccccctgccggccgcgccgggacccgcggcggctctggcccaggctgggacgggggtgcggggtagggagggcgatccgctcccgccgcggccctctgagccctcaaaactccgaaaaacaggacggggttcgtcaatggctagaaaagcccaagcgcgccgccaccgggccctacacccctgggagggctccgtggtgggcgggggctcagggggctctgggtccttggcgggcagcagggcacatgcgctgctcggaccgccagcgtccagccgctgcgcccagggaccgtcagcacctcccgcttgtgctgctctgccgtggtcaacactggtcattgaacacaagccagattcaagacgactccccgcccccccgcccccacaccccccgcaggctgcggcatctgtgggtgggcgccacatcctgggcttggcctgggggagggggatgactgcaccccgccctgtgctctcacccagacgggcacacacagcacctttagacgggtggggaggggccccaacttaagatgctgcaggccaaagactaggaagcagagggtccccctgcgggccccctttcccgtgcacgtgctcacactgttacacatgcgtcaccctggctcagcctcacacagagctctggagaactgcgatttctgtccccagagctttgttggtttgcagggtggaccaggcccctcactaagccaggactgtgcccacgagggccagggggagggccaggtccatttggagggcgcatgccatgtactttgtggtccctggcctccccagtgtctctccagagggtccttccctgtttctccaggaggcagcaggctgaacacagatgcttttgaggggtgggtggggaacactcggggaagtctaggatgctaagtccccagcagaggttcagcctgtgcccccgccacacagctcgtgggcatcttgggggtttttcctcaggtccctagattggccggtgctgctgccggggtcccaccacccctgggcgggtgccgccggggcaagatggtggcctttctgccaacgccctcctgcctggggaactcagaaaaaactgagaggccgcaccatctgcatctgtgattaattagcagtaattacacgtgttgtcaacggcaggagagtcacaggtttgatgacattccgagggctttagggaaacaaaaacttggccccactctgccactgaggagccccagatcgccagcccgtccatccctccctggccaggggcagggccgggagaggggcccaggtccccgagagcttttgccctcctctccaaccccgtcctcctccatgtctgacctgcagccaaggctgggcggagcagggatggagacaccaccttatattacataacctccctctgctccaaacacccttcacccatctttggcccaaagtccaggatgccagcccgaggcccagagccgcgccttctccacaggagactggggcaccccggacagacgtccccgtgtggtggcacctgcccgggctccttcttgcctcccctctcgggaggagagcccctgccacccaccccacctcctcccgctacgacctcagcacgagccaggccagggatgtcctcccaacagtccagcctcaccccccaccctcgtcccctctgcttccctgagggccccccgcaacctccgtgaaagaggaagggtctccacctcccccttccctccgtcatccccccaaaagtatgtactgggggactcaagcccagcgcagggcggctcctggagttcagcggggaggtgagcaaacacctggcgccggagctttctgaatttggatgggcaggacccccgcgatcccgcagaaacctgttgagagtgtgaggtgaggggtcgagctggggccccagggcataaagcggggatggtgcttgggcagggccaggtgaagggacagacggttccgagggtgcccggcagagctcagcgggaggaagagcacggacgatggtggcctggggtggggacaagatgcccctggttctgggcgacccagaagtgtggatggtgaccctaccctgaggcgcagcgtctgcaagcgtactagatttgggggaaaatggaggcgtgggcgactggggagcaggcgggtacccttccccctccctgtgtccctgggtcccccaggcctgggctaaacaactcagcccagcccgcccactcccaccaggggctgggctcctaagggcagagcccgcatctccaaagtgcccaagggcaccgagaccaccgcataagtgggaaccgaggcg

SEQ ID NO: 2051 - DNA, 6375 bp, Homo sapiens
gaccaactcactggcgctcccaatacctgccccagccccctccctcaatgtggctggggtcaggaaaatctactggaaagctgctgggtgtggtggtctgagccctggctgtctgtcacagctggggtctgccccaggcaaaagcactattggtgcctgtgaagcatgaggacccacttctggcccctggagggagtcacaggcagatggaagccctctttgcccctcttgtggagtgccccagagtggctacaaaggaggaggcctgtgtgcctttcctgggcaccaaggggccagctgtgtctcagcctccgaggcctgagtggtgcctggcaggacacaggtgccccagggcgacggtgccaaggaggagacggtggcagctggcacacaccacaccccggcactgttgtgaggaggagccattctcacccctgggggccgtgggccatgcggcaaacattaacactgtgggaatcttttgactgggcaattccacttttaagaatccatcttgggaagtcaccggacaaatgcttagctctgacgtgtcaacacaggctggtgcgtgacaaggcaaagacgaactggctggtgtgcaagctcccgacgccaacacagctttgtaaacaccaagtatgtgctgtcagcatgggctcaacacaacctcgtaaggtccatgctagcactcccattctacagatgaggaaactgaggcccagagaggtgaagtgactcgccagagctgacacagctactgcatctcagtgctgggatggaccaacctcacagacacagttcccagaagctcctccaggccctctgctcctcccggggcgcccgccttgtgccagtccagaccctggtcctgcaatgccctccatctcctgatgcccccacctctgctccagtgaggccaccctcctctcccacctcccccacctcccgcccccgatctagggagcagctggaggccccctctcaaggagggccttcccagggacctaccccaggaagctcgcggcctctgccctgccactgtcccctgcaaacctgttacacttgccagctgctagtactggtctcacctccctgggccaatcgcatcctggcctcagttccagccccgctggctcacttccaagttccacaggtgaaagtgggtctgggtgaacatgggtggccttatccacacacacagctgggagaggtcccaagacacctttgaaagatgcccatttaaccgggccttggcacccagccacctagcacgggcacgctgagcccagcctgcctttccccagactcatgaccggtgacttcaaggtcacacaagctggctggcgggccccacacatcctcctccagctctcacacacgtgcccacggtgcgcctgcctggctcacggagcgcccaggttcacatgcacacacagcacttgtttttgggtacacgatacccgttcagcatccctcacccatgcagggctgggacacacttggacaaactttcctgttgcagagaaacctgggattgtttgtgggagacacagaagtgccaccctttccagggccgatggcacctgggtcaaagcctgcaagtttgcatcccggggaagcaggacaaaaagcctcaggggagagcccgagatgccccccaacaccctccgagggcatgagatggccccacagcaaggccccactactgccacaccaggctcgtcccaagtaattttctgtgttaatcaagagctccccatacggtgggtgaaccagaccagcacacttggaggctgccgggtgcgaggacacaggccacacccaggccagccactggaacagaagcagaggccctcgtggggaccctgtctgctcccttctcactcacctctgtcctcctgagctgttactgtggccactcctgggccacagcagacccctgagttccctgtggcctgagccgtccctcctgccggccagtgctgggcggtatcttgggccctcaaacctttcccatgagccctgagctacttcctgctgctgaaggcactgctccctaatatgggcctggagggctggccaggaccttgggccaggcatgtaccctggcaggatgccagggcctgatcccatcagggcctagagggtcccaggcccgccctggagcacagctgctgggaagtggtatttccaggaaaggcctggcaggggctctgatgcgaagtgcgctgggcagggggtgggcacttgccagctctggggccaccagggccactggtccctccctgtcctacaacagctgtcatctccagggcctgtggggaggcagctgagggcctgggactccatggcatggaggtgggagcagggagcctggaggccagaggcccgtgaagacccctgcaaactggaaggccaggagctcctctctggagccccactttccggcctgatggccttgaggctgactcagggacaccactagcgtggagctgggggtttgagctggggcactggagtggggtggggtgtccaagcacctcctggcccctctgaaccatagcaccaaggctggcatcctccagcacccaggaaagacagaggcctgctcaaggcctggcaccaagacctatggactccagggcctgggttctgaccacgctgttgcctggcaccctcctccccatgtgagagctggtggggaaacccgccccacagagctccccccaccaccaggcagcacgaaggttcttctttctgcagctgaagccacctgcctgggccgcaagccttggcctcacctggagctcagctccccgctcccgagcccagccaagcccaggtcctgctccctccccaagcctgacgcctgacatccctccactgccggcggctgctctgcctgcagtgtgacagggaatctctgttgcaacggaggccagctcagtccagcggggaggaggagctgtcccgggccggtgggcagggccaattgggagagacaggtgtctggaaggacccggaggatgaggcctggagctaaaggctggaccctgaggacactgtcctgccggctcgtctggagcaggcatcccccggatagtccctcagagcacgtccaggctgtgcccacttcccaaggacatcaccaagtcactgtccaccctcagagcacctgctcctcacacacgctgtaccccggactcccccgggtgccagggataggccagcggggaacgaggagtgaccagaacccaggactcccgccctcatctgacagccacttagcccacttcccactggggactcttccttggaaggttgctctggaaaccccctactgtgtggggtaacctcgccgggcaccccaccctggccgagcactgccatgccacacaagaaggatggaaccttcctccccaagctggggtggggcaggggctgggggagatggaaggccctgcaccgcccccagcctccctgccactccccacacctgggagatgctcaggacccccatgtagccacggccgctccccccagcttcttaccaggtcgaggacagatggggacggacgctgctgcctcggcacctgctgattagtgcggcccaccctgaggggcgcccctgttccccaaggtggttgggagggcactcgcgggtcctggggaagttggatggccctgggaatggcgggtcctggagggtgcgggagcctgagggggaacttgggggtcttaggttagaccggggcctccccgcgtggggagggcgcagcagactgtacctgggggcgcattggccgtcgtcaaactcgaaggtccggttggtgtagcccccgccgcgcgcctcccggcagacgccccccggggtccgcgccccgtcagggagtggcatgcggcctggcagctcggacccgacccgagggagaagcgagtgggagccgccaccttcttccctcgcgttgccctgaaaaacattttttttttcctcgcagattagcgaggaaaagacgccagttccagggtcgggtgcaggcgtctgtccgcgcgcgccccctgccggccgcgccgggacccgcggcggctctggcccaggctgggacgggggtgcggggtagggagggcgatccgctcccgccgcggccctctgagccctcaaaactccgaaaaacaggacggggttcgtcaatggctagaaaagcccaagcgcgccgccaccgggccctacacccctgggagggctccgtggtgggcgggggctcagggggctctgggtccttggcgggcagcagggcacatgcgctgctcggaccgccagcgtccagccgctgcgcccagggaccgtcagcacctcccgcttgtgctgctctgccgtggtcaacactggtcattgaacacaagccagattcaagacgactccccgcccccccgcccccacaccccccgcaggctgcggcatctgtgggtgggcgccacatcctgggcttggcctgggggagggggatgactgcaccccgccctgtgctctcacccagacgggcacacacagcacctttagacgggtggggaggggccccaacttaagatgctgcaggccaaagactaggaagcagagggtccccctgcgggccccctttcccgtgcacgtgctcacactgttacacatgcgtcaccctggctcagcctcacacagagctctggagaactgcgatttctgtccccagagctttgttggtttgcagggtggaccaggcccctcactaagccaggactgtgcccacgagggccagggggagggccaggtccatttggagggcgcatgccatgtactttgtggtccctggcctccccagtgtctctccagagggtccttccctgtttctccaggaggcagcaggctgaacacagatgcttttgaggggtgggtggggaacactcggggaagtctaggatgctaagtccccagcagaggttcagcctgtgcccccgccacacagctcgtgggcatcttgggggtttttcctcaggtccctagattggccggtgctgctgccggggtcccaccacccctgggcgggtgccgccggggcaagatggtggcctttctgccaacgccctcctgcctggggaactcagaaaaaactgagaggccgcaccatctgcatctgtgattaattagcagtaattacacgtgttgtcaacggcaggagagtcacaggtttgatgacattccgagggctttagggaaacaaaaacttggccccactctgccactgaggagccccagatcgccagcccgtccatccctccctggccaggggcagggccgggagaggggcccaggtccccgagagcttttgccctcctctccaaccccgtcctcctccatgtctgacctgcagccaaggctgggcggagcagggatggagacaccaccttatattacataacctccctctgctccaaacacccttcacccatctttggcccaaagtccaggatgccagcccgaggcccagagccgcgccttctccacaggagactggggcaccccggacagacgtccccgtgtggtggcacctgcccgggctccttcttgcctcccctctcgggaggagagcccctgccacccaccccacctcctcccgctacgacctcagcacgagccaggccagggatgtcctcccaacagtccagcctcaccccccaccctcgtcccctctgcttccctgagggccccccgcaacctccgtgaaagaggaagggtctccacctcccccttccctccgtcatccccccaaaagtatgtactgggggactcaagcccagcgcagggcggctcctggagttcagcggggaggtgagcaaacacctggcgccggagctttctgaatttggatgggcaggacccccgcgatcccgcagaaacctgttgagagtgtgaggtgaggggtcgagctggggccccagggcataaagcggggatggtgcttgggcagggccaggtgaagggacagacggttccgagggtgcccggcagagctcagcgggaggaagagcacggacgatggtggcctggggtggggacaagatgcccctggttctgggcgacccagaagtgtggatggtgaccctaccctgaggcgcagcgtctgcaagcgtactagatttgggggaaaatggaggcgtgggcgactggggagcaggcgggtacccttccccctccctgtgtccctgggtcccccaggcctgggctaaacaactcagcccagcccgcccactcccaccaggggctgggctcctaagggcagagcccgcatctccaaagtgcccaagggcaccgagaccaccgcataagtgggaaccgaggcg

SEQ ID NO: 2052 - DNA, 634 bp, Homo sapiens
aagggaaaaaaagcacaaataaaaattgtaacacgaaaggggggtcataacataggaaaaagagatttttttaattacagaagaatattatggaagctttatgccatgagatttgaatgaatctactttcactggggagacattagcgtacctgccgtgttgggcgatattcaggtgcttaggatggtcagtggataaaacaaagaccctgccccatggagcttgcgttctggtctgcattttgtcttaaattgtccttgcatggctttggtgtcaaggttgtactagcctcatgaaatgatttcatcccttctctgaaattgtttgagtcaaatagttattatttcttcttgaaaggcttggtgaaactcgccttataatgactgggccccaggcaggaggcagaaagataggaagagaactttgactgtctgttaaatttcttttataattatgaaatgtccaggttttcaaaatttcttcttgagctaatttaatccacttaatgtcttcctataaaaatgcatgttttggccaggcacggtggctcatgtctgtaatcccagcactttgggaggccaaggcgggctgatcacgaggtcaggagatcaagaccatcctggctaacacggtg

SEQ ID NO: 2053 - DNA, 1842 bp, Homo sapiens
  misc_feature (120)..(120): n is a, c, g, or t
ccctgttcttgggtgggtgtgggtataatactaagttgagatgatatcatttacgggggaaggcgctttgtgaagtaggccttatttctcttgtcctttcgtacagggaggaatttgaangtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacagctgaaccctcgtggagccattcatacaggtccctatttaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatgggtgttaaattttttactctctctacaaggttttttcctagtgtccaaagagctgttcctctttggactaacagttaaatttacaaggggatttagagggttctgtgggcaaatttaaagttgaactaagattctatcttggacaaccagctatcaccaggctcggtaggtttgtcgcctctacctataaatcttcccactattttgctacatagacgggtgtgctcttttagctgttcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctggtaaagcgggggagggggggtttggtggaaattttttgttatgatgtctgtgtggaaagtggctgtgcagacattcaattgttattattatgtcctacaagcattaattaattaacacactttagtaagtatgttcgcctgtaatattgaacgtaggtgcgataaataataggatgaggcaggaatcaaagacagatactgcgacatagggtgctccggctccagcgtctcgcaatgctatcgcgtgcataccccccagacgaaaataccaaatgcatggagagctcccgtgagtggttaatagggtgatagacctgtgatc

SEQ ID NO: 2054 - DNA, 1458 bp, Homo sapiens
  misc_feature (128)..(128): n is a, c, g, or t
ttaacaaaccctgttcttgggtgggtgtgggtataatactaagttgagatgatatcatttacgggggaaggcgctttgtgaagtaggccttatttctcttgtcctttcgtacagggaggaatttgaangtagatagaaaccgacctggattactccggtctgaactcagatcacgtaggactttaatcgttgaacaaacgaacctttaatagcggctgcaccatcgggatgtcctgatccaacatcgaggtcgtaaaccctattgttgatatggactctagaataggattgcgctgttatccctagggtaacttgttccgttggtcaagttattggatcaattgagtatagtagttcgctttgactggtgaagtcttagcatgtactgctcggaggttgggttctgctccgaggtcgccccaaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacagctgaaccctcgtggagccattcatacaggtccctatttaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcctgtgttgggttgacagtgagggtaataatgacttgttggttgattgtagatattgggctgttaattgtcagttcagtgttttaatctgacgcaggcttatgcggaggagaatgttttcatgttacttatactaacattagttcttctatagggtgatagattggtccaattgggtgtgaggagttcagttatatgtttgggattttttaggtagtgggtgttgagcttgaacgctttcttaattggtggctgcttttaggcctactatggggggtgatctaaaacactctttacgccggcttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgttccttttgatcgtggtgatttagagggtgaactcactggaacggggatgcttgcatgtgtaatcttactaagagctaatagaaaggctaggaccaaacctatttgtttatggggtgatgtgagcccgtctaaacattttcagtgtattgctttgaggaggtaagctacataaactgtgg

SEQ ID NO: 2055 - DNA, 995 bp, Homo sapiens
ttaacaaaccctgttcttgggtgggtgtgggtataatactaagttgagatgatatcatttacgggggaaggcgctttgtgaagtaggccttatttctcttggccctgttcaactaagcactctactcttagtttactgctaaatccaccttcgacccttaagtttcataagggctatcgtagttttctggggtagaaaatgtagcccatttcttgccacctcatgggctacaccttgacctaacgtctttacgtgggtacttgcgcttactttgtagccttcatcagggtttgctgaagatggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttgatttaactgttgaggtttagggctaagcatagtggggtatctaatcccagtttgggtcttagctattgtgtgttcagatatgttaaagccactttcgtagtctattttgtgtcaactggagttttttacaactcaggtgagttttagctttattggggagggggtgatctaaaacactctttacgccggcttctattgacttgggttaatcgtgtgaccgcggtggctggcacgaaattgaccaaccctggggttagtatagcttagttaaactttcgtttattgctaaaggttaatcactgctgtttcccgtgggggtgtggctaggctaagcgttttgagctgcattgctgcgtgcttgatgcttgttccttttgatcgtggtgatttagagggtgaactcactggaacggggatgcttgcatgtgtaatcttactaagagctaatagaaaggctaggaccaaacctatttgtttatggggtgatgtgagcccgtctaaacattttcagtgtattgctttgaggaggtaagctacataaactgtgg

SEQ ID NO: 2056 - DNA, 387 bp, Homo sapiens
cttttttccaaaaatgttaacagcacagggaaaaatgaatacaaatagtgtttacattgtaaatccaagttgttctctctctctctctctctttttttagaaagaacattacatggcatttcctactgaagatgggacttagcacaaaaaccatcatggattccatcaaagagatcattaatgtctcaaaacgtctccaaggatacatgatctacaaaggaccacagagtgccctgcagaattgggttgaaaaactaaagaaggcaaacagagtttatggtaaggcggcagtctctggtccccgttgtgagattgggttcttcctgcctgttcctggagtggcatggagaaaagagcatggatttgcagaagagacacttgagagag

SEQ ID NO: 2057 - DNA, 460 bp, Homo sapiens
aaagacaaggtctcactctgttgcccaggatggagtgcagcgatgtgatcagagctcactataaccccaaactcctggactcaagcaatctgcccctcagactcccaagcagctgggattacagcctctgttgtcccatagagagttgacattcctggacatctatgtggcttcacccgggccccttcagcacctactgaggcctgaaacttcaaccaagtttggaagtgatgggagatgctggagacttgggcgtgtgtcttgttagcttgagatggtggaggcatgcatgtctaccaaacatgtgggacattaggaaggtcccgttgagcagacagtccaagcaagcagatacaatggttgcacctcgtcaccctcacaacctcacagcagactggattggggaagatgcctgacacggtggatgcagtgggtggatgcagcatctatcagttaccag

SEQ ID NO: 2058 - DNA, 638 bp, Homo sapiens
ggttggtaagctttttattattacctcaatttcagagctcattactggtctgttcagggattcagtttcttctggttcggtcttgagagggtgtatttgtccaggaattcatccatttcttctaaattttctagttcatgtgcatggaagtgttcatattattctctgatggttgtttgtatttcagtggggtcagtggtaatatcccccttgtcatttctttttgtgtttatttgaatcttctctcttttcttttttattagtctagctagcagtctattttattaattttttcaaaaaaccagctcctggatttgttggtcttgtgaatggtttttcatgtctcaatatccttcagttcagctcggattgtcgtctgctagctttgggatttgtttgctcttggttctgtagttctttcagttgtgatattaggttgttagcttgagatctttctaactttttcaatgtgggcatttagtgctataaatttccctcctaactctgtcttagctgtgtcccagagattctggtatgttgtatcttttttctcattagtttcaaagaacttcgtgatttctgccttaatttcattatttacccccaaagtcattcaggagcaggttattcaatttcca

SEQ ID NO: 2059 - DNA, 521 bp, Homo sapiens
cttcttataaaagaataaagaagaggttctctctttccatccttaggaaaaggtgggctgttttggcttcctaccatggaggaggaccttgaaggagaaaactggcagaccttctccattccctggtgcttcagcagggcagctgaggatgaaggagaacatatttgccatgctctgagttcctctaacagaataccacctcatctggggctgaaaactcaaatgcctacaggatgccaggcaagtaaactaaaaaggagtactgagcagcaagaagggaccatggcaattgtggaaagtttgagcatgcaagtctaactaaaggcatttaaacacacgtttttaagaacactggggaggctgaatgaaacacatccaagggccaccactttgcaactcctgaaccaagcaaaaccaactggtgtcctgttgtatgcgtgtgttgtagagctttaaagctataatcccttgaattatttgatatttctttataacttttaacatgccattttgttgccagc

SEQ ID NO: 2060 - DNA, 1512 bp, Homo sapiens
cacgtttgctgaaattactcctagatttctagatgagtatgtaaatttttctgctcccaaagctctggcatctagtttgagtcaatctgagctctataacaggtgaagacatcatattagtttgcagactagactatcaataggagaaataggacgaaagcagcactttaaaaatggatattaaactaccacgatcttgagcaaacatctttatttaagaaatcaaatagggtaaaaattatgcaatttcacacaaggatacaagacaaagcttagaattacttgctcaaaagttactcagaatggaacaaaattgttcaagtgctcccaattagcacaggctgtattacttgcttttcaatggacatttactattttacattaagatctacttataggaacaaagagacaattcccagccccctctggtgtatcacctaaaagactgaatacaaatgttaatgtaatccaagcttttctttgacaacaatactaaaaattgccttacaattttttacaagtacgagtatcaacagtttactgtctgagggaaaggaaatataagaatataaagtgacagaagcaacacacttcactgtggcctgcaactgctcccagcgtcctattttataaacatgatttgggttctcacattatagcaggatcactattcctagcctctggtggaagcagacatgtgacacttagcactgcacaagtgtttctttggcttcttgagtagtgctgtgtatactgcctatacatttttataacatctctaaatgcataatgtcaacgtatgtgctatcacatttcactcccaactgcagaatattttaattttaaatttatctaccaaatcttgactatgacatttatttttgggttgttacattaagatcaacctatctgggccgggcacggtggctcacacctgtaatcccagcactttgggaggctgaggcaggagaattgcttgaagtcaggaggcagaggttacggtgaaacaactgccattgcactccagcctggacaacagagcgaaactccatctcaaaaaaaaaaaaaaaaccccaaagatcaacctatctgaattggggatccctaataaaatcagctatgaggacaacaaggtgaagaatgaaaccaatttaccttcacaatcatctaaaggtaactaccatgaagttgtgttcctaaatacatattcacctggctgtgaagacttacctgcggagggagttgccagagatagttctgatgggggaaagctagtctgaaaggtaaactgcagcctaagggagttacttcaataggccagtttcctgacaaaggtcgaatcctttctcatcagaatttaaaaattatagaacataccatacctttatatataaatcataaacatcagtaaagaagttctttattccatcttcttgtcttatgtcatgaagcataataaacctcatatgtgaaataattaaggcataatctttcttagaaatgaaaaacaaa

SEQ ID NO: 2061 - DNA, 285 bp, Homo sapiens
ctggatctccagcttgctgactgcagatcttgggactactcagcttcgataatcatccacgttggaaaccccagtcaagccttcagatgactaaagcctgaactgacatcttgattgccaatgtgcaagagatgctgagccagaactcccagctaagctacttctaaattcctgacccacagaaagtatgtgagacagtggggcatggtagctcatgcctgtaatcccagcactttgggaggccaaggtgggaggattgcttgagccgaggaatttgagatcagc

SEQ ID NO: 2062 - DNA, 324 bp, Homo sapiens
ccctcccttgggctcacgtccctactccgcctgaggccgaccgtcccgcgaattcgaatttcttttttacacccttgcgactacgccacgcctttcacgtaagggctaaagtcagctcgttcgggccacgcccctgcggtacgcctgggtcacgcctcttccgctaagccttgctgcctgcgctcctcactggcggggccgttcccgccgtggccgttcccaccgtggctaaccccttccattctctcggaacaggcaagacccctctgttacatagatgactaaaagcttatgaagaaatttgtcacttttaagaaatgcaag

SEQ ID NO: 2063 - DNA, 219 bp, Homo sapiens
ctcacatttggcaccttgggctgccttgtaagaatctgactaccctgaagctgccttatcgggaggaagcccagacaacatgaagaggtcacctggaagtgcttggattgacaacccgaggacagcatcaactgacagctatggggctggatgaggaactggcttttgcccacctgtctgggagcactaacaggggcaagcacattctagatacctggg

SEQ ID NO: 2064 - DNA, 1588 bp, Homo sapiens
gtgaagttcaagttcgcaggacggttttcattccccacgacccccacgggtcaaggtcctcttgactttgggtctgggcacctaagggaagtaggaaagagcttgcaggcctggcagctgtggcctaggtaatatgaccacggcgctggcagtgccactgacttcacacagaaacacaccatggggacccgggactcagggccctggcccctgcagagtgctgggattatgagccaccacgcccgaccagaagacgaacactttctacagcctggagagtctaaagggactaaccaacactgcaaccctcatttgtaaggaggatgaaaacaacaaaataactacattaaatgagaagcaaaaactcttttataaattgcctgcctctcttctttcctctacagccaaacttcttgaaaaagatacctacatttggtctctctactttctcattttctattcctcaactcatgccaatttggttttggcccctcttcacagtaataagctaaggagcagttctcaaaccataaccacttcttcctccctggattcctgattttctttctacctctttttgttcttatttgcgactcctccttgtctcttaaaaactgatgtttctccaagttcccatgccaggctatcttctcacactgatttccctggatgatctagcccacgctcacggctttaatgttctagatatcttcattcagatgattcaaaaacatttcaagacaaattacttactgttctactgtatatctccatttgggtgtcacacaggctcaaactcaatctacccaaactgaactcacccctttcttcccatacatacatgtttctcctcctgtgtttcccctcagtaaatggtaccactatccactcacagttgttcatgttagaattttgggcatcattcttcacatctcttccctgtcccctccttctctgaatatcccatcaccaaatccactgattccacttcttataaaaagcaccatatatctatctgtccacttgtatctccctcactgccagttctccagtacaggtcacaatgatcttatgtctatagatcattttaacactctctgggatcttactccactgcaatacattccacactgtggccacagtgctctttctagatggtattatctgttcaaaaccctacaatggctcatccaatgcctcagtctctctcacaaggcctattagaactgcatgatcagaaactcctgccattcccatcttacatcaattctagtcagactggacaattttcatcccatccaataagccacgccaagtttatcaagtctttgcatctgctgttcacactctagatggaaagctcaactaaccaattcccacgttacattccccattaagtcttctgcactccccaaatcccttcaggtaccatgccccccgtgatgcactttgcattttccctattatagctattaacatattttatggcaactacattatttgcttctatatcccattagacaatcttatttattgccatattcccaaaaacataataaaaacaggtccacaacctcttatctgaaat

SEQ ID NO: 2065 - DNA, 913 bp, Homo sapiens
cttataggtgacaggtcatttttctatttgtgcttgcaagatattctctttggatttcaagatttttgaccatgatgtgcctgagtgttttgtcctgtctaaccatggctggaatctctcaaaaatgagcagtaagggagttcccacaagggagtggctgaaattgaggagagaggccatttctcctactgtcccctgtctccaaagaaaaggaggaagtaaaaactgaaaaataacagactgatcggcaccactggccaggcctgtaggttaaagattaacccacaacctaaccgcttgtgatatctatatatcacagacaatggtatggagaaacacttgccttgctcaccacccccacctagtcatgtaccccatgcttgttcaatctatcacgaccctttcacgtggaccccttagagttgtaagcccttaaaagggccaggaactctttcttaggggggcttcgttcttgagacgcatgtctgccaacgctcctgaccaaataaagcctcttccttacatttcttggttccctgaccgggaagcgaggtgattaacgatggtcgaggcagccccttaggcggcttaggcctgccctgcggagcatccctgcaggggactccggccagtttgagcaacgcggatcctgagagcactcccgggtaggcatttgccctcgtggaacacctcgtcagagcggtgcatggcaggcccccacagaggatcaatgcagcggctgaacaccaggaaggaactggcacttggagtctggacatctggaatatgtgggaggatctggagtcagctgtcaccactcagtacacttggacccggctcccccaagggttcaagaactcccccaccatcttcggggaggcactggctcgagacctccagaaaattcccacca

SEQ ID NO: 2066 - DNA, 349 bp, Homo sapiens
ctcccctagaaagggagggggactggctcaggggacaccctccccctcagataaggggctggggagaatgaggtcagggaagcaagtccagtggtacaggataccaccccttgggagtggcgcctggggtctgaggtacatggtcagtgggtccttgaaggggcagacactaaccatgcttcccagaagacctgaaattgtgatgggagaagaggggttaggaagcagaggaacagggttcttgcccctgggcactcacatgaaaggaaggggaacagccccttgtgaacctccacctgggtgctcagctccatgtgaggtatttcacaaagtccccaacagacacagg

SEQ ID NO: 2067 - DNA, 851 bp, Homo sapiens
aactccagccattacaatagacatttatttaaagtaaaacatctgcagaccaaataattcttaaaattgtttgtttcaagtttaaccatcttcataacagctgcatccacagacttcaactacatgattacttctttgcccattcttctctttcttttctttcccgaataacctcttgcacatacagttcaaggtagaaattttcctcttcatatttggtccactgctctttaggcaagatctgatgcttcatggtcaggtccaatgcactcttaatgtgacacatcctgtcattataaaggttctcaggaagccttcttatggcttcttttatgtcttcatcctcatatattgtatcatctctcattaaccccagtttattgaatcctgcagtattgtaataccattttcgaataccatccagccacttgcctgatgctgaaatggcctgcttgccagccattttgacctgctttaattttttttaatccttcttataacaagatacaaaaattatacactggctgctcatcccaacagaatttggcaatataaaacattttctttcattaaatacatagaaaaagtgtgtttaagcgtttttagcaagaagactacatgggcgatgttctgtccttcttaggcacaaaattctagtttatcccaagagcatagatacctttggggattttacagatagctaggtgggtattttttacttcccccttaagaaagttacttttctggacacgggtcaaattatggtttataatttgcaccatattccatgtctaggttacctgtttacagaaatgctcagcatgaagaggagtttctatatctgttctgcc

SEQ ID NO: 2068 - DNA, 503 bp, Homo sapiens
cagacatggtctttcattcgtgaagcagcaaataaggccatgcctctccctgttaacacctttttgtcctctgaacgtaactgtcttacaggcacagacgtgtttccagacaatccagatgatgcttctgctacagcgacatggtaaataccaacccgtctctcaacaatacccccaaaattaagattttctttttccaagatgtccacgtcaccccctatgtcatgcctgaagtaattattgagcccagtcccaaggcgcaagggccacttgtgtcagcagtgtgcaccagcagcgtgcgccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgccattttaggcctcagc

SEQ ID NO: 2069 - DNA, 1519 bp, Homo sapiens
gcatgatttatagtcctttgggtctatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcaccattcttaaagaaaggaattttcaactgagaatttcttatccagacaaactaagcttcatgagcaaaggagaattaagatccatctcagacaaacaaatgctaagggaatgaatttccacaagacaaaccttacaagaagtcccgaagtgattgctaaatatggaaaggaaacaacattactggccactacaaaaactcacttaagtacatagaccagtgacactataaagcaaccacacaaacaagtctgcataataaccagttaacaacatgttgacaggatcaaatttgcacatatgaatactaaccttgatttcaaatgacctaaatgccccaattaaaaggcacagagtggcaacttggataaataagcaaaacccagcattctgaatttaagagactcatctcacaagcaatgacatgcatagattcaaagtaaagggatggagaataatctaccaagcaaataaaaaacaaacaaacaaatgaaaaacttgggtttctattctaattctaggcaaaccagactttcaaacaacaaagatcataaaagacaaaaggaggcagagcaagatggtggaattgaaggctacaccaattgtatttctataaggacaccaatttacaactatctacacagagaagaccccttcatgagaaccaaaaatcagagatgccctgcccagagcggaggactctagagaggcagtctggctacagaggctttgctgagctacagagggctccatccagttggaacttccaagatactttgtttacactttgatgggaaaaccacctactcaagcctcagtgaaagtggaagcccctccccacaccaagctcgagcttctcaggttgacttcagtctgctctgctggcagtgagaattttaagcccgtggatcttagcttgctgggctctgtgggtgtggaatctgctgagctagaccactcggctccttgtcttcagccccctttccagtaaatcttgctgctgctcactctttgggtctgtgccacctttaagagctgtaacactctctgcgaaggtctgtggcttcattcttgaagtcagcgagaccaagaacccagtggaaggaaccaactatggacacatcttggtgacccagatgggactatcgccaagcggtgagtaccattgcaccccttttgcttgctattctgtcctatttttccttaggatttgggggctaaacaccaggcacctgtcagccagttaaaagctactagcgcggccaccagactaaagacacggttgtcaggctttctgggaaagggctctctaacaacc

SEQ ID NO: 2070 - DNA, 670 bp, Homo sapiens
gcgaagatgaaacctgtgctgcctgaggcaacagtgatggcctccctaaggcagttgccaggcaagataatgctgattctcctcaggagccacctccaacaccactgtttgattctagacctataactagactaaagttccagcaggcctgtagagatctaacagagggaactacagtcactcaactacaaaatttaaatacaatgggaataattggatcctgaggtggcaggggaaaagtggcagcactcaaccatcaaaggcaaggtaagcatagctatcataatggacactagagaaaaaacagtaatcagaatagtctgactcatgtagagctctgggattggctaattaatcatggtgttcctagaagtgaaactgataggaagcctactgcattcctacttaatttatgtaagcagaaaacttctaggtagaatggacaaaagactaatttgaattgtaaaaacagaatcacggcccctcaatcaatttcccaacttgaaccagtttacacgcccagaaccccttgaatgaagggaaggccaggaccccttgaggaaaggctccactacactaccgatttaccagagtaactgtgcattggggaaagggatcagacatttcagggactactggacactggctctgagctgatgttgattccagg

SEQ ID NO: 2071 - DNA, 1103 bp, Homo sapiens
aggaatccaacttacaagggaagtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccagactttcttcacagaattggaaaaaactactttaaagttcatatggaaccaaaaaagagcccgcattgccaagtcaatcctaagccaaaggaacaaagctggagacatcacgctacctgacttcaaactatactacaaggctatagtaaccaaaacagcatggtactggtaccaaaacagagatatagataaatggaacagaacagagccctcagaagtaatgccacatatctacaactatctgatctttgacaaacctgagaaacacaagcaatggggaaaggattccctatttaataaatggtgctgtgaaaactggctagccatatgtagaaagctgaaactggatcccttccttacaccttatacaaaaattaattcaagatggatgaaacacttaaatgataggcctaaaaccataaaaaccctagaagaaaacttaggcattaccattcaggacataggcatgggcaaggacttaatgtctaaaacaccaaaagcaatggcaacaaaagccaaaattgacaaatgggatctaattaaactaaagagcttctgcatagcaaaagaaactatcatcagagtgaacaggcaacctacagaatgggagaaaatttttgcaacctactcatctgacaaagggctaatatccagaatctacaatgaactcaaacaaatttacaagaaaaaaacaaccccatcaaaaagtgggcgaaagacatgaacagacatttctcaaaagaagacatttatgcagccaaaaaacacatgaaaaaatgctcaccatcactggccatcagagaaatgcaaatcaaaaccacaatgagataccatctcacaccatttagaatggcaattattaaaaagtcaggaaacaacaggtgctggagaggatgtggagaaataggaa

SEQ ID NO: 2072 - DNA, 1356 bp, Homo sapiens
gtttgctcttctttttctagtgccttcagatgtaaagttaagttgttaattgagatctttctttcttttttaggtggaagaaatatggatatgctgtattctgtttgaaaggattcatcatgaaccagaaaaaaatcaatgaaaaggggcatttcacctagattaaattttgcaatttttaaaaagcatatgaacaaagaaactatcctccaaacatccaaataaggaagaatactttacctaacaataggaacaaattaaaaataattgattcagcctaagacttttttttcagcgaagaagtagtttaataattgcagggccagccaaataaggagaaagggaaaaaacttctcaaacccatctctctgagaatttggaggctaggtttttttaaggacactttggcaggcaggggataggaaacttttaagaaatgattgactggggatgaaatcacaggggtacctaaaactgtctcggcttagctgagtcagttcctgggagggggctgtcttgggaccaggtggcatctcttggtcagctcttggtctgcttataaatctgaaaaatatctcaaagaccagtttttttaagtttcataatagtgatgttatctataggagtagttggagaagtgtaaaacttgtgacccccagttacatgactcggcagctgtaagcaacttatagaaaaacacataaagcaatggcagcatcccccagacatctagactatgccagtcctgtctgccttctgagagagatgagaaagaaacccatttctcaagcagtccccccaaaaagacagaatgtgggacacatgccacaactttttcccttcctagagagaagctgagaattgggagttttcaccctctcgttctatgccgagctgggaggagggagtatggaagaagccaagaattgggagttttctgctgatgatgctatgctaagctgggcagagagaccatggcgaaaaacgccacagcactccaaccttcaggaaccaccacgctgatcagtcagcagctgtcaacatcgaggaaagacctcccactagcaaaaacattccaactcaatgaaggctcagatagcatttttaacaatgaagtatttttaaattaaggtatgtacatttctagacataatgctattgcacacttaagagactgaagtatagtataaaaataacttctgtatgcactgggaaacagaaaaatttatgtgactcactttattgcgatacttgctttaggcagttgtgtggaactgaaaccgcaatatctgagatatgcttgtatatatatatatatatatatatatatatatatatatatattcatctttagcc

SEQ ID NO: 2073 - DNA, 1176 bp, Homo sapiens
gtttgctcttctttttctagtgccttcagatgtaaagttaagttgttaattgagatctttctttcttttttaggtggaagaaatatggatatgctgtattctgtttgaaaggattcatcatgaaccagaaaaaaatcaatgaaaaggggcatttcacctagattaaattttgcaatttttaaaaagcatatgaacaaagaaactatcctccaaacatccaaataaggaagaatactttacctaacaataggaacaaattaaaaataattgattcagcctaagacttttttttcagcgaagaagtagtttaataattgcagggccagccaaataaggagaaagggaaaaaacttctcaaacccatctctctgagaatttggaggctaggtttttttaaggacactttggcaggcaggggataggaaacttttaagaaatgattgactggggatgaaatcacaggggtacctaaaactgtctcggcttagctgagtcagttcctgggagggggctgtcttgggaccaggtggcatctcttggtcagctcttggtctgcttataaatctgaaaaatatctcaaagaccagtttttttaagtttcataatagtgatgttatctataggagtagttggagaagtgtaaaacttgtgacccccagttacatgactcggcagctgtaagcaacttatagaaaaacacataaagcaatggcagcatcccccagacatctagactatgccagtcctgtctgccttctgagagagatgagaaagaaacccatttctcaagcagtccccccaaaaagacagaatgtgggacacatgccacaactttttcccttcctagagagaagctgagaattgggagttttcaccctctcgttctatgccgagctgggaggagggagtatggaagaagccaagaattgggagttttctgctgatgatgctatgctaagctgggcagagagaccatggcgaaaaacgccacagcactccaaccttcaggaaccaccacgctgatcagtcagcagctgtcaacatcgaggaaagacctcccactagcaaaaacattccaactcaatgaaggctcagatagcatttttaacaatgaagtatttttaaattaaggagcatggaatgttcttccatttgtttgtgtcctctttgatttcc

SEQ ID NO: 2074 - DNA, 830 bp, Homo sapiens
ctttttctagtgccttcagatgtaaagttaagttgttaattgagatctttctttcttttttaggtggaagaaatatggatatgctgtattctgtttgaaaggattcatcatgaaccagaaaaaaatcaatgaaaaggggcatttcacctagattaaattttgcaatttttaaaaagcatatgaacaaagaaactatcctccaaacatccaaataaggaagaatactttacctaacaataggaacaaattaaaaataattgattcagcctaagacttttttttcagcgaagaagtagtttaataattgcagggccagccaaataaggagaaagggaaaaaacttctcaaacccatctctctgagaatttggaggctaggtttttttaaggacactttggcaggcaggggataggaaacttttaagaaatgattgactggggatgaaatcacaggggtacctaaaactgtctcggcttagctgagtcagttcctgggagggggctgtcttgggaccaggtggcatctcttggtcagctcttggtctgcttataaatctgaaaaatatctcaaagaccagtttttttaagtttcataatagtgatgttatctataggagtagttggagaagtgtaaaacttgtgacccccagttacatgactcggcagctgtaagcaacttatagaaaaacacataaagcaatggcaggtctgttgaagtttgctggaggtccactccagaccctgtttccctgggtatcaccatcgaggctgtagaacagcaaagattgcttcctattctttcctctggaagcttcctcccagaggtgcacc

SEQ ID NO: 2075 - DNA, 694 bp, Homo sapiens
ggaactatgaacttccctcttggtattgcttttgctgtatcccttgagttttgcatcccccagacatctagactatgccagtcctgtctgccttctgagagagatgagaaagaaacccatttctcaagcagtccccccaaaaagacagaatgtgggacacatgccacaactttttcccttcctagagagaagctgagaattgggagttttcaccctctcgttctatgccgagctgggaggagggagtatggaagaagccaagaattgggagttttctgctgatgatgctatgctaagctgggcagagagaccatggcgaaaaacgccacagcactccaaccttcaggaaccaccacgctgatcagtcagcagctgtcaacatcgaggaaagacctcccactagcaaaaacattccaactcaatgaaggctcagatagcatttttaacaatgaagtatttttaaattaaggtatgtacatttctagacataatgctattgcacacttaagagactgaagtatagtataaaaataacttctgtatgcactgggaaacagaaaaatttatgtgactcactttattgcgatacttgctttaggcagttgtgtggaactgaaaccgcaatatctgagatatgcttgtatatatatatatatatatatatatatatatatatatatattcatctttagcc

SEQ ID NO: 2076 - DNA, 782 bp, Homo sapiens
ccaaaaagctataatgttgaacatacactttactcttctgtctcccctccctgagggagaagcctttgagctgtgttaacatctgtcttctctactgcatatcctgtggaatagcagcaaatcacttacatctcttttgttttcagcatcccccagacatctagactatgccagtcctgtctgccttctgagagagatgagaaagaaacccatttctcaagcagtccccccaaaaagacagaatgtgggacacatgccacaactttttcccttcctagagagaagctgagaattgggagttttcaccctctcgttctatgccgagctgggaggagggagtatggaagaagccaagaattgggagttttctgctgatgatgctatgctaagctgggcagagagaccatggcgaggtcacacagcacaagttgaagccgagattcaaactcaatctggttccagagcctgtgaagtacctatgaaagatattcacgtggagatggatactcacatgaatgtaggttgagattggagatctagatatggaagccattagtaacttagttgatagtttaaaaaagaagaggtgaatgagatcacctggggagtatgttaaagagtgcaaaagttaggaggtggtcagattaggaaggaccttgaatgacaaactttgcatgtttagctcttgagagtggagtgctactagaactttttaactcaaaaggagatgaggcagggatgtgcaaatatggctgtaaatgtaggcaaaagctttgtggggc

SEQ ID NO: 2077 - DNA, 735 bp, Homo sapiens
ttgcacttcagcccgggcaacagtgcgaggctgtctccaaaaaaaaaaaaaaaaaaaaaaaaaacgccaggcacagtggctcactcctgtaatcgcagcactttgggaggccaaggtgggtggatcacgaggtcaggagttcaagaccagcctggccaacatggtgaaaccccgtctctactaaaaatacaaaaattagccgggcgtggtggcgtgcacctgtagtcccagctactcgggaggctgaagcaggagaattgcttgaacccgggaggtggaggttgcagtgagccgagatcgcgccactgcactccagcctgggcgacagagcgagactccgtccagaaaaaaaaaaggaaaagaaaaaagaaatatccagcctgggcaacatattgaaacttaatctctacaaaaaaatttaaaaattagccaggcatgggacatggtggcatgtacctatagtcctatggtccctgctactcaggtggctgaggcgggaggatcacctgaggtcaggtgttcgagaccagcctggccaatatggtgaaaccccgtctccactaaaaatacaaaaatttagccacgcatgatggcaggcgcctgtaatctcaactactcaggaggctgaggcaggagaatcgcttgaacccgggaggcggaggttgcagtgagctgagattgcgccactgcactccagcctgggtgacaagagcaaaactccacctcaaaaaaaag

SEQ ID NO: 2078 - DNA, 1098 bp, Homo sapiens
ccagttcgtacccccgggacgccttgcacctagtctccccagtccaagctgcccaaagccccgcaacccgcaccctaggagagccatggaaaggggcaaggggcaaggggtaaggggtaaggggaggagtcggagaggcgcgttggaggggcgcctcggaccgggaggtatggggtcggtggcagcgggagcggccaaccttgcccaaaatgccaagtggggcgtgcggggccactcacctgcttggaactccacttggcgatttttttccttttcctcctctagcagcatggagtagaggatcccgacagagttatggatgccgaagatggagccgttgcaccaggtggcagcgaacaccaccacccagccgaagccaccttcgggaggctggaagccgcgcgcggtgccgcgggtctctaccgtaggcgtgggctcgggttcgtgcacccgctcggactcgaactccagctccggcaggggctctagaaccgacactgatcaaccccgagcctcgggaagacccctcctattttttgctcccataccctccttcctcacaagcagcccgcaactgaggtggcaccggggaccctaggacgacagctggcccgcgaggaaccccaccctgccctcaggagctcccatgtccctccttggacttgaggaggacgacctgaggggacagcctgggcctcggacagcgggtggacacaatcttctcgagcccgaggactcggccccccgcggtcctgcgcacccccgggagtctccccctgcccccgctcttcccggcaaatccctggcggcctgggaggggaggaggcggccatgcagcgaggcccgcccctccgggcagtcaatcagggctttgtttgcgccaacctggagcccggaggagcctcagagggccgggtctgggccgggccagggccgggccgggtctgggccgggccagggccgggccagggccgagtgtgggccaggagccgggccaggaagggagggaggtggcaccagtgggggccgggcccaggcccagtcgggagccgaagctcagttcaagctcctcccgacaatctgtcccggacttaggag

SEQ ID NO: 2079 - DNA, 1212 bp, Homo sapiens
gcttgtcaaaaactgacatatgcatattgttctcaactggtaagctgttagactggatagtccatgaataatagcctctgcgctgttgcgggtccggcagaagtcctcagggcggccgtcgcggaaagctcagcaaagagagaggcagaggaaatcgagcatccagccagcagccacagcctcggcctcagccaccaggcccgggtcctcctcctcctcctcgggggctcccacctgcacccagcactcgagcagttcctggcactcgaactgctcctcgtcgtttctctctgtttctgccatctgctcctcagtagggttggcatccctaccatctgcacagccccaagggctcggggcccagctttaaattttttgagccttcctaaaagccagatgttatcagcagctgaacagcatctacagaaaccagctgcaaagacagaagcagaacaactggtttggtggaaatatccaataccaaaaagttgagaaatcggtaaaataataacttggggtagaggttatgcttgtgtttctccaggccaaaatcaacactgatttggataccctcaggacacctgaaaccttatcatgaaccagatgctgaggaagagattctgggaggatcccgagtaccccccagttgcagtcatgtcaagactgatgctcaggaggatcccaactgtcatgagcaacacccatcgaacacagccatccacctgggaacagatcaagaagctgtcacagatggtgggagaaaacctgaggaaagcgggacaaccagtcacaatgagtaatttaatggtagctatgatagcagtgatcaccattgcctctgcagatgctgatcttgactcctgtgagaagtagctcaccgtgacaaagctgcctttgcttttatcgctttgcaaaacaaagaagggggacaagttgggaacaggccccaaaatctggccataaactggcccctaaactggtcataaacaaaatctctgcagcactgtcacatgcttgtgatagcctgacgcccacgctggaaggctgtcggtttaccggaatgagggcaaggaacagctggcccacccagggcggaaaaccacttaaggcattcttaaaccacaaacaatagcatgagctatctgtgccttaaggacatgttcatgctgcagataactagccagagcccatccctttacctcggcccatccc

SEQ ID NO: 2080 - DNA, 522 bp, Homo sapiens
cagattgaatgtgttcatgcacagattttatcatcttgttactcaaacgactgatggcttctgaccctgcctgaaaatttcctaagaggtaacagttctaggacacagatgctggagggagtggaggaagaagtttaattaccacatacagctcttccatatgcaaggtctctggggcaaaactgtcattctgtctgaagccagaccctcaatgtcagactaagagagtcggatggagactacatcttctgtgtgtgttgcaatgggaggacttctctccaccgagtttagtgaggtataggtgaccatgcagactcttcagaaatagacattggcaaactttgctcagaaagagtctgaaagacatacaagcggccaagaaacatgaaaaaatgcctcacatcactaatcgtcagagaaatgcacatcaaaaccacaatgagataccacaccagtcagaatggcttttattaaaatttcaaaaaataacagatgttggggaggctgtgaagacaaggggac

SEQ ID NO: 2081 - DNA, 285 bp, Homo sapiens
agattgaatgtgttcatgcacagattttatcatcttgttactcaaacgactgatggcttctgaccctgcctgaaaatttcctaagagaatagccccatgcttcctcaagaaaaaaacactacactcacaccacatacacaccacaaaacaaagaatgggtaaaaagggcacacacacacttttacagtttataccaaaccagaatcaaaaccaaaaccagagtatcaagaaaaccaagccagatcaaaaccaaaaccaaagtatcaagcagttcaagtcaagtca

SEQ ID NO: 2082 - DNA, 2911 bp, Homo sapiens
tctacatctctgttttggtaccagtaccatgctgttttggttagtgtagccttgtagtatagtttgaagtcaggtagggtgatgcctcctgctttgttctttttgcttagtattgtcttgactatacaggctcttttttggttccatataaaatttaaagtagttttttctagttctgttaagaaagtcaatagtagcttgatgggaatagtgttgaatctataaattactttgggctgtatggccatttacacgatattgcttttttcaatccatgagcacggaatgtttttctgtttgtttgtatcctattttttccttgagcagtggtttgtagttatctttgaagaggtccttcatgtccagtgtaagttgtattcctaggtattttgttttctttgtagcaattgcgaatgggagttcactcatgatttggctcactgtttgtctattattaaagtataggaattcttgtgatttttgcactttgttttgtatcctgagactttgttgaagttgtttatcaggttaaggagttttggggcagagacaatggggttttctaaacatacaatcaggtcatctgtaaacagataatttgacttcctctcttcctatttgaatatgctttatttatttttctttcctgattttcctggccataacttccagtactatgttgaaaaggagtgatgagagagggcatacttgtcttgtgacagttttcaatgaaagtgcttccagcttttacccattcaatatgacattggctatgggcttgtcataaatagctcttattatgagatatgttccacaaatacctagtttattcagtgtttttagcatgaaggggtgttgaattttattgaaggccatttctgagtctactgagataatcatgtgttatttgtcattggttttgttaatgtgatggattatgtttattgatttccatatgttgaaccagccttgcatttcaggaatgaagctgacttgatcctggtggataagcttttttgatatgctgctggattcagtttgtctgtattttattgaggatttttgcatcgatgttcatcagggcaattggcctaaagttttttttttgttgttgtgtctctgccacattttggtatcaggataatggtggcctcttaaaatgagttggggacaagtccctctctttctgttgtttggaatagattcagaaggaatggtacaaacttctctttgtgcctctggtagaattcggctgtgaatctatctggtcctgggctttttttggttgttaagctactgatttctgcctcaatttcagaacttgttattattctattcagggattcaacttcttcctggtttagtcttgtaagagtgtatgtgtccaggaattaaccatttcatctagattttctagtttatttgcatggaggtgtttatagtattgtttgagggtagtttatatttctgtgggatcagggatgataactcatttatcattttttattgcgtctatttgattcttctgtcttttcttctttattagtctggttagggatctattttgttaatctcttcaaaaaaccagctcctggattcattcattttttgaagtttttgtttctatatctccttcaattctgctcagatgttagttatttcttgtcttctgctagcttttgaatttgtttgcttttgcttgcctagttcttttaattgtgatgttagggtgtcaattttagatctttcccactttctaaggtgagcatttagtgctataaatttccctcttaacactgctttagttgtgtcccagagattctggtatgttgtgtctttgttctcattagttttagagaacttatttatttcggccttaatttcattatttactcagtactcgttcaggagcaggtttttcagtttccatgtagttgtgcagttttgagtgagtttcttaatcctgagttctaatttgattgaactgtgttctgagagactgtttgttatgatttccgttcttttgtatttgctgaggagtgttttattttcaattatgtggtcaactttagattaagtgctacgtgatattgagaacaatgtatattctgttgatttgaggtggagagctctgtagatgtctattaggtctgcttggtccagagctgatttcaagtcctgaatatccttttaaatttttttgtctaatattgacagtggggttttatagtctcccacaatttttgtgtgggagtctaagtctcattgtaggtctctgagacctcactttattaatctgggtgctcctgtattgagtgcatatatatttaggataattagcttttcttattgcattgatccctttaccattatgtaatgcctctctttctcttctttgatctctgtcattttaaagtctgtttttatcagagagtaggattgcaatccttgcttctttttgctttccatttccttggtaaatattcctccatccctttattttgagcctatgtgtgtctttgcacatgagatgggtctcaaatacagcacaccaatgtgtcctgactctttatccaatttgcaagtctgtgtcttttaattggggcacttagcctatttgcatttaagtttaatattgttatgtgtgaatttgatgttgtcatcatgatgctagctgtttattttgcacattagttgatgctgtttcttcatagtctcgttgatctttatattttggtatgtttttgcagtggctattactcgttttcccttcccttatttagtgcttccttaaggagatctcgtaaggcaggcctggtggtgacaaaatatctcagcatttgcttgtctggaaaggattttatttatcctttgcttatgaaggttagtttggctggatgtgaaattctgg

SEQ ID NO: 2083 - DNA, 340 bp, Homo sapiens
tttacaaaggcaaagacatggaatcaacctagaagcctatcaatttcggactgaataaagaaaatgtggtacatatacaccataaaatactatgcagccataaaatagaatgaaatcacttcccttgtggcaacatggatggagctgaaggccacaatcctaagtgaactaatggaggaacagaaaaccaaataccacatatttcacttatatgtcttagctaaacattgagcacatgtggaagtaaacactggatgcttggagtttttagctgatgtttatgaagaatagtgagtactagaactgtgcagctaatgaaaggaaatgctgtctaagaagg

SEQ ID NO: 2084 - DNA, 506 bp, Homo sapiens
ggagtttctgtgggaagattttctgttttccaggtttcccaagggaaacgaagaaagggaggaggataatcaatgactgaacctctaatagatgttggacgacgttaaaaaaaaaatgtatcggccctaccctcgaggatttgacaaattagactgaccagagtaataagagatacaggcagaagaggagacatagacacacacagaggagaagatgatgtgaaaagggaggcagagatcacagtggtgtggctacaagccaagaaataccgaagccatcagaagttggaagagccaccaagagtgctgaacaatcatctgaggacatcattgggtatcactggcaaagagaagagatgaagaaaagataagagaaagaaatgaaagtggaagagggcagaaaaagataaacaaaagttaggagagttttcaggaggagaaaataaagagaagacagagaaggaagtatctggggtaccaaaaaagcctatgaacttaaaagggag

SEQ ID NO: 2085 - DNA, 595 bp, Homo sapiens
ctgagaactgtaccaatgaggttgaaaacatttgtaaaccattgcctagtaaaagcagtcactgagatcagcgttttggatgattaatatctcttaaaaacattttataattccctcaacaaagctcttgcaaactgtggtagaggctgttagtgctctccaatatccatgttttctgcccactccttggaatccagctagattggtcaatagtggcctagctatagtggtcaacgtcccctatgattgggtgcaaccatgagactgagttctggccaatggattgtggcaggagtgatgtgttccagattttgcctcatgaaacttcctcatgcttgacttgtgctctctcttttcctatctacccgctgaatggagataactttgagtacctagagaaggatggagctacaagatggaatgagcctgggaccctgaatggccacgtgtagcagagcctctctgctgacctggaacattaacctcagactcttttgagttgtgcaaccatcaccacaatgaattgtagaatattttcatcactccaaacagaaaccctgcacctatgagttgtcactcttcaacttgcctctgc

SEQ ID NO: 2086 - DNA, 604 bp, Homo sapiens
gtttgttttgcttaccagcatttttcaagacagatcttgcgtgtgttttagtatgtcgctctagtcgtatacaaaatatcacaaatcacttcatctccccaatcctcatcgaatgttcctcgccagcccagtggtcctccagagcaaagcccggccttccttccagctgtctgggccaggagcttgagggtcttctagcaagcaccccggaggctgtcttctgactgtcatgcagggctgtggcaaactagctgactgcgcagtcacgtggaggggggaggggctgacggtgggtcatgtgaccaggctctgggttgagccggcctagaggagtgttttcttacacccagaaagtacaggaaaggcagacgacaactgtgctccgcagagcgggaggtggggggaacggcggaatattaaggagctcaagaagcagagactctacctgccctaggcgttcgtgaagagaagcagctgttgctattggaggaggtgggtgcaaggacggcagatgccatccctgagaggcggtgactgagactagatgcgggtacaggtagtgcctcggatccccgggctgcctcctgccttttgaacatcccag

SEQ ID NO: 2087 - DNA, 2599 bp, Homo sapiens
tgagtagctggaattataggcttgaaccaccacgcctggctaatttttgtatttttagttttgcaatgttggccagactggtcttgaactcctgacctcaagctcaagtgatatgccctctttggcctcccaaagtgctgggattacaggcatgagccaccatgccctgcccagacaattattttgaatcttctttaacaccaagacaaatagggcataaagcatgacttaaaattttttaacctggaaatattttaaagtagttgtaacccgctaagctattaaagacaaacaaacaacaacacatgtgcagaaattccataagcacccatatattacctggctttgagaaatgtaatttacttttgtcctttcagataagccagctgcagaatatatcctgaggtacctgctttatggaattattcacactattcaccaacaggaagaataaagtcaatcaattcaaggagtctcagaacaggagcacatagacaccaaactttgtgggacaacaaatataatgaagagtatgtttgcgtctttcaaacaaagaaatgttatgagaatgacttggatgagctgaaaaatgaatgatctccttgaacaaggcttgcctggaatttcgctttgctgcagagacatctggaaatgtggattgagggtggaaataaaatgaagatgtcctggaaacttccaactgatccttgggtctaattggtgtgggatatgcagcacaagcgtgagaagccatgaagtgagagccccaacaggggctcagagtcaaaaacctagatattagctcccaaagtccttccgaatctgctccagctccccacatcactcctagctgcccttggccctctccacctttcccctcccgattccttggaaaataagcgttcctcccccacccccacccccagctctacgaacacaatagagaagaaaaaattgtcttttaagataatttcctccaaatccttctcagtttcaactgcatgaagacaaaatgcaggctgtcaattcgatgaacagattgtgattaggctgggggaggctagaattgtaataattttatagctacaataataaagacccagaagtgggcaagacctatgcaagttcacagactaggttaaagaaaaggccagcgttgaagatgtgggtgatttccaagaaggataatcgacttcgagacaagtcaagaacacgatctgggaatcaggtagtcagtattctatcctgagagtgtaatatcttcatcagagagcttaagccaggcagacaagaggcagggagtgggttagagtgaagcagcaggtggcagtgagggtggagagaagaaacgaaatatagtccttgccacagagaaagaagcggtaagacaaaaatggctaagcagcaaaaacagggaaatactatataaaacctgccttagcaataagctatttctaaagactgtgaaggtatttaaatgcccactgctagatgggatcagcctgggaaggttttctagaacaggtgaatcttaaacagtgtctgtctgggctccttgtcagtcctgtctcccttcacagctcccttgacctagaggccggtgtcctcccatggatggcctttaaaacaactggctggcatataataagaggggcacctgttggaagactccggagaaggaagacgcatctgaaatttggtgccatgactcgaatcgggggacctcccttggaagatcaatcccctgtcctcctgctctttactccatgagaaagatccacctacaacctctggtcctcaggccaaccagcccaaggaacatctcaccaattttatatccggtacccactggaaattggactctccaactcacccggcagccactcccagagccactggaactctggcccaacgctctctgactgactccttcccagatcatctcagcttagcggctgaagattgatgctgcccaatcacctcagaagcttcctggaccatcacatacgctttgggtaactcttacagtggagggtaagtccgtccccttcttaatcaatacggaggctacccactccacattaccttcttttcaagggcctatttcccttgccccatgactgttatggttattgatggccaggcttctaaacctcttaaaactccccaactctggtgccaacttggacaatattcttttatgcactcctttttagttatccccacctgcccagttcccttattaggctgagacattttaactaaattatctgcttccctgactattcctaggctacagccacacctcattgccacccttttccccagttcaaacactccttcacatcctccccttgtatctcaccaccttaatccacaagtataggacacctctactccatccatggtgaccgatcatgcaccccttatcattccattaaaacctaatcacccttacccaactcaacgccaatatcccatcccacagcagcctttaaaaggagtaaagcctgttatcacttgcctgttacagtgtggccttttaaagcctataaactctccttacaatccccccattttacctatccaaaaaccagac

SEQ ID NO: 2088 - DNA, 880 bp, Homo sapiens
ggctagaattgtaataattttatagctacaataataaagacccagaagtgggcaagacctatgcaagttcacagactaggttaaagaaaaggccagcgttgaagatgtgggtgatttccaagaaggataatcgacttcgagacaagtcaagaacacgatctgggaatcaggtagtcagtattctatcctgagagtgtaatatcttcatcagagagcttaagccaggcagacaagaggcagggagtgggttagagtgaagcagcaggtggcagtgagggtggagagaagaaacgaaatatagtccttgccacagagaaagaagcggtaagacaaaaatggctaagcagcaaaaacagggaaatactatataaaacctgccttagcaataagctatttctaaagactgtgaaggtatttaaatgcccactgctagatgggatcagcctgggaaggttttctagaacaggtgaatcttaaacagtgtctgtctgggctccttgtcagtcctgtctcccttcacagctcccttgacctagaggccggtgtcctcccatggatggcctttaaaacaactggctggcatataataagaggggcacctgttggaagactccggagaaggaagcactttgccagacatcgaggggaaaacagagaaatgagatggtttccggatgcaacccttgttctgagagagcttacagcctcctctggaaggaatattacaggcgttaacaaaatgaaaattcagacaaaactaacattgagcacctatgctgtgcttgccctgccctaagtgcacaagtaagccaaatgtcagcagagtgtcatcctgtccattccagttcaaatataattggttcaagttccatgttacccc

SEQ ID NO: 2089 - DNA, 437 bp, Homo sapiens
gctcttcccaccagcatggaatctagtgacagcctatgtcctggcatgtggaagataagataagccagctgcagaatatatcctgaggtacctgctttatggaattattcacactattcaccaacaggaagaataaagtcaatcaattcaaggagtctcagaacaggagcacatagacaccaaactttgtgggacaacaaatataatgaagagtatgtttgcgtctttcaaacaaagccacgtgaagtcaaggcccttaacacccacccctcccacatactgaggggagaattcagatgcccactggagtcagccgatcagactgccttttgcacactccttgcctccactccagtttaccgtggaagacctgtctgctatggctgaatctgagagagatccttgagtgtaagatctggtcttgatcacctttctac

SEQ ID NO: 2090 - DNA, 1301 bp, Homo sapiens
gcctccgactccctggttcaggtaattctcctgcctcagcttcctgagtagatgggattacatgcacatgccatcaggccagctaatttttgtatttttagtagagacggagttttaccatgttggccaggatggcctccatctcctcatctcgtgatccacccgcctcagactcccaaagtgctgggattacaggcgtgagccaccgcgtttggcctactttacatattttagctaccagttccttgtcagatacatgattttcaaatattttctcccattctttgtgttgtcttaactttcttgatggtggctttgaagcaaaaaagtatttaacttagatgaagtcaaatttatctattttttcttttgtcgctcttgtttttgctatcatatctaagaaatcattgcctaatctaaggtcacacagatttttacctatgttttcttctaagagttttatagttttaacacttacctttacatctataattcattttgagttaatttttgtttatactgtgaggcaggagtccaatttcattgttttccatgtggatattcaggcatcccagcacatttgttgaaaagattattctttcccccattaaattatcctggcagtctttttgaaaatagattcatcataaatgtaagggtttatttcttggttctcaattctatcccattgacctatgtgtctattattatgtcattattacactgtcttgattactgtagttttgtagtaagttttgaaatcaacaaatgtgagtcctccaactttattcttttccgagtttgtattagctattctgagctctttgcacttccatatcaatttcaacatcaatttcagcatcagcttgtcattaccaagattctcgaagctctgccgatcatccacgctgaaggtcaagaggcagcagtctgctcccctgtagaagggtgtcctaaggctcttgaaacgttcctgccctgcagtgtcccagatctggagggttacaaagcgtccatctacctccagatctcgatttaagaactctacccctatggtgtgaaaagcctgggagtcaaatttgttggttacgtaacggttcataagcgaacttttcccaactccaccatcacccaagagaatgacctttaagagcagggatttcccactcatttttgcagcaccagaagggaaggagtttgtaaccaagagaacctgaaaataaaaggaaaagtaggagggaaaacagttaaacctgaaactgaaatcaacttcatagcaaatttctctgaattataaggcc

SEQ ID NO: 2091 - DNA, 413 bp, Homo sapiens
aggcatacctagttgtgctgtcagccaaagcccaccaagttcatcctgtaaagtcacacgcctgaagaaacaaccaaaagtccattacttaaagacatgatatacagaacatattgatctacaaaagacccaacgacccaaattatatgctgcccaacctactggtgaactggattggaactggccaaggattggtaaatagagaaagcgtttacattttaaaaacttcctctgtggttaaaaaaattcctggttgttatcaataagaaaacaagtaaaaaatgttacagatggacccacactgatatttgactttaccaaggtcttccgccagaacatgaaggtagacataaatgtaggagattagatattgagatattttaaaaataaattacttagtaataagaagttag

SEQ ID NO: 2092 - DNA, 755 bp, Homo sapiens
gttggcattactggagcaaaagggccatcaagcagaagctttttgagtatggcttctggcccctctctgtatattcatacttctgttaggtaacagggtaggtatgttaggtaacagggtaggtatggaacactcagagaattctggaggtggacatgggcacctgagtgggtgccttcagagttggtgtgaaagcgagggaaccaggctcatccaccaaggagccctgggctgcaaggcctgtcaggtcccagaggtggtggaggtcaggccttgttggccgccatgtttggaaactgggagctgaagctactgcagggcattgagactatggatctttgctcttagtgcagaaacaaggttaggggaagagagggatccttgccctggaggtcttggggctatgtaaaacctgagaactaatgtctcatctggaggacccaggcctagccaaataacggggcggtggtagtggccacattatcaggcgttatctcttgtaaagaggagagagaatttcctgattattgggtactgcactgagacaagaaatggtaacccaggtgcattgcatttcaattttttttctggtttcttatctctcccctcaaagaaaggctgggttaagcgtgccacaggatgccattctttccattttctcactagtgcagagagtgccagtacccactggttatatatcaattgagcaggacatcatcctacagagtgagtagaactgattctacattgagaat

SEQ ID NO: 2093 - DNA, 851 bp, Homo sapiens
tggatttcatgtttattatcccttagaaccccactttcttttgctcttcttctcgggctttctttgctttatttctcccactcttttcttcttttttttagtgtacaagcagtgaagggtgcagatcatggatagagctttcaagaagtttgttctagttcttctcctgaaactggacctccctcctagcttggtgaaaagagaatttggtccctgttactccatcttggccagaagcggaagttgaatctgtcttttgaaagtggatttcatatttggaaacaacccaaagaaagggtgtcaactgattcttactttatgaattggtgaattgttcttccctgctgtggacattagctgctgagatcttgggaggaactgaattcattttggagatccaagaatgctctcttggggtctggatcggtactcctttcctgcaacatatttctggcgacccagatgggactgtagtacagaaaccctgactcaatggctacctttggatacagggatacatgtgcaggtttgttacatgggaagattgcgtgatgctgaggtttggagtatggatcccaccacccgggtagtgagcataatatctggtcctccaggattctgtggacatctcttcctgtggaaagcttagagaaggaacattagtggggtgctgtaagaaaactgcccatggctcctttcccagcataataagagagccccacctggaagactctaggttctcatcttcatgccccgatgtaaggagagtggtccgtaagtatatgctttgcctactttctccatgtaatatctcaagtgagaaaaaatgataaaaataaacacccagaaac

SEQ ID NO: 2094 - DNA, 711 bp, Homo sapiens
gaatacttttaggtgaaaagagaatttggtccctgttactccatcttggccagaagcggaagttgaatctgtcttttgaaagtggatttcatatttggaaacaacccaaagaaagggtgtcaactgattcttactttatgaattggtgaattgttcttccctgctgtggacattagctgctgagatcttgggaggaactgaattcattttgtgtgtgaaccccactgatatcttaggaagatgcactggttgtcatggtaaaagctacgctaattggcttcctctagttgatgttctgtcaagctcattgccccactgaggatttggaatagagcgcttaactttttgcttctcaaagaacatgttcccagcaagtcagctgcctcagcagaaaatggaaggagatccaagaatgctctcttggggtctggatcggtactcctttcctgcaacatatttctggcgacccagatgggactgtagtacagaaaccctgactcaatggctacctttggagtttcactcttgttgcccacgctggagtgcaatggcacaatcttggctcaccgcaacctccgcctcccgggttcaagcaattctcctgcctcagcctcccgagtagctgggattacaggcatgtgccaccacacctggctaattttgtatttttagtagagatggggtttctccatgttggtcaggctggtctcg

SEQ ID NO: 2095 - DNA, 860 bp, Homo sapiens
gaatacttttaggtgaaaagagaatttggtccctgttactccatcttggccagaagcggaagttgaatctgtcttttgaaagtggatttcatatttggaaacaacccaaagaaagggtgtcaactgattcttactttatgaattggtgaattgttcttccctgctgtggacattagctgctgagatcttgggaggaactgaattcattttgtgtgtgaaccccactgatatcttaggaagatgcactggttgtcatggtaaaagctacgctaattggcttcctctagttgatgttctgtcaagctcattgccccactgaggatttggaatagagcgcttaactttttgcttctcaaagaacatgttcccagcaagtcagctgcctcagcagaaaatggaaggagatccaagaatgctctcttggggtctggatcggtactcctttcctgcaacatatttctggcgacccagatgggactgtagtacagaaaccctgactcaatggctacctttggatacagggatacatgtgcaggtttgttacatgggaagattgcgtgatgctgaggtttggagtatggatcccaccacccgggtagtgagcataatatctggtcctccaggattctgtggacatctcttcctgtggaaagcttagagaaggaacattagtggggtgctgtaagaaaactgcccatggctcctttcccagcataataagagagccccacctggaagactctaggttctcatcttcatgccccgatgtaaggagagtggtccgtaagtatatgctttgcctactttctccatgtaatatctcaagtgagaaaaaatgataaaaataaacacccagaaac

SEQ ID NO: 2096 - DNA, 554 bp, Homo sapiens
atacttttaggtgaaaagagaatttggtccctgttactccatcttggccagaagcggaagttgaatctgtcttttgaaagtggatttcatatttggaaacaacccaaagaaagggtgtcaactgattcttactttatgaattggtgaattgttcttccctgctgtggacattagctgctgagatcttgggaggaactgaattcattttgatacagggatacatgtgcaggtttgttacatgggaagattgcgtgatgctgaggtttggagtatggatcccaccacccgggtagtgagcataatatctggtcctccaggattctgtggacatctcttcctgtggaaagcttagagaaggaacattagtggggtgctgtaagaaaactgcccatggctcctttcccagcataataagagagccccacctggaagactctaggttctcatcttcatgccccgatgtaaggagagtggtccgtaagtatatgctttgcctactttctccatgtaatatctcaagtgagaaaaaatgataaaaataaacacccagaaac

SEQ ID NO: 2097 - DNA, 484 bp, Homo sapiens
attggacttcccaaactccagaactgagatccaagaatgctctcttggggtctggatcggtactcctttcctgcaacatatttctggcgacccagatgggactgtagtacagaaaccctgactcaatggctacctttggatacagggatacatgtgcaggtttgttacatgggaagattgcgtgatgctgaggtttggagtatggatcccaccacccgggtagtgagcataatatctggtcctccaggattctgtggacatctcttcctgtggaaagcttagagaaggaacattagtggggtgctgtaagaaaactgcccatggctcctttcccagcataataagagagccccacctggaagactctaggttctcatcttcatgccccgatgtaaggagagtggtccgtaagtatatgctttgcctactttctccatgtaatatctcaagtgagaaaaaatgataaaaataaacacccagaaac

SEQ ID NO: 2098 - DNA, 1530 bp, Homo sapiens
cactgtcacccaggctggaatgcagtgccatgatcatagctcaatgcagcctctgcctcccagactcaagcgatcctcccacctcaggctccggagtagccaggactacaggcacacaccaccatgcccagctaatttttgtattttttgtagagacagggttttgccttttgtccaggctggcatcatatactttaattcatgtccagatgactttaatacctaatacaatatattaggttggtttaaaaataattgctttttttttttttgcatttttgcaccaaccttaatgctatgtaaatagttgttatactgttgcttaacaacagtatgacaattttggctttttctttgtattattttgtattttttttttttattgtgtggtcttttttttttttctcagtgttttcaattcctccttggttgaatccatggatgcaaaacccacagatatgaagggctggctatatatgcattgatgattgtcctattatattagttataaagtgtcatttaatatgtagtgaaagttatggtacagtggaaagagtagttgaaaacataaacatttggacctttcaagaaaggtagcttggtgaagtttttcaccttcaaactatgtcccagtcagggctctgctactaattagctataatctttgcacaaattacatcacctttgagtctcagttgcctcacctgtaaaatgaaagaactggatactctctaaggtcacttccagccctgtcattctataactctgttatgctgaggaagaaattcacattgtgttaactgtatgagtcaaactgaaaatgattattgaagtgggaaaaagccaattgcttctcttagaaagctcaactaaatttgagaagaataatcttttcaattttttaagaatttaaatatttttaagggtttgacctatttatttagagatggggtctcactctgtcacccagactggagtacagtggcacaatcatagctcactgctgcctcaaattcatgggctcaagtgatcctcctgcctctgcctccagagtagctgcgactatgggcatgtgccaccacgcctggctaacatttgtattgacctatttatttattgtgatttatatctttttttttttttgagacagagttttgctcttgttgcccaggctggagtgcaatggcacgatcttcgctcaccacaacctccgcctcctgggttcaagcgattctcctgcctcagcctcccaagtagctgggattacaggcatgagccaccacgcccagctaattttgtatttttagtagagacggggtttctccatgttggtcaggctggtctcgacctcccgacctcaggtgatccgcccgcctcggcctcccaaagtgctgggattataggcatgagccaccgcgcccagccttaaggttttcttttttgagacggagtcttgctctgtcgcccaggctggagtgcagtggcgcaatctcggctcactgcaacctccgcctcccgggttcaagggag

SEQ ID NO: 2099 - DNA, 429 bp, Homo sapiens
tgctttctcaagctaaatagttaagaatggaaattggaatcctgcattcaccactcacatttatatgaccctggacagcacaatctctttctgctgcagatttttcatctgtgaacttggacagtcatacaaacttcatccggttgttgaaaagattaaatgagataatgcaagggcagagcaagatagcagaatagaagcctacaccatttgtactccctgaaggggagagaaaagcgccatcacaatatctaaaaatcagaagaagagaaaagccaaaacatcatcatatatatagggaacatatctcaagccatctttggtgcaagagaagagctcaacttccagccaattgatggcagattgtagaaacacatggcgggcctttgtattaacccaggggacattatgctaggtgaaataagccag

SEQ ID NO: 2100 - DNA, 872 bp, Homo sapiens
ctttcttagaacctgtgttttctaatcagtgaaatagggcttaacaaggcctgccttgcctccctgatgcattgttaaaatgatcaagagctctaagatacttgaaaaaaattaaggtggtaaagctatacacatataaggcatttatatgatatgatttcagaggaagaagaagggcccttggccctccttgaacttccctcatctataggttaataacaaaacttggatttttttttgaatagcagaaaaatgaatatttatttaacatcagctgcatgaaaggtcctgggctgggcattttaacagaacaaactcagttaatcttcacaacatctctgttttcctatgaattattatctccattttatagatgagtagcctaaagctcaaagtgaaaactttcccaagatcacacacctagcaagtgttggagttcagctgctatgcaaactgagaaggaccaaaggtattcttagataaagtaagtagtagtatttacagcacttttgaatctgggagaaagtgaagtacagacagattagtaaacaaagaactgtgaatccttagatggctccaccaactaatcaattcgagtcgattattgccttcccagttctgaattaggatgcttgcttgcagtgtgacttatttagtcagcattattttacgactctacaattttctctctttatctgaaatgatccagcctaaaactccctgaaaatgccgggcattaagtatatcacaatggtaattcttttgactgaagccttatttgattcagtggaaaatgacttcagtgtattggatttacagttcatttaatgagtgttgtagaggtcaatacattagtgtaaacttggttcagg

SEQ ID NO: 2101 - DNA, 2460 bp, Homo sapiens
ctacataattacttttacttgtgcttttcatttgtttctgtggattagatttaatctctagtgttcattattttctccctaaagaacttcttttggcatttcttttgggtttattcttctaatttcttgtaaggcagttatgctagcaatatattttatcattcgtttgggaatttattttgccttcagttttgaagaatacttttgctgcatatagattcctgcttgaaagatttttctttaagcacttggaatatatcatcttactgcctgctggcatccattgtttctgatgagaggccaggtgttaatctacatgtttcttacatgtgtagattcatggaatcatcaccacaatcaaaatgtagaattgttccatcatgataatgctccttcattcagtctctatagccacattcagcccctccatgccccactccttggcaactattgatctgttccccatctctataatcttgttattttaagaatgttatttaaatgaaatcatacattatgcaaccttttgaggttgactttttcactcagcataattctctggagatttatctaggtatttgcatgtattgatagtacattcttttttgctgtgtagtatttcatgatatggatatagcacattttgtttaaccattcacccattgaagtatgttggggttatttgcagtttgggctagtataaagaaagctgctttcagccagacacagaggctcatgcctgtactcccagcacttttgaaagccaaggtgggcagatcgatttgaggtcaggagtgagaccagcctggccaatatggcaaaaccctgtctctacaaaaaatacaaaaattagccaggggtggtggcagcagaggttgcagtgagtcaagatcacgccactgcactccagcctcctgggtgacagagctacgctctgtcaaggaagggagggagggagggagggaaggaggaaggaaggaaacaaggaaggaaggaaggaaggaaggaaggaaggaaggaaggaagctgcttgagggagggagggaggaaggaaggaaggaaggaaggaagctgctttcaacattcacatacaggtttatgaacctaagttttcatttctctaggataagtgcccaagagtgcacttgccgtatcatacagtaagtgaggtataattttttaagaaactacaaaaatattctccagagtggctataccacttttacattgttaccagcaatgtatgagtgatccagcttggtaagtccttaccagcatatggtgttgatatggtttggctctgtgtctcacccaaatctcatctcgaattgtaatctacataatccccacgtgttgagggagggacctggtgggaggtgattggatcatgggggtatttcccccatgctgttctcacaatagtgagtgagttctcatgagatctgatggttttataagtgtttgacagttccttctcacatactgtctcacctgccaccacgtaaaatgtgcctgcttccccttacaccatgattgtaagtttcctgcggactccggagccatgcagaactgtgagtcaactaaacccctttcctttataaattacccagtctcagacagtatctttatagcagtgtgagaatggaataatacaggttgtcactattttttttaatgttagccaacctgatagttatatagcgatatctcactacagttttaattttcatttctgtaatggctaatgatgttggccatcttattatgtgcttacttaccatccgttgtccttttcagtgaatgtctgttcatatctttagctcaatttcttttcttttttttttttttttgagaccaagtctcgctctgtcacccaggctggaatgcagtggcaagatctcggctcactgcaacctccacctcccaggttcaagcgattctcctgcctcagcctcccgagtagctgagattacgggtacctgccaccacgtccggctgatttttgtatttttaatagagacagggtttcaccatgttggccagactggtctcgaactcctgacctcaggtgattcacccacctcggcctcccaaagtactgggattacaggcatgagccaccacgctcggcctcagtgatttctcttcttgcactgtttcttctgctttctttggtttattttttaactttttttttagtagagatagggtcccactagttgtctgggctggtcttgaactcctgggatcaagcaatcctcctgcctcagcctccccaagtgctgggattacaggcataagccattgcgtccagtcctttggtttcatttgcttttctttttctagttgcttgaatcaggaacttagattattaatttagattattaatttgagatctttccttttttctaatataagcatcatttagtattataaatttctctttcatgaaattgtaaa

SEQ ID NO: 2102 - DNA, 1706 bp, Homo sapiens
gcttgatatttattgaaaataatgccaatgctttttccaggtagtattgaggagctgggctgagtgcttgtttgttttgtttttaagtactatttgtccaaatgcacacatctgtgggactgctgcaattttgaaagaaaaatgacagctgtgtaaaaccagtgcataggaaaaaagaagtgtcaacaatttggctgccaggcacaccgcgcccctgcagcaatctggtggggcaggggaggacactcggagtaggtagaaaactaaccaggctgaacggccccttcaggggttggtgagctgtccaaatcaatgtctgaaaaggcatagccaactctggcattttccaggttggtcctgatctcgaaaggtggtagtctgtaggtgggatgtggtgagtggatgtgaagtggcagcatagttctctgggaagatgtaagcctggcagcagggcaggtggcagcagcagggctacgggtggtctgcgcagtttgtaacaggggcctggccaatagctggggttcaggacacagttcagattagcaggggagggatcccggggatggccagggtagatgacacttccaagcacttccgagtgagtgaggctccagccccgaccccagcagcaggtaactggagcgctattcctggaacaaagacaagcactacggagaaatgaagagagagagcagacgggcgcgggtaggtaaggggaccggagggcaagggggagagcagtggctcctggcggggtgagggctgcggggagggggtggcggcgtgcagggccctcccccccgaggcccgagggtcgagggcctaataatcatcctcctcttcttcgtcgtcgtcgtcttcgtcgtcatcccagccaaagcactgtttcatctcatcgaggaaggcccggtaatcacctaggatggggctatccatctcgatgtagggcaccacccactcctcggcttccccggtgaggaggctgattaggaatgccaccttcatggcgtcgttgcagaatcggttctcgttcacgagcatgtaagacgccgtctgcacgataaactcggggagccgggagctctcgccattaaacgtttcggggaagggcaccgggcagctcggcggacgtacctggcgcagcaggctggccctctcgcacaccagcagccgcagctgttccatgagctggctgttctcgatgctcagggcgcggtgccgcatcaggagcgcgtgcagcagcagcaccaactcatccaccattgcgaacggcctggaaggacaggactcggctcggttcggctcggccaagttgatattgtgtccagaattggtgggttcttggtctcactgacttcaagaatgaagctgtggaccctcacggtgagtgttacagctcttaaggtggcgcgtctggagtttgttccttctgatgttcggatgtgtttggagtttcttccttttggtgggttcgtggtctcgctggctcaggcaggagtgaagctgcagaccttcgcggtgagttacagctcataaaggcagtgtggacccaaagagtgagcagcagcaggatttattgcaaagagcgaaagaacaaagcttccacagtgtggaagggaaccccagcgggttgccactgctggctggggcagcctgcttttattctcttatctggccccacccacatcctgctgattggtagagcc

SEQ ID NO: 2103 - DNA, 295 bp, Homo sapiens
gctgggtcgctgaaccaccggcttgtgttgatattgtgtccagaattggtgggttcttggtctcactgacttcaagaatgaagctgtggaccctcacgtgataaagctatgtgacattttagatacatggacaacagaaagacggaattggacaaagaatgaaaatgcagggaagaaataaatcagcaaacaaaacactgaacgtgaaattggaaagtggttgtaatgggaaggatgaagatgtcccaaaggaagtaacactggcaacaactttcacattaaagaaacttttggg

SEQ ID NO: 2104 - DNA, 783 bp, Homo sapiens
atcgaggcaatgagtaatcttcttacccatcttcctccccaaagctgctgacatcagaggtctgtccttcatgggaggcaactgcccatttgactattactgttacaagatgattcttgctgcatcttcgctctagccaggattctgcattttctgttcttacgcaagtgaccgaggaagcactctggagtggaccaggggagtggtgaaaaccccacagagcaatgaaatccaggacaacaccatagagaggggaatgaggaagcctgcctttgcaacactgtctcccccattgggatcagctcagagtcaggaggaaattaatcttacagttaaaagctaccatttttcagggagcagttcaactcctctacagaagaatgaccttgaacatgtgtcctataacagttctgcaagctacgaagaccaagaccatggccctggcatctaggcagggagcttcatgctgtgtcatctcctggtgaaaggcagaaaggcaagataagagatggggtttcaccgtgttagccaggatggtctcgatctcctgccctcgtgatccgtccgcctcggcctcccaaagtgctgggattacagacgttagccaccgcgcccaaccaaaagaattttcaataacaagcacaggctcactaaaaatacagagttggagggcctctcaaccctttgctggcttcctttctggaagtttgaacacttcaatggtgtggcctctactggacctatcattatatacctggcacctggcaaagatatttgacaagg

SEQ ID NO: 2105 - DNA, 402 bp, Homo sapiens
cagtgcccgctgggaaaatgcgaccgtccacaaagcgaaacggccatcggggcgagttcggcctcggcggggattctcctgaggtcacgcccgctctggccgccagaggacgcccgaggatcacgaatgggcccgaggagctggctgccccttcccacgctcaaggaagaagaagagagacagagagaccggagcacacgcagccatctcaccatgtgatgtgttgtggcacctcaggactcttcagagagtccccaccatcaagaaggccctcaccagatgctgcccctttaccttggacttctcagcctccataactaacttcagctaacatcactatccaggggctttcagagtgcatgacctgcagacctggaatcccacacaagaaggtatcctacc

SEQ ID NO: 2106 - DNA, 629 bp, Homo sapiens
agtaagttctcatgagatctgatggttttacaatgggcttcccccttcacttggctgtcattcttcttctccttcctgctgccatgtgaagaaggacgtgtttgcttctccttccaccatgattgtaattttcctgaggcctccctaaccagcagaacaagtgcttcgctcctggtgctctacaaggactatagaggcaacgtcaaaagaaataaaactctacattgtttgcagatacagctactttggggaaaccttgtttcccaggagtaaagaaacagttacaagcctcccacacatttggtaagaaaagcaagtgcctataaagctgctgcaacaaacagaccatggctcagtggagtgttttacacaatctgattatatacatggtaagcatcagaagaccttcagcataataggattgcttaaaggtgaataattggaaattgaatagctaaatagccctatttaatttaaataatacattcttttctctctattccttgccttctttaaaaacttgggcccaaactgacctcctgcagaacactttcatataaaatatttattcaattctgacacaattatgtgaatttaatctctagttttatatgcaaggacaatgcctc

SEQ ID NO: 2107 - DNA, 642 bp, Homo sapiens
ctccaggatgtattcgttcctttgaaatttgcgctatgcctcctatgtgggcaacgaacctgcagagatcatctatgatgtgctccgtactcgggtgactgcaatgcagatacatccagtgcagcgggtctggtgccgatgcatcgatttgcattggaattcacggttctggttccattcgcagagagtgcttcgctcctggtgctctacaaggactatagaggcaacgtcaaaagaaataaaactctacattgtttgcagatacagctactttggggaaaccttgtttcccaggagtaaagaaacagttacaagcctcccacacatttgtgcctataaagctgctgcaacaaacagaccatggctcagtggagtgttttacacaatctgattatatacatggtaagcatcagaagaccttcagcataataggattgcttaaaggtgaataattggaaattgaatagctaaatagccctatttaatttaaataatacattcttttctctctattccttgccttctttaaaaacttgggcccaaactgacctcctgcagaacactttcatataaaatatttattcaattctgacacaattatgtgaatttaatctctagttttatatgcaaggacaatgcctc

SEQ ID NO: 2108 - DNA, 228 bp, Homo sapiens
tggcattgtgacatatctctgcactgatcacccaggtgatgtaactcttgtctaggctctgcctaccggggcattttaacatatcactgcactgatcactgagatgatgtaactcttgtatatgcttcgctgacagggggcattgagacatatctctctgttgatcaccgagatgatataattctttcataggcttcgccgacagtgggcattgagacatatctcagc

SEQ ID NO: 2109 - DNA, 1382 bp, Homo sapiens
gcggatcccagcggccgtcctgtagctgagcaggcctggggcttggttctatgtccctgtggctatgtttccagtgtcctctgggtgtttccaagagcaacaagaaacgaataaatctctgacccttctcaggtgcagccagagagacactagcccactgatggacggacagacgtgggcagggtacgtgtcactaaacctcccaccactgccacagctgcctacaacagacacatcagatgacactccgggcaaataaatgattttcactgaggacttactggttttaataataggtcctggtgtagagaagtccctcaacctattgtgcaatgagttttgagaagcgggtaagctgtatgttttgtggtttttgtttcataaatgcatctacaggaagaccaatattgactgaatgaagctttcatttaaagagctaaaatatgctttgtgtttttatatgtggatactactttaaacctaatgactattcattgtatcatagcttgtgatgtattctgctcatggcttttaaggtaaattgtgccatgatccactgccattctaattgctttaacaagtcattgccacactactgttacatattaattatgcatacagacaggtagacttattttacatatgtgaactaactagttgtcaaagcaaatgcagattgtattctgcaagtaaagtctttttctctctgaaatttctagggatgttctttaagtgaaattcatattcagactgaagattttagttacaagaactgagtgcagattaaagtctttttgtgattcaaacatattcaagagtacaactgtgatatttcatggaagttacgcaataaaatgtctctaacctgcgaacaaatctatcaagcagacggcacagtactgaatttgaaaccagaaatactgggtttttatataaatgcttcatagatttgttttatgataaagggcacataactctcctaaacctcacaccatctcttgaataggtataataagcccacatcaatgctgatgccttagctattattaaactcttacagtatgatgtaaagtgaaagtacaatgtaagatcattcctaggccaactttgaccagttttatacagaaacatgtgccaacttttctgtttgcaaagataatatcaaagcaaacaccagaaagttatatctttggtgcattttttcaaaatcatacacataatacacaaaccaaagacaaatgatgaatattatgtcagaaaatataaagtcttcccctttcttcttttgccaagaaagtccaatattttcaccatttttatgcacacaatcaactttatttaagctggaagttaatgtctcattgttttcattgttctaaata

SEQ ID NO: 2110 - DNA, 446 bp, Homo sapiens
attgtgatatatcactgcactgatcacccaaatgatgcaaatcttctctaggctccgcagggagggggcattgtgacatatttctgaaccgatcatccaggagatataagtattctccaggatttgacaaaagagcttcggaaggtgttgggagagcctcagctggaatttcacggatggacaagggcacagagagtccagcaggctcccttgcacaatagccgtggtgcgcaatgagcgcaggtctagccaggaggccggcaaagagagctagaggtctgcgttctgcctccaggcactccatggtgggagctgggaggctccaggggcacgggcgggcctgcgacggtggcgcggaggcgcagaggaagcgagcagctggaggggtgtcaggcctggacgctgcacaggcccggtgtttcgcgggacggtggtctccacccagc

SEQ ID NO: 2111 - DNA, 370 bp, Homo sapiens
gacatatatctgcactgatcacacaggtaatgtaactcttctctagtctctgcctacagagggcgttgtgacatcactctgcaatgatcacccaggtgatgtaaccattgtctaggctttgcctacagggggttttgtgacatatctttgcactgatcacccaggtgatgtaactcatctaagctctgcctacaggggccttgtgacatatctctgcactgatcaccccggggagagaattcttgtctaggctctgcctacaaggggctttttgacatatctctgcactgatcacctaggtgatgtaacttttgtctaggctctgcctaagggggcattgtgacatacctctgcactgatcactgaggtg

SEQ ID NO: 2112 - DNA, 296 bp, Homo sapiens
gtctaccctctgcctacagggggtattgtgaaatatctctgcactgatcaactaggtgatgtaactcttgtctaggctctgcctacaggggcgttttgacatatctctgaactgatgacaaaagtgatgtaactcttgcctaggctttgcctacaggggacattgtgacatatctctgcactgatcacccaggtgatgtaactcttgcctaggctttgcctacaggggacatttgacatatatctgcactgatcacacaggtaatgtaactcttccctagtctttgcctacagagg

SEQ ID NO: 2113 - DNA, 339 bp, Homo sapiens
gtctaccctctgcctacagggggtattgtgaaatatctctgcactgatcaactaggtgatgtaactcttgtctaggctctgcctacaggggcgttttgacatatctctgaactgatgacaaaagtgatgtaactcttgcctaggctttgcctacaggggacattgtgacatatctctgcactgatcacccaggtgatgtaactcttgcctaggctttgcctacaggggacattgtgacatatctctgcacggatcacccaggtgatgtaactcttgcctaggctttgccacaggggactttgtgacatatctctgcactgatcacccaggtgatgtaac

SEQ ID NO: 2114 - DNA, 206 bp, Homo sapiens
gcccactgtaggcaaagcctagacaatagttacatcagttgggtgatcagtggacagatctctcacaattcccctgtaggcagagcttatacaacagttacatcacctgggtgatcagtgcagagatttgtcaaaattccctgtaggcagagcttataaaagtgttacatcacctacgtgatcagtgcagagatatgtcacaaagc

SEQ ID NO: 2115 - DNA, 747 bp, Homo sapiens
gaagcctaggggagccagtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtgtgtgtcatgtctgtttgtttttcaattaagagaggaaagcattaggcagatggaatgtacatgtgaggatgaggagacagaaaacaagtagccctttccatcaagatagagggttttctggggttgctggctattgaatgtcactcctgatttctctttccaaggcactgtaccaccagcctactgagattgtgtgggagctttcatgggggttgtatttcact

SEQ ID NO: 2116 - DNA, 6191 bp, Homo sapiens
acgaggcgcggggcgcggagtggcaagagcgcagcatgggctgcgcagaactgaggcagacacccagaggctgccaaattgtcatctgagccggaccgggtttcggcggccgcgctttatagtcgctggagcctggtgacctattccagggctacaagactgcctcggcaaacagcccaaggatgttcggttatctcgccttgagggttcgcgcgtcacgtgccccccccgtcccccgcttgtttttcagtttaaaagtggggcccgtgtctgcaggactctaggagctgcgggcccacccattcactgatgttaccctctcctgtcatttctcctttgtgaagggcactgaaaatcttgagttttcttgggaaagagaagacatcaaacaggcatatgaggtagaggataataaagaatattacctccttttcaagtaccttgatttttttgaagttttctcgaagttggtttaccagtttcacaataacacagagcaactagaagatcaaaattccttgtatgagggaagagtatctgtggaccaggctgaaatttctgaggggactctatcacttttactaagaaatgtggatttcatggatgaagctatctacaagtgctcagccatcacaccagatggaagaggtgaaagtacaattaagctaatagtagaaggtaagggaatttattgaatgaacttgatttcaagctctgtctctattcataagttataacagtgacaacttatctagttctctcacttttccccttttactcaaattattatcagttcttcttattcccaacacgtcaattcgtcttagctaaaaatattgccctgagcgaaagatgctgtatctatacctgtatacattattcattcacacagacaaacaaaacattaacaacaacaacaacaacaagcactggtctatcaaaaactctccaaacaagttgtaacactgaaaaatcaaaatatgatataacagtcttacatgaaaacgctgagatatgacatatggtttagtgagaagagccccgcattgggagtcaggaggcccatattctaattttggatgactttgggtaactcatttagcttttctaggcttcacttttctcactattaaaatgtaggttggactggatcagtggatctccgtagtgatccagggatccttacccttcacaggattgcatgaagagcttttcccccatcagagactttcagggattggggaaggcatggcagaattcctccaggataagagttggaagacatgagaaggtggtggttgtgagaataattcgttatcttctgtggttctcagcaggactctgaaatgccccaggtgcaatttgacaggattgatgatgaggatgtggccacatgcatctcaaaggactagtacctcacgcccattgtgacatggctggaccggacagagagggacctgagcaaccacagcatcgtggaaatcctggaggagcagatgaatggcttctacagggtgttctccatcctgaaataccctgtcaagttaaatgagaaatatctctgccacataacagagacagatgtgaacaaccagctcttcagaatcatccacaagtatccaagtaagtgcaaatccgaaaggaacagtgaaagtggggtgcatttcaccacagaaaagtcatcattcattaatatttactgaatgtcaaatatatcaggcatgccttcgcactttggggatttaaagaagcatcaggaacatacgcttggagccttgggcaagataaggtggtgaagtggagtctctctgggcttgaaaaaagaacatgcttcagagactgacagctttctcctgatagatgtggctcttactattgatgaggtttcttttcctctgcacagaacatcagctttatgacgtggcaggctgagtagtcatagtggccatttattagcctctcaccatgtgcctggcactttacatatgtcactttaatctttacctctattttaattgttattactgcccctcttctatatgagaaaaccaacaagttaaataatttgactaaggacatagctaacaagcacaagactcaggattcaaacccattctttctgaatctaaagttcatgcacttcatttttcttatgcatataccacactgcacttacagatctaagactatagactgcatgaatagatctaagtcatatatgtttggagaaggggattccctgtgtaataagcaaggaggcaagaaatagagtcactgctcccactcaaattctgagcagtctttaagttgccgtatcaaaggctgtctacattctggggaatcttaattgagtcctccagagaaattttgatggatacttttttgtgtagctgttctattacttctaaactgtctaaactttttcaagttaggaatttgaaaaaaaaaagcatgttagaaaaagaacaggtatttactgaacacataccatatgctagggtggacccaggtacttttgcataaggtatttaaccccacaatgacctctgagttagatactaacattacagtatttagcagaggaggaaaccaaggctgagagaaggttaagtatttaccaaaggctacacagctgacagtcttacaacccaggacttgaacttgggtctaattattaacaaaggcctgggcacattccactatgtggttgactcgtgggccttaagttccttgtgtcaaagtatctgtagcctcaggctgaggtcattgatttattctgccacctgtgacctcacctgcctctccatcaagaaggaagggatggtgatgaatacacttgcacggtgagctaattccttctactttcctgtatccctgacttagagatcttattaagacttctttggagggttagctctggcagggactttggccatcatctaccaatcacagcatataggggtgactaaacagaagtccagagaggtgagataattgtccaaggtaatacacactctatacaagaagtattaatggagtctgacttcatgcaaaggttgggcagttacctttcaggtctagtctgtaggggcctggcaattaatcaaagcattcaaaacactattgcaatcctggatctcccagtaactagccgtaaatatttacaaccgttaagagtatttatttaaatttttaatgacttgggaaaatacccgcactatcatgttaaaattttaaaaagcaaaatagtagcttgtatgtgtagcatgagccccagttgtttaactatatggagatttaaaagataggatgtattattattattattatcataatatgaacagtaattactggtaacctctgaatgataggattgtaggcattttttgttttctcttttgtacttgtgttttatgcaacattctataatgaacatatattatttttagtccaaaaaagctatattttttaaatctttaaaaaatatctttatgaaaaatggtttacatgccataaaattcacccatttgaagtgtacaatttaattgttttagtatattcacaaaattgtgaaatcgtcaccactcttatcatttagaacattttaattaccctaaaaataaacctcatgctcattcacagtcactctccattcccttcaccatatcccccagtcctaggcaaccactaacctactttctagctatatagatttgcctattttagatctttcatataactgaaattatacaatatgtggtctttttaaactggcttcttttacttggcataatgttttaaaggttcatccatgttgtagcatatgttagcacttcatttctttttatttctggataatagtttattccattatatggatattaccacattttatttatccattcatcagttgatgaagatttgggttgatttcactttttgtctctgatgaatgatgttgctgtgaacattcacatatatgtttttatgtggaaatttatgttaaatttcatttatcttgggtatatacctatgagtggaattgctgggtcatatggtaactattttttaaccctttgaggaactgccagactattttccaaagcagctgcacaattttacattcctaccagcaatgtatgaggttactgatttgtcaacatccttgccagcactcatgatcttttttattctagtcattctagtagatgtgagtgacatttgtggttttgatttgcatctctctggtggctaatcttgggcatctttcaatatgcttactggttatttgtacatcttctttggagaaatgtctattcaaattctttctccattaaaaatgggttatttatctttttattattgagttgtaagagttgatatattttgaataccaattccttatcaaatatttgacttgcagaaattttctccccttctgagttgtcttttcacttcttgatgatgtcatttgaagcagtaaattttctgattttgatgaagtacaatttatctttttttttgtcacttgtgcttttggtgttatatctaaaaaattattgcctaatctaagtcacaaagatttactcatatgttttcttctaagagttttataatgttagctcctacctccaggcttatgattcctttaaattaatttttgtttttggcatgagataggtgtccaacatcccaggaccatttattcaaaaggctattctttcccccatggaattgtcttgatggccttattgaaaatcaagttactataaatgtaaaggtttatttctgggctttcaattatattccattgatctatgtgtctgtacttatgccagtaccacactgtcttgactactatagctttttagtaagttttgtcacagaggagtgtgttcttttaacattgttcttctttttgaagatagctttgattattcctatttcagcattttcatatgaattttaggatgaacttgtcaatttctgccaaacaggcacctggggtttcaataaggaatgtatggaatctatagattcattttgggagtattggcattttaatgatactaagtcttctatctatgaacacagatgtctttccatttgtttaggtctttttaaattatcttcaatgatgtttggcagttttccatgtataagtcttacaattcttttgttaaatttattcctaagtattttattctttttcatgctttggaaatgtaattgttttcttaatttcattttagaatgcttattgctaatagaaagaaataacagtagatttttgtggattccttagtattttctatatagaagaccacgttatctatgaatagaaatagttttacttcttcctttccaatcttgattacttgtatttaattttctttctaattgccctggctagaacctccagtacaatgctgaatagaaaaactaagagtagatctctgggagaaagcattcaatctttcatcatcaactatgatgttagctgtaggttgttattactgtaaatgaacaatatcaggttgagaaagttctcttccgttgcttgttttctgagtgtttttatcatgaataaatttaggattttgccaaatgtattttctgcatctgttgagatgatcatgtgggctttgtcctttattctattaatatgatatattgcactaattaatttttgtatattgagccaactttgtattcctgggataaaccctacttggtcatggtatgtaagtctttttctatgttggtagattcagtttggtggtattttgttgaggctttttgcatctgtattcatttgtaagagatattggtctgtagttttcttgtgatgtcttggtctggttttgttatgaggataatattggcctcataggataagttgaaatgtgtcccttatcttctgttttttggaaaaggttgtgcaggattggtgttaatttttcttttaattctttaacttttggttttgtttattttccctatttttctattctctatttcatttacttccattctagcctttgttatttccttccttctacttgccttgggtttagttttaatttctttttctagtaatttcatttaaaagattaggttattgctttgagatctttctttttttttaacgtgtttttgtttattatacttttaagttttagggtacatgt

SEQ ID NO: 2117 - DNA, 859 bp, Homo sapiens
aacttgggatccgtctcctctttcgcctcctccgctttgggagccccgggctactctttcacagcccctgttgccctgtgatctgtaggtccttggggacgcacagttaagatgacaggacatcctggaagctgggaaatgatatgtattcatttcctaccaccgtagtggaagagagattttccctatctttacaactgatagcatttccaacagtaagctgtgagattctgcttgaaatcacctctcaaacaaataaaaaacagacctgggagacatgctacactcattctgctgaggaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtaggttgcgtctttgtatccaagtccattgttactaggttggaggctggagattctaaatggcttccagaccatctctctgattctctttgggagatggggtctgaaaga

SEQ ID NO: 2118 - DNA, 859 bp, Homo sapiens; identical to SEQ ID NO: 2117

SEQ ID NO: 2119 - DNA, 1747 bp, Homo sapiens
gcactggcagagaccctgatggccaaggagtccacccagggccaccggagttatttgctgacgtgctgtattgcccagaagccatcgtgtcgctggtcgggatcctgcggaggctggctgcctgctgggagcaccagcagtctcctgaggtctacgtggcctttaccgtccacaacccagagacgtgccagctgttcaccaccgagctaggccgggctgggatcatatgggaagcggaagctcatcatgaccagaaactgtttccctatggagagcacttggagatggcaatgctgaacctcacactgtaggactcacacacgactccaacgggattgtgagaatcaagtcaatctcatgggaagaatttttatatgggaaagcggataaaactttcattgtactggaatgtttggagaatgttaaattccaaatcagaaaccacaaactgccctctaataagacatcggctatctaagcgtgtgggtgccccctttctgccagcagttctggttcttacgaaaatcaccatatatcagacatgaaaattctggctttgtgcagataaaaaagtgtgtatcaagtatgacgttcccccaatgtggacacacttggttcctcagaaagccaagcccactgcagctgccacatccctggacacactcggttcctcacaaagccaagcccgctgcagctgtcacatccctggacacactcggttcctcacaaagccaagcccactgcagctgccacatccctgagcctatggtgcagcaggtgcttttttcaagacagggatcaaagtgttaggaacacggcagaaaggtgacacctggagaccaaatgcaggatgaggagtactgcagaggtcacagggaagtcagagaacagtaatacgctaacaggggcacggggcatgaagaacaaaagacaggaagcgtttcagagactccaaagaagaaatcagggccaaccacagcttcccgggtcattcaccaggtggcaccactgccgtcatttcagcttctggccactgggaggcgctgctcgaaagggtttgccctgacactccaagaagctgcgggaaggacagcaggggccctggggttttagcctctggcccaggagttatgtgtccataaccaaagggagcacagtctgcacccagctctcatcccatcagagctgctgcgactcctgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggacttgagacccttcacaccccagcagcgctccgcctcccacttgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaagggggagtgggtgttcttttcagccttgctaaactctctgaatcaaggatcacaaactacagcctgcaggccaaatccagcccacagcctgtgtttgtaaataaagctttattggaagaaagccacaccccttaatctacagatgatctgtggctactttca

SEQ ID NO: 2120 - DNA, 1705 bp, Homo sapiens
agaggaggacaagaggcttttacaccgaacggaggtgatgtggacgacaacggagacgcagccgcacttcaccaagcggccggtccgaggggacatggcggcaacctctgcagcgtcagtgctgctggcgggtgcaagaaactggtggcgacactgcctgagcccgctgctgttgccaaggtgacgaggcataaagccgcggtggatcggtgcgtgggggcgcggggtgggtggtgaagggagaacgaagctcgagcggaaagacaggaccgcgaccgcttgtcaggggattcggcttccagtcccccttccagagggcgtccttctgcagccaggcctctgtcttcccccgcccccacacgagtctcacttcatcaccatgctggagtgcagtggcactatctgagatcactgcaatctccgcctctcggattcaagcgattctcgtgcctcagcctcccgagtagtagctgggagtacaggcatgtgccaccatgcccagctaatttttgtatttttggtacagacctggtttcgccttgttggccaggctggtctcgagcttctgacctcaagtgatccgcctgcctcggccttccaaagtgctgggattacaggcgtgaaccactgagactggtcagttattggctctttttaaagattgtgttgctttctgcctcaatattaatatgttggaagttaccaagaagttcatgacagatctatttcaaattctggtgaagaaggaagaattggcccttgaaagaatcagtgttttacaataattttgaaagagggtagcgacagaaggaagaaaacattatcaggagggaattcagataaaggacaaaccatattttgactgctactgacttgttgaactggcagtcggggtcaacttgggaagacagctgtgaccataaatattaaagaagacaaaaggattctttgtgacactgagaccttctgcagtaccacagtggaggaaatgccagtgtacacaactggcctcatttaattcctgggaggagatagtttgggatgcagtgcttgttgttgctgagcaggcgatcacagcatgcactgtgtttctttctttgagaatatttgaatcctgcctgaatactcgtaacagatgagagacgcaggttttgatagcatagatttacgctgtcattagtcatgagctcttgggacgaaagtaattggttttatcctgtttagagttagaccctgtggttgggtatgaaagatgagtgtctgtaaaaatccttcttagaaatgtatttcctcaagactctgtctcaaaaaaaaaaaaaagaaatttatttcctagttctgtaaaaatcgctatattgagtgttctctatcacttaataatatacttattattaagtggacttaaagatatgcagtgtataaaatcagctaattacgttaaaccatggtatctccctttattgtgttagactgaatagaacaaactttaaaataattttttaaagaatatatttgaattcattttgtttgataatatgtttttattcagaaaagcattttattagcgctaggtgtgaacccgagccttttgctaaataccagcagcaatcatgtcctagagttaaatcccagaaaaattgccatattatatattaaaggttcaataaattacaataaagtattttttctttaaagtgatttggtc

SEQ ID NO: 2121 - DNA, 797 bp, Homo sapiens
cacaatatacaaaaataaactcaaaatgaattaaagacctaggcataagattatatatatcactcttgatcaggtaattaatgtgctgttttaatctcaatttaattatttataaaataggaataataacaacactccctagctaactattcaggaattgtcataatctatacatgcatttttcctgattagacatatgtatggacaaactaagtatacatgagtgaacttgaaagccaataaaattaaacttagacacgtctttctgctgtgactacatatatcctctttctaaccaccgctctagtctctgtacatctctgaaatctaacctcaaccatcatgaaaaggctgaaatcatttgggattttcatttcttatcaggtttccccatactaacgaatgcctagataataaaactcatatgccatttacataatttctttgttttccacctccctttcaagcttgttaaaaaaaacacaaaagctgccattcatcccctcctaaaatatatcccctgggcaggaatttaatttgcagttaagaataagtgtcaggttttttgcctttctgtatttttgcagtttgatgaaaagtgatattcttgtgatagtaatgtccactatcatttggaagtatcagtctcctaaattattagtataaataaagactgtgttgtacagcagtatgacactacacccttgaagataaattcatatttctgtattattgaaaatttattggcctttcaatcccagcctgtctacttaatagctttgctaccttgaacaaat

SEQ ID NO: 2122 - DNA, 2478 bp, Homo sapiens
atttctccaagtggttgcagatgacatgatttcccaaagtgttagagctgaagtgtgtttccttgtgtatatatactgtggttcctttatcccttcatctgtggatagacaggtgcaaccgtgtggttccccacgatatgatttcattgtggttttctgtctgaagagtatcccagtatgtacctgtggagcagcttctttatcccttcatctgtggataagcagtgcaggccaaggccccctgcccatggaggtgtgctgcagacagcagcagcagcagcagcagcagcagcagcagcagcagaggcctggcttcctgaggaattgctggccggtttgaggaaggaaggaagtcccacctaccatgatcaccctccagcctggaggaagctccatgccagcagcatggaccagcatgggagccagagccctgctaatgctgcagctcatcacccctgctcagcagcccagcagcccagcagccattgccacatcccatttccagggcctcctgcccccatgcccccacgtgcccatggaccgacacaccactcttcctgttggcccaaggtaggcatggagggaatttttcaagtccacttttagtaggtaagtcaaaaccaaacaaaataaccactcgacacctggtccaatgcccttccaaactcactcttttctctgacccttaaacacttgtcctgcatctcccagactccactgtaccttgatcagtaggtccctcttcactgcagtgtcttttttgcagagttcttttagctctttcatgcttttgctatgggcagaggaaagaaagaagggtaaatttgggaatcaggggagatttgtgagttccagtcccttttgtttgaaaacccagtgaatcccagcttactgggtgagagttttcagtggagtcctctgatcacaggggctccagaggaccagggtgggacctctcatgctcctcccctgggccccatctccacttcacatgagccactgcgtgtttacagttagctttcagctggacacagagttccactgctgggtacaaacacctgaaagcctccagttggctccagtctgttcctgatggttaaaaaaccttagtcctgagttggaaatccttgcctaggagtccagggcagcttagtgaccacagccaccggcccatccctgcctccagtgtccctggactccaagaacctttcagagtcattgagggcacatggggggagacctgtgagtccctaggtcaaccctgatgctgccatggagagagccctcctcacctggacactcctgcccacgtcttgtgtagctgacctattgggttgctgcacagagcagagacgatgacgtgcaccgaggagaagttgttgaggcttaggcactcctggagagggaagaatgagctgtgcggttcagagttggagcttggcccactacagcctcagccccctctgctgagatctcccctcctggatgaagcagaggcctggggagcctcaggagggcagacctggggccgagtggatgtcactcatctaggaggattttagttcaacccaaggaagaccccaggtcggaagtgagcagccaccactgggccgtgggagtcaagtctggagaaacagctacggccatcccagccctggccaaggggaaaatgccggaagactccagggtgggaggaagcgcgtcccaaggcccaggatctgcgaggcgacttggggaaaacgcaggcaggacctgctgaagctcacacccgtggaccacccagactgcctgccgctacaggatgccctccgcatctcccaggacttctttccggcatcagtgtggacattgaccccactggactgcagtcacagtggactcccaaggggcaggatccacctctgatgttcagtgaagactaccagaaaagtctgctagagcagtaccatctgggtctggatcaaaaactcagaaaatacgtggttggagagctcatctggaattttgccgatttcatgactaaccagtgtcagcccaagactaccccgtcggtcattctgttcctgccgtcctgtgaggagccccaagccaacaaggccacactggtgtgtctcatgaataactttatccgggaatcttgatggtgacctggaaggcagatggtaccctcatcacccagagcgtggagaagaccacgccctccaaacagagcaacaacaagtacgtggccagcagctacctgagcctgacgcccgagcagtggaggtcccgcagaagctacagctgccaggttatgcaagaagggagcaccgtggagaagtcagtggcccctgcagaatgttcataggttccagcccccaccccacccacaggggcctggagctgcaggatcccaggggaggggtctctctctgcatcccaagccattcagcccttctcgctgtacccagtaaaccctcaataaatatctttgtcagc

SEQ ID NO: 2123 - DNA, 2206 bp, Homo sapiens
tttgcctttaaaatatacattttgctcaagtgtagaggtccgatgctgggtggctgggtgttaattatcctgggggcgggtgtggtagggcactagctgggctgggctgggctcgctggcggctggtttgagaggagggtgattcagaggaaggcagtgacacccagatgtgggacaggctgcaagaaagcctggtgggccttagggcagacacttgtggggacccggggagccctaggtgccctgacaggtggaagaggggtgcagaaagggaggatgtcaaagagagaatgtcaaaggtcataaccaaacctaacaattttcttctacttatgccttttgtcaggacaaggagagggacaaattccttcttggcatccttatggccctgtgacctgctaatgaatgctgactctgagttgctactagaatttggtttccttgtggcttcccaggaattgtgagccatgttggataaggacctgcaagggaagaatgaggaagcctgggacagtgcaggaggggagagcactggtggtagagaggagtgatgacaagggtctccgccaaaagggaaatggaggggttaaagaagctgctggggagggttaaaaacaatgtgttctcactcgtaggtgggaattgaacaatgagaacacttggacacaggaaggggaacatcacacactggggcctgtcgtggggtgtggggagggaggagggatagcattaggagatatacctaatgtaaatgatgagttaatgggtgcagcacaccaacatggcacatgtatacctatgtaacaaacctgcacattgtgtacatgtaccctagaacttaaagtataattaaaaaacaaaacaaaacaaaacaaaaacaatgaggtgctattgttttagtggtgagtatccggagacctgggagttctatttaccaggtataacctgggctcaaaattccaggctgacttcaggcatgtcctcatctcatagatgccagcactaaggcccagagagggccgagctcattcagcccacccatcttctcacccctgactgcatttcccgggggtccttctgcagccaggtgctgctgtggtactttgggatctattggctgagctcccagagaagggtcatggattgggctagtttggaacaagtgaagggactgaagatgggctcagtatggggcgaagaccttcaggaagggtctgcagagtgagtaggggggttttgactaggaaaagttccaaccctgccggggccgctgtcaagagaaaagcatctattacagttacatttttaagttaagtagactgaagaatatttcttgtgtattaaagacgttcctttttggttgatttgcaatggaaaagcttttgttttctttttttttttggaaacagggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatttgggtgtgattcagagagctgtttatgcaaaaccagctttgtcaccatcaggcaaggcacctgaattcccaccgcagagagtgttgtggccgtgaggacttttctgtcaccagccatttccaggtagacccagtgtaatcacaagcatccttgtaagtggcaaagaggcagaggagacagcgccagagaggcagctgcatgagaaggatcaagatgttgctgactttgaagttggaagaagaaggccatgagcctcagtatgtgggcggcttctagaagctggaaggggcaaggagatggatttgacccttcagcctccaggggcagctgtacctgccatcactgattgtagcctggtgaggcctgttttagacttctgacctgtagagctgtaacataatacatttgggttgttttcaaccactaagtttgtggtaatttgttgtagcagctgtagaaaatgaatacatatgaatcctctggcatttgtttgagatttgctctatggcctagtatgtggttgtaaatgttccatctgtgcctgaaaaaatgtatatttctaattcagtagtctctgctttttttttttattttgtaccccatcaataaaatgattttcag

SEQ ID NO: 2124 - DNA, 3546 bp, Homo sapiens
aaaaaagagtatatcactttattttcaaacttttatttcatacacacacacacacctatgtaatgtaaaatatgagatataaaatacttctgtcaatgagacaaaaaaaagttaacaagcttttgttagcccaaatccagtatagcctagcaccatacgtgaggataaaaaactcataatatattttttacccattaattcagagactattacttaggcagccatacattctgtaagctctacaaaaaagtcaaaggaagctataaggttgttgctaaagcttatgtagaaatttttagtccaggacgtgctcctagtatcttaaacaagattctaactgcaatgctgtgccattagccatctgttgaagaaagaaatcacaggaaagctttgttcctctaagtcattcctccgtgaaatgacagaggacattacaaaggccattagatttgttcctaacttctgactccagcagcaactaccaaagaaacatcagaaatgttgatgtacagatcaactcagttcttgcaggtgtaggcagaactgagtctttaattgaatcaaaagtctttaattgaatttactggtgatgaaacattaaattctcaaccaaacttagatcttcagaactgtatgagattctcattttttacttacctaaatctgttattaccaaattgcaaaagttgaaactcctataaaagagtataggcatttttaattaggaatctaacaaaagtaaaacttttcataataatcttcagtcaaaacactagttaaaaatggtaacatttcagccatgctcttgtagatcacacagacaaaaaaaggtaacacattacatgaacaatatttctctccttcctgtataaaaataaaaaagaaaacaatattagttctatgcaacatattttaataattcaaggaaagcaaaaatagcacaagaaattcatagaaccatattcttatttttttttaatatagagaatacgggcaagaaaattacacacctcaattgcttacatttctttcatgaatttaagaaagcaacaaaattctttataagatctttgctgaaactgagagattgaaaggatgaaagttaaaacttaccggtccccacacctcctctgtaagacaatgccctgctcacccactccaccccaaagtcccttcttattccaatactcagtgacaatttcaattttaattaaaaaatatggcctgcattagagtaggtgagttttaggattgttccaggttccctgaccagggtggtgagtagacctacgtgtaggccaaatgtcacacagctcatccaaacccaactgctgcttttgcggttagatggcacccagagccacacactggcacaaagatggaagccttggaaggctgtggaaaaatgagaagtattgatattttaagccttatttctcacagacccctgttaacagaagtaaacctgcaaaaagcaatataaatacaaaaatagtgccttgggcagaaaagcaagtatatctaatcacattctccaacatacagggcagatgtaagctacttacatgaaattcctactcttccattcaaggcatttgacatgaaagctcaaaatgctcaaggctcagtttcattttaaaataaaaccaaaggaccatattagttgcctataaaataaaaactgaatgcagttccccacttctccatattcccctctttcccaactgacaaatgcatacagtatgctaatatacatatataatcatttatttaatcacaaatatcttctgaaaactccctaaaacactataagtaattatttgattacttggtaatcaagtgactatcaaataaatatttgaaacttagcattcattcaataactgtcaagcaaatcactagcatagtactgttatatgctatgtgggacacacagaagataaaagttactcacagtcctcacatgactcaccaggtcgtgaaacattattcactctgccacatacactgccaggacttcatactaagaacagtctagaacctctacaactgtgaattattagaatctgtatccttcttctacttcattaactgaacacctgattaagccactgtagcccatcaccttattttcttacctttaattgaagacattctgagttgtgggataataaaatgactttaaaatatgttgaagtttaagtcaaggcaggtatttcacgagtatttttcccccaccaagccctagaaaaatcatttctaacgccaaatagttgtaagtcaattgtactccagcatatgttaaagtcagctagctcctaaagaagtatgtctctctctattatttaccgatctcatcagaaataccatggagtgagactggtaattttgcaccaagtctatttgtgttttatggaaaaaggtaagtgctaaaatatatattcattcatctaagctcatctctgtcccattatcacagaaaagtcatctcctcatgaaatgataggtcatttcctatctatcccatcctcaatttcagatacagtattaaacaaaaattccatctggtcctcgctccactattaccaatcctgacctctagagttttatcagtcaccttggcctatcaattgcgaatttctctatggcctaaaattttacttggaaaacacactctggaggttgggggtgagtggggagaaagtgagaaggcagagcaaagccctgtcctctatatgttctgtggggggaaaaaaaggctaaaaaaaagtaaatattttatgtatctagtgattattttccccataaactacaaagccttacagatttttactttgattcagttttcctaagattgatgaatacctacaaagcatcaaaaataaattccaaatagctctctattgtggtttaagaagaggagttcttcccttttataacacactttgcaaggccaaagaatccagcttccacatcctaatagacaccacaatccttttaataaaaattacagcacagagctaatacttgaagcattcctagtaaatcttattgcaaatttctatcaaggaaactttactgagttcccatcttaaaaggccctgaaatttaaatttgctaagccaagtttcccaagatttttccgatcatggcacatatagaaaatatttgcacaatacacccaaagtaaaagaacaagattgccaatagccagctggtggctccagtggccccagggatgagaggaaaattgtctttgcacaccttggaaatttgccactatgctacaacccaaccacaggagttctgattcaactctgaccagtcacctgcagaattttcaaccactttagaactagcaccaagaaactttggaattaaggaccttctaagttttttgtttgttttttgttttgagatggagtctccctctgtcacccaggctggagtgcagtgaatctgcattattaacatgcatctcaggtaaatctgacgcaggtagcctgtagacaccaaggaaatgcttacagaggtcttcagcttaat

SEQ ID NO: 2125 - DNA, 840 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaggtgtggttaagagaaaaaaaaattgccattaaggaatcagcaaataggatgtctgaagtgaggatatagcacctatctctgagattaaagtcatctgatcaaaaatgatgcctctgagactataacaaaggaatgaataatgaaatataagaatggggattctgcactaactctatggggaagaaaacaatgtctctgttcatcatgagaaatgctcagcgactgcagacataaagagaaagctttcaattaaagtttcaatgatgggataggaactgagaagtctgtggagttttctgcctaggagtacccttggaaaagccactgctatgcccaaccagcactgggaatcccagatcacatgcaatcataggagttgccctggaggcagaagctcagcacatgttctggtaca

SEQ ID NO: 2126 - DNA, 3143 bp, Homo sapiens
atagcctgtgtctgaggcgcgcggagctggagcgcccagggcatgtccgccgatcccaaggaggcaatctgtcaggcgccgcccgggcggcagtatgcctgagggggtcctccgtgttcgcgcctcccgccgcctgcactgaaaggtctgtacctgagcctggatacttgaacagaggcagacactgcggctcaaaaccccaagggtaggtacctattgtgcggagtctcggaacgcctgcctggaagaagagttccggcggctccccgaacgcttggagaaagcgcttggatgcagttgcaggaatatcctagctctgagacaaaaattgggaacctcagcatgagtttgtcacctgaatgaaataaaaaaaatcacgttgaaggctggtgcagtaacatgtgcctgtagtcccagctactctggaggctgagtcaggaggatcacttgagaccagaagttcaggaattcaagactggcttgagcaacatagcaagacttcatttcaaaacaaacagaaaaaagccaccaccttcagtatttcttgccaaagcaaaggagccatttgttctttacgatggtcaggaaaggaagcatcaaggtcatcaaatgaaaaattttcagcatttcagcctctctgctcagggaaatatctgaatctagaatatcacaacatgagccaaaaccgccccatttctcatgccacatgtcactcttaacacaaggttactcaacctcgagcatggttggcatttggggctgaataattcttttttgtagggggctgtcctgggcattgtaggatgctcatgagctacctcagtctctaccacccactagatgccagtagcattgacccctgatctctctacccaagttgtgacaactaaaaccatctctggataatggaggaaccttaaatgcatattgctaaggaaaagccaatctgaaaggattacatattgtatgagtccaactatatggtaatctggaaaaggcaaaaccatggagacagtgaaaaggtagtggttaccagtggtccatgggaagggttggatgaataggtggagcacagaggatttttaaggcagtgaaactattctgaatgatactgtaatggtggatacatgtcatacctttgtcaaaaccaataaaatataacaaccaataaaactgcacaaagagtgaaccctaatgtaaactatggacttaataatgtatcaatattggctcaccaattttaacaaatgtaccacactaatgcaagatgttactaatagtggaaactggagggaagagggcttgaggggacatacgggaactctctgtaattcctgttcagtttttctgtaactgttaaactgtccaaaaaaagtctgtttttataaatggaggcatggttttatatggactaaaatactatgattgcctttttattttacacatggtgaaattagagcaggacatattttaaactcaaaattcacaaaattaatttatgaaaatgtttacccagatcaagaatattaaagaaacttagattaatattgttaccttgaatttattttactgagtaatcctctaagactcctctacacattattaatctagaaggatttttaaagtctttatgacaattaattattggtctacagtcaaattgcgtatccccattaactagagttatatttttccattttctgatccaaaaactttaggaacaggaaatgtttattttagaaaacaagaacacttcttaagcatttgctgttaacagttattttcacatgtgcttgtacttattttacacttgtcagaacatagtatttacctttgaaccaaggttttataataagcaagcactttttttatttagaagtcacattttccaagtagaaaaatcattaaaaattcagtcctctgaaggctaatttctttaaatcatttaacctaattgtttaaggtatagattggaatttttctcagcactctcttgaaaacaggtgacagtggaaccctgttaggttcacaaatcctagactttgattatatagcccaggctcaaatttttctcgaatgttacgaacattcaaagcattaggagtcttggtttcatttcttaattttttttcttctgggtatatttgagactcatcttggattcaaataaattaataatagtctcatgaaaccgataaaaatgggagctccattgaacatgagagacattgattcgtagtttctaacatcctccaaatgaggagcccatccctaatttagatgcttctttcaaaggaggctcctttccttcgttatccataatatagtcacaccagtcctgaaaaaacatggaacagactccagatctttatatttcatactctaaagtcgtacaagccaatctgcatttcctctagtggaaactgtatagctggtcatctttccaggacccttttatcaagaaacaatgcagcttctacatttgtgctgcttctacaccaaaacagctggaatgtatatagtatggttctggatgctcttgtatacctcactcttcatttctcacctaacccatgtgctatgatttgaatgtttctcccctgcaaaactcatgttgaaatgtaattgccatgataacagtattaataggtggaatatttaagaggtgattagggtgggattggtgatgttataaaagggtaagttcagccccttcttgctctctctgtcacccttccaccttcctctgtgtgatgatgcaacaaaaaagcccttcccagatgccagcatcttgattttggacttctcagcctacagaactataagccaataaatttctgttatttgttattagtctgtgatattctgttacagtagcacaaaatggactatgacaccatgtgtttacacagaaagaaaaaaatatcatacggtaattgctcctaaatatgcagagaatatgttctgatatccttagtggatgcctgaaactgcagatagtaccaaaccttatatatactatgttttttttcccatacatatgcatgttaaagtttataagttaggcagagtaagatatgaacaataactaataatgaaatagaaacgtaacgatgtgctgtaataaaagttatgtgactgac

SEQ ID NO: 2127 - DNA, 2753 bp, Homo sapiens
atcaatgttcggtagcagacctgtaatttgcaaattgaatgacaggcagcattgaaaatgcactgcagtggccttttctagatatgaagtgcatttactctgctcacatttccatggcctgagctaattacttggtctcatctaaatggaaaaatatgataaaatatagttttctatgtgtaaaggatggaggaatataaaacaatttggaacagagtctcgctgtgcctcccaggctggagtgcagtggcacgttcgcggctcagtgcaacatccgcctcccggattcacaccattctcctgcctcagcctcccgagtagctgggactacaggagcctgccaccacgcccagctaattttttgtatttttagtagagacagggtttcactgtgttagccaggatggtcttgatttcctgatctcgtgatccacctgccttggcctcccaaagtgctgggattacaggcgtgagccaccgtgccgggccacatgtcttctttgtgctaggcactgttccaacactgagggtttcacagtggggacaaaatttaagagtactatggaatttacatttatagcaacagaaagacaaaaaataaatgagaaaaaaatcaataaaatagaatgctcaaagtgtgaatgaaagaagtaaaaccggtaacagaagtgcaagggtggtagagggaggaaatttaatgttaaatagtttgacaagagaaggtctttccattaaattgatttctgagtaaagaatttataaggaagtctgaaatgtagatgtctctagggagaccattccagacagagaaaccaacaagaaaaagaaatatcctgaagctgaacacaggcgaatgttctgggagtaggaatgaagccagtgaggccagagggaagaaagtctagaattagaaatcagcgaggtcaagcatatggcaatgtattctctgagatctttcaagccagagcagtgagtttggcgtttcatgaaggaaagtcatgggagtgattgaagcagaaaaagagataatatatagtctactgagtcactctggctgctgtgtggaaatgtatgttaaagagggccaagaacagaagtagatcattttgaggcaagaattgatataagagatgatgctcgctccaactagaatagtagcaacagagatggtgagaaattgtcaagttattgatccattttgaagggaaagtcaaaagaatttgctgatagaacaaatttagaatgtgaaagtaagaatggaactcccctttacctagaagagaatttgaggagagatttgagacataaaatcaagaggcattctgtatatattgtttagaggcctcataaaataactaggtgaaagtgttaaaaaaataactgtgtgtttaggagtctgcagtttcagtaagagagattttccctgagactaaaataatatccattcatgcttcttttgtatttattataccctaggaactgttttctctactatatgtatgagtttttaatttatacaaaattcccataggtactattattatcaacattttaccatgagaaggctaagacataaagaaattaagtatttgtgccaaagacaaagagttactaactgatagagcaaatgtctgtgtgtctgttaaccctgcttattgtctctcttggtaattaattatcatacagctaacatttaaagccatgaaattaggtgaaatccccaggggagagtcagggagaatggaagagttccaaggaggggtgaaaaataacatcttatgagaaagaaaacaagccaggttgtgctgtcttggaagcaaagacagtatttcaagaaggatttgatcatgtgtataaaattatgctgataggctaaattagaaaggcttctggttggctttggggcttaactgcatggaggatttggggaaccttgatgaaatcagcccagtgaagggacaagtgtgaacttcagagagacaaaaaatgatgacaagaaatagagataatttttgaagagttattttggaagcagaacaatggcaaagaagggtggttggatcaaaaaaggattttttgtttgcatacattttaagttagaaaaacacggcactgtctctgcactttgctgacgtagagtatataagcacaagtgtaaagaggtgttgggagtagagaaaattatcatgctatttggtttattaattcagtgaatgagaaaaactcatcagcttagggtaagtcaaagttctgaagctacaggaaggaaaatgaataggagagatagtatataactactgtcaatgaaaagagtcaaactatataaaatattttaagagatttattctgagccaaatatgagtgatcatggtccgtggaggtcctgagaacatgtgcccaaggtggtagaggtacagcttcgttttatatattttaaggaggcatgagacatcaatcaaacacatttaagaaatacattggtttggttcagaaaggcgggacaactcaaagtgggggcttccagcgctataggtaaatttaaacattttctggttgacagttgagtttatctgaagacctgggatcaatagaaaggagatgttcaggttaagataaaggttatgggacatgaagttttattgtgcagaggaatatctcacatagcagacttcagagagagagcaggtgacaaaatgtttcttattggacctaaaagggtgcctggttcttagttggttatctcatggatctgg

SEQ ID NO: 2128 - DNA, 2259 bp, Homo sapiens
cgtgagggatgtcgcgggtgagtggtgtcgaggcctgttgggtcagggcggttcgcaggtgctgtcagagctgggcggggcagccgggtcgtagaggcgggcgccagtcgcggtcggtggagagggatgaggatgtaggagggacggacgtggcggaagccgcggggactgcgggggcggagtgcctctggggagccagggaggcctttccagaggctcctgggggaagaagaggcgaagcgagagtccccggggaagccctactccacccccagccggagcctgggttgtgcctgcacggaccagagcccacagtgcgagttgctgtaggcaaccagctagggtggccaacttctcccggttggcccgagatgttctggttttgggaccacagcgtcccaggcctccagcccaccacagtgaccatattgtgcgccccctgcccatcttctcccgcagcttccctagattaggcttgggaggcaaggggaggcctcctgacttttctcactgccttcgttaatataaagatgaaggcacactccacaacttccttctggccaggcccagacatgtctgtccttgtgagataaaagcttccatgggagccttccttcctaatcaaggtaggtagaccactggaaggtacatctggttttatattttgtcctgtagaagtcagatttcagcccagttgtgtaggagtgaggatgagcttatgctcttatcagagctttgagtacagagacatttgatctggaatttcagccagcctcttcaaccccagaattcagaggttcaatcagaacagacattagcttaagttttcccatcagttgtctatcattaaactggcaaaatctagataattagaaaatatgacagagatgatccagacagagatgttcaggtttttccttgtgtaattcaaaaagtctcgtggtggaacatctgacccttttcaagaggaaggatgaaaactctacataggaacacgatgtgaatggaagaaacctgtcattatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggtaaatactggtaatgtgctagttttggttcggttttgcaatggttctgttgtcaggaatagtccgggctattggtctgattcagatgggccattttaggatcatttttgatattcattgcaatggtacaagttttgtagccaaacagacctagaacatttttttttaattcatatcaacaccgatgaatgttaaaggtgtattgaaaatttagagttggttttgtttctaatttgaatcctcttactcatagactgggtaaacactgaataatcgtcttaaagtctgtttttaaatgttcttccatattataggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactc

SEQ ID NO: 2129 - DNA, 3182 bp, Homo sapiens
aaagtttgggattcccagtctacaaaaccccacagctcctaggaattctctcaccacccttgtgcctttaggcttcggtagattgcaaatgacctgctttctttcggatcccgggctgctttcggacacctgtcgaatagtaaatcccaagtaaggtacctgcggtcgtcggcagatctgaattttcttcttggacacctaatacccacagtcctccagagaccgagaggttgatgtcactcccaatatcggaggaagtatacacccccgtgtgagatggtccttaataatattccacggcggagggggtgatatgactacatacatggcagaaagtggaaacctcccagggatattgttcccacgatcctggagggaagaagatgatgttactttcaatatgacagaaggtggatgaagtggtggactgcccctccacacctgtggacacgcccccactgatattccttctaattgcagcgtgggagaggaggatatgacacgcgatatcgcagggagtagaaacacccctgtgatactgttcttaatattcagggaggaagaggatgatattactcccaatacagacgggtgtacaccctctgtacaccgagggtgtacacctgtctgtgaaagagttcgtaatctccagagggggagatgatattactcacaatatggtaaagaggctgtgagtccacggaggatcctcagagccagcgggggaagaggggctggctctcagtccccgcctcgcgggggtgactccccccagtgcgatgggggtcctaagagccagtgggggaagaggggctggctctgagaccccgcctcgcggggggtgcctccccgccctgtgatgggggtccgaagagccagaaggcttagaggggctggctctcagtccccgcctcgcggggggtgcctcctccccctgcgatgggggtcgtaagagccactgggggaataggggcttgctctcagtcaccgcctcgcggggggtgcctcctttcctttctacatagacacagtgacagtctgatctctctttcttttccctacagatggacacgcccccactgatattgtttttaatgcagcgtgggaggggaggatatgacacgcgatatcgcaggtagtagaaacacccctttgatagtgttcttaatattcagggaggaagaagatgatgttactcccaatacagacggatgtacaccctctgtacaccgagggtgtacacccgtctgtgaaggagttcgtaatctccagaggtggagatgatattactcacaatatggtaaacaggctgtgagtccatcgcggatcctcagagccaggtggggaagaggggctggctgtcagtcccctcctcgcggggggtgcctcccccactgctatggggatcccaagagccagtgggggaagaggtgctggctctcagtctccgcctcgcgaggtgcctccccaccctgcgatcggggtccgaagagccaggggggaagaggggctggctctcttcgtggatgattctttttccattctcaggcagttttcttttttctttctttctttttttttttttttgagactgagtcttgctctgttgcccatgctttgctcgatctcgggtgactgcaaccactgcctcccaggttcaagagattctcctgcctcagcctcctgagtagctgggactagaggcgtgtgtcaccacacccagctaatttttgtatttttagtagagatggggtttcaccatgtttgccaggatggtctctatctcctgcccttgtgatccacccacctcagcctcccaaagtgctgggattgcaggtgcgagccaccgggtccagcctctcaggcgattttcatacctgcatactctggtcactactctgttaaacagtcaaggagggtaagtattatcttcagatttccagagctctgtctctgtacagccctctcctcctcaatattctgccctatgaattctagccacattggccttcccaggctcacagttctgtcttctcaactcaggaagatctctgagttccatctgcattctttcttcctgtgctgtggcctggaaagttttctaaggtgttagggaggtcaattgtggggctagcctcatttgtttctcatctcttgaggatcactgccctttgatgcttgattccagtgattgattccctttgttgcttgagggccatagtttcatatattttgtccagtagttttgttgttttaggtcagaaagtaattttggtctctgttactctatcttggccagaagtgtaagacctaagcatttacacatcaaaatactgcacacataattttagtttaagctactttttaaaaaatctccttcattttccatttagcattctatttagggtattacattggtttttttgaaattctgttattggcagtttctattgcctatcaatcccatttaaagatagtgcatagggtattctaaaatagctgttaagcaaagagaaaattgggcctgatagggtgagaatcacagctctaatacctagagtgaccttataatgtattgtccaaaggagatatttttgacagtgaaagagggtgttgttagtaattatatcaggaccatggcctaaaccaggactatcccaggaagcctgggacatatttgtaccccatctctatttaatgcctttatacaattctttacttaattctaccagcctttattgagcctgctttctttgtctagctgagtgccacgtgctgacgtcactaagatcaatacagcaaactctgaaagatggacagagagacaggagatggtcctttataatgcagtgtgatctgtgctgcaatagagttttggaagctagaagttcaaaacgaggtgttggcagcaccatgctctctctgaagatgctaggaagaatctgctccatgcctttccattcgcttctggggtttcctgcaagccctgacattccttggcttgtagatgcatcaccccagtttccgcccccatcatcacatggcctcctctctgtgtgtgcctctgcgttccctctattcttcttctaaggacaccgacaccagtcatagtggattaagtgtccactcctaaccaattacatctgcaacaaccctatttccaaataaagtcacattctaag

SEQ ID NO: 2130 - DNA, 706 bp, Homo sapiens
gcctcccttccgaggaggcggtgctggggcgggcgcaggactgcaggctggggctccgctccccggcgggagcccgcgcgtggttcccagcgaagtccccgcgcggctgggcccagcgtgagtattctccgcccgctgtcctccccctggaggcggcagcgcccgtttatttgagccgtgtgaagatgtgcctgcttcgccttccatcatgactgaagtttcctgaggcctccccagctatgctccctatacagcctgcagaacggtcggctgcctccaatcctgaggtcatcactcatcaagaggggataatcccagggacagcaggatctgcttcgttacttggatttaggagccagaaacccatcaggcaactaaacagtaacaatgacccgccattaaacacactgagagaagagcatgatgaagagtttgtacaagaagaagccaggagcacttgctgacaatgcttacagagacgcaggcttctatgagctctgcctgttgaactgcagtaaaaatagatctccttccccagagaggcttggatgtgggcacaatatcagttcagacgatggtcaatgcatgtacttaatagagtgaaaagactttggactgtgaagtcagattacctgggtctgaattgttattcttctacttctttgtagtatgctttcaccacattaaaaattgtctgagcctcaat

SEQ ID NO: 2131 - DNA, 7428 bp, Homo sapiens
agagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaaggtatgtctggattcatccagccaggtgccttcctccgagctcagaagggactcctttccttgagggggaggatagggacgtgttccgggatcccaccccgcccccaaccactgaagagtagccagctgctggtcccaaatgacctgattcgattttttaaatgtaaaccttaggattggttcttgggtgaagagtccgctgctcttcgctattaggttagcgttcggaagttttcagtccttgttttcccgttgacttcgctgcctatgtgcagctaggctggaagcagcaatcgctgatagaaagcctgtggttaaagctcaaacgacatagtgtagtctcgactaattgaatcaacacgtatggatagcaacattctttttaggtcctcctctggaaagggtccatttggccaagagcactgttcactgttactcaacctcctgaaaagtaaccatagtaactcacctctcttttgatgggatcctccttattggctgcctatcttcctttggaaagcgcatctctctaaatttagaagatgatgagatccgtaagcatacatccatgtagaaaaggtgcagttaaacatggccctttaaagaaatgctgtcttcaaagaaaaagtagcatttggcgatttcaaatcttgtgagaaagaatgtgcattccaaagaaagacggggttcgtgttttgagctaactgctggtttgttactttagagggaatacttcctgaaattatataaaatctggcattaaaacttaagaatgactctgatttttttaaaaaaatatcagcctactgataatcttccaaaaataatctcccaagtaaataactgatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctggtga

SEQ ID NO: 2132 - DNA, 1672 bp, Homo sapiens
gttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaaccccacctctaccaaattagccaggtgtggtgcacacctgtagtcccagctacttgggaagctgaggcaggagaatctcttgaaccagggaggaggaggttgcagtaagccgagatggcgcccctgcactccagcctgggtgacagagtgagaccttgcgtttaaaaaaaaaaaaaaaggaaaaggaaaaaaaagttctactgtgggtaaaatgctatcatgctatcaaacagcatcacatgctacagagaagtcttgtgaaaggatgtcagtgtggcaaacttcattgtcttttaagaaattgccacagctatcgtaatcttcaaccaccaccaccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgtatttagtatgttccttgtatataaaaccccattttatagggtaggaaactaaggcttagagtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatg

SEQ ID NO: 2133 - DNA, 2889 bp, Homo sapiens
acatagatcagactctccagccgccatgcctacacctcccaattaggacctcaggcctgtgctagccacgccccaaaccctaaatctctccagccgcagacaaccctgggaaatgtagtctgcggacaagagccagccggcccacagccagagccatgcaagcgcagttctcttcggacagagccactgtctcaagactctgcccttcttcaagagaagagcccagaagaagagagaatgactgctaggccctttatggctggattcaggccatgtaaggcatgcctgcttccccttcaccttccaccatgattgtaagtttcctgaggcctccccaggtgtgcttcctgtacagcctgtggaatgttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcagtcgtagtacataccttactcagcatcaaagaattcacactggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataaagatatgatataga

SEQ ID NO: 2134 - DNA, 1742 bp, Homo sapiens
gaaaagtaaaaacaaaaggctgaaccatgatgctggaataaacaaaattgttgttgagcttagactctgaaaattttctctgcttttaccctgtgtgtgtctgaaggtggatattgttatgcaaggaagagatgtgaatatacaggaaatgagatccttaaaggggttgccgtccagatgttagatcaaagagattatgattcattcaaccaagtcgctggacttttgaaggcctatccaagtcatggtgcctttgaggttgcgcctgttactattcaaaacttggttttaaccatttaaggccatgaggtgtgaggtcttttgagagtgaaagaactcatattaatccagctcctgactcctaaaaaaacagtaactcttgtaattaaaatgggcagagtccatcaagaagcagtgtccagaagcactgggccatgtggcgagcagcagtgtcaccaggaaacatgccgagctgggtcaggaactgcgcaaggaggaggagacactgctcctgttgaaggcagccctcgcatgacctgctgaatcacatcaaggttgaagcattggccctccaatcaatgattagttctgggagaggggatgaggtgctgtcttctccaacttctccaactgtgcctgaacagtcacacgtcatgtcagtgcatatagagaatgaagcatcagtcaaccaaactacgctggagtggagcatagagtcctgtgacagaagaggaggaggaagagaaagaagaatcagatccctaaaggagggaaaaagccaggattcattatacaaattaaatttctaagtctcaggctctttctccccaaggaaatcatcttgccatgagccctagggcctgcttgaatggagagcaagaactataggaggatgtgtagctgcaaaaatttctcatcaataactcaatcttcagaacgttatgacatacagaaaatcaaagatgctgtgtcttagcattgagcaatatgggtggtgctatgtctgtagtctggtcaaattcagtaactgtgttcaaaacaaaatttcctctggaatactattgagaaaatctggcatttgcaaaaagggcagagtttaaatatgagccagtctttccaatcaacaatacctcttttaagaaaaccaactaacagctgtttgcatgccgttgaatccttgtgagcagttaggccacagtctaggacagaaagatgacacggggaaggactgagggccatctgagaacaaaagttgttgctacttctcagaggcattgagacacactgcatgctgtagactgctttgtgtaactgttgtcacatcttgcttgagatgtcattggcagaatgttcttaaaaataaattatagataaatagccatcatggagtttgctggtttctagatagcaaaagagaaaagaagcagttcctgcctggcccggtggctcatgcctgtaatcccagcactttgggaggctgaggtgagtagatcacttgaggtcaggagctcgagaccaacctggccaacatggtgaaaccctgtctctattaaaaatacaaaaattagctgggcatggtggcatgcgcctgtaatcccagctactcaggaggctgaggcaggataatcacttgaactcaggaggtggaggttgcagtgagccgagattttgccaatgcactccagctggggcaacagagcgagactctgtctcaaaaaaaaaaaaaaaaaaaaaaaaaaaga

SEQ ID NO: 2135 - DNA, 4424 bp, Homo sapiens
gcaccaggaagcccggctgacggcttaattgagattaacataaactccaatcagagaggaaaacgcggacaggattacctaatcgtatatgcttaagggagtaccacgagagcgcgagcagcctcggcagggcagaacaggccctcggcaggttcttcatcctgggtatctatctagactctagttcaggctccatcattacataattctatgccacttcccttctaggggtatctgttttctcaatttaaagagagggctcgtctgtcaggaccctaccaactccagatttccatgagccacagggtctgagcgacgcctgcaagccaacactgttcattcaggcctgaacggctaagcactgaatgggaggttgatttgactttgcttttttctttgcttctgtctacagagggagaaatagctgcctcattccctcttgctggagaaaaaaaaaaaaagcaataggtgtttaatctgcaagggagatgaatttcctatctaacccaaggagatgtgggacagctccggggtaaagattgatagaactgtctgatgtcagagcagccacaggccataaataatccagtccaaccccctggctttacagatgaatcaggcccagagacgccaggcgacttgagcaaggccactcagctgtcaagagcccgggtagaaatcagtgccctttctgctacaccattctgaacggctccagccacctgcttgcctcaaggatcccagtttgctctgtcttccctttctcttcttccttctcctcttacaatgttcaataataattggcaatgtacaaatcagactctcaggacttcagaggcaaggaccaggctgaatttttctgatcctagcaaaggtggattccttgaagaaagctgcctttcaatctaaagttctgaaggattccagtgattttgcaacctgcaggctttggcttggaaggacttacagccgatttcacaaactttcaaagccttaaggagcagtgatggagcattggtcagcagtttcgtgaatgacgctacattctcttattttccaaatgacctaaccccacagcacagaatctgctggatttggtgtctgtaaagacttaccagccaggcacagtgcctcattcctgtaatcccagcactttgggaggccaaggagggaggaccactggaggcctggagttcaagagcagcctgggcaagataatgagaccctatctctacaaaaaaattaaaaactatccaagtgtggtggtgcatgcctgtagccccagctacttcagaggctgaggcaagaagattacttgaacccgggagtttgaggctgcagtgagctataatcacagcactgcactgcagcctgggccacagagttgagaccctatctatcaggaaggaaggaaggaaggaaggaaagaaggaaggaaggaaggagggagggagggaaggagggaggaagaaaggaatgaaggaagaggacttccatccaaggatagatttcctcattttacgaagtccacctcattccctttacctctttcttgggcaacctcctctaccctagcatcaagcatttatcagattcctataatttcatcaaatgcaggcacttatcaggtttacaaaaaatagtctatcttggagagcttccaatgtgatgttgaggcagagcaactgtgtttaagggcaactcaagactagcccacctgaaaggttcccacacccaaactaacctgcaggtacaaatgaagtcacatcagttatgaatacccaggttttgatgactcacagcccccaccaacaaaactgcaggaccttgagggcctcccaccctgcagtgggctcaggggctcactcccttgtgctaatagagtctttctctgcagctacctgtggtccagggcctgaaaaaccacttagagtcatcacttccccattgcctgtaatcccagcaccactttgggaggccaaggagagaggatcctgagcagctggggcaacaggcatgcactaccacacttggataatttttaatgatttagtaaagaggtggtctcgctatcttgcccagcctatgaatgctgccctattgcttcattgcaccgctccttaaagaaagtttgtgaaatcagatctgagtccttccgagtcaaagcctgcaggttgcaaaatcactggaatccttcagaactttagattgtggccatatgaaaggcagctttcttcaaggagaggtggggtagcggagtagtcacttatgccttggtctggctgggtgaatctgcatttttacacaaacaatagggcagaggaagcaatcagatgtgcatttgtttcagatgagccgagggatgactttgagttctgtcctttgtcctgcacctgtgaagataagctatcaatttacattgccagagtgaaattcaacagaactgttttagtgtaaagatcttgaggcccacaaggaacttcctagtaggcaaattgtgagggagatatgaagatttttaaaaatctttgtaactgtcttatttaggaatagaatgagaggcaggtgtgcctgatgcagttcccagcttgatttttccctttggcttagtgatttgggggtcctgagatttatttgcctttcacattggcatgaggagaaaaaaatctattgaattgtcttgagtaggcatccctcttctggactttaatttgtgcaggaggggacactggtattggttatcccacccagccaagcttggggtataattgatttttggtctttgggtttctaaatcagtcttatgacctcattaaaaaatgaatgagggccaggtgcagtggctcatgcctgtaatcctagcactttgggaggccaagatggatggatcgtttgaggtcaggagttcaagaccagcctggccaacatggcgaaaccctgtctctactgaaaaaatataaaaattagctgggcatcatggcacatgcctgtaatcccagctactcaggaggctgaggcaggagaatcacttgaacccaagaggtagaggctacagtgagcccagattacgccgctgtactccagcctaggtgacagagcaagaccttgcctcaaaaagaaaaaacaaaagacaaaacaaacaaacaaagaaacaaactgaatgagtccccccagaacctctgggcaggtgaaaaaaaaaattagtttttagacctacaaacttatgaatcagattctgaccaaattcctgcctatgaggtcctacaagcagtaggtcagagtcttcccaaacccctctgagccatagccagccatatgcatcaaatggttttcatgtttgttgaatgaacacatggatgaatgaatgagcaaatgaaaaaacagattactggctggttggctagttgaatagatgaacagaaggatgaaaagaaccatttgatataatacttgtcccctgaaaatctcaagctgaaatgtgatccccagtgttggcagtagggcctggtgggtggtgtttgggtcatggggacagactccttatgaatggcttggtggcctccctgtcgtaatgagtgagttcttgctctatttgttcacacaagagctggttgtttaaaaatgcctggccaaacattgttggtgggagtgtaaattagttcaaccatcgtggaagacagtgtggtgattcctcaaggatctagaactagaaatactatttgatccagcaatccaattactgggtatatacccaaaggattataaatcattctgctataaagacacatgcacacatatgtttattgcagcactatttacagtagcaaagacttggaaccaacccaaatgcccatcaataacagactggataaagaaaatgtagcacatatacaccatggaatactatgcagccataaaaaagaatgagttcatgtcctttgcagggacatggatgaagctggaagccatcattctcagcaaactaacacaggaacagaaaaccaaacactgcatgttctcactcataaatgggagttgaacaatgagaacacatggacacagggaggggagttgtggcctgttgtagggtggggggcaaggggagggagagcattaggacaaatacctaatgcatgtgggcttaaaacctaggtgatgggttgataggtgcagcaaaccaccatggcacatgtatacctatgtaacaaacctgcatgttccgcacatgtatcccagaacttaaagtaaattaaaaaaaaatgcctggcagtgtctcttgctccctttcacaccatgtggcacacctgctccccttccccttctgccatgagtaaaaacttcctgaggcctcactagaggccaagcagatgctggagccatgcttgtacagtctgcagaactgtgagccaaataaacctcttttc

SEQ ID NO: 2136 - DNA, 4769 bp, Homo sapiens
atttaaacaagctcccaagaaggcaacagggacccactgtaccccaagaggcactccaagtttccttcagagaggaaaaagagagacggggctcctagaacccactctccccaaaggcgagtttcccaggcgccgctcgtgctgttgctggaaagcgagctcgctgtagaccggccgcgacaccatgtagctgcagctgtactcggggagctgcggcggctccgacctgccgcctggcgctgccatgacctgcgagccagaggacagcgaggagggaggacacgcgggaaggaataaactggactacatggaaatcaagactagaagagagggaggaggagctggagctatcctacctcatcagtgttttgtcttctgttgggatgaactttgttaaaactaatgcatggttaagatgaaaggcagaaggaagggtttgataaaccagaacattctcgcctgattgttagtgttctgaagtaaatacagaagaggctccaaaatacagacctctgtacatcaaccttccgtaatccacctgccttgcatatgcagaccatgacaattctacgagctcctggaaacagaactcagaactcctccccagagaaccctgatgcaaattctctgaaatggtagtcagcatgtgcgttttcctgagaagtgaatgagtcaacagctttcaacagatcttcaaaggcttacttcacccaatgaagttaagaaccactaaagaagaaacctaaaaggaaaatccaggtcatgaactttgcaatttttattcacatacagagaagaggggaggaatctcttgtgtatgttttacttatgtataccactggttcttaataaagggctttttttgcctccagaggtcaatgcctggagacatttttggttgtcacacctagggagatgctattgggatctagtgagtagagaccagagatgctgctaaacatcctacaatgaagtttgctatcactccaaggttttgcatgcgacttaaactgtacatttattaatcaattgctacatgtactaaaatatgtatctctctccatatatgtatatatgcgtgtattttttcattattgttggatgtatagctcaactccactacaacagaggaaagtatttgttttaaagtagaatctgaatatactcactctgtataccctcatccataccttcaagatctggtgaaaacactatctcttgcaagaacattctttgatgctgttcagaattaatccagacccttttctgtattctcttaataccttatctgatcctctcttaagttacttctcactatctaccttagtaacacaattttatttacatacaagttctctctccctcactagacaaaaacttcttgagggcaagcactgtgtctcctttcaaccattattatcttctctcatgttttttgaacagatttatctatagcccaaacataccttttcaaaaaactaaaaattactttacatatttgatctaaggctttgtttttctccattaagagcatgctgtggatatctttgcaagtgagtgcataaggatttttcttaaccttggagatggctgtctaggatttcagaatatcaactcatatttgtagctccatggcaactcacctacacaactcacaactctttattgaaggcattctgtaccaatataaatatagtccatatcccattctaatatggatttctgctccttgttgcttgctattttgaacacttttagtctggtccagtcaggcctataaaccactttgcatcagaacttggcaatggtttgctggttcagaggattaaggagtggggtaaggctggcagaaggacagaagagaaaagacttgagtaacaacaggaggcaaaagagtaacttagcttggctaatagaattcttatttgaaatgcatctctctatataagagtttggttcaataatcacaatataataagtcctgcatgtatctggatgaagataattgcttttttctgttcaatgcttttccatagcagaaatagctggggcagaacaaaatggtatctctgttacaggattctataagggtatagaactgcttttctcataggtaaaaggcagaccgtttgaatttggctttttaaaaacagaagagtaggaggaaataacagcttgctctctccaccctatttaattgtgatattaaacaccttagattactcacttgggctttataaggcaaccttctcctgtttcacacagaggtgggtggttcttatttatcagacttttaaaatattcaggacttctttccaaagaaatagatgcatcacttaaaaataaatatcagacaatattattgatactttacagtacttatttagcagttaatacttttttaaaaggcattttcttatttatcatttaggcatttgcagtgtaagacaaactcccttgtttgattacgcattcacctgttcattcattcattcattcaaggatttattaggaaattatttgtgctggctgtgggtacaatgatgaacaaaagcttataccctggcctcatatttatgggtgcagtagacactaatcaaatggtcacaaaatgtgtatcttatttcactgattataaaatacagatttttcacattttatcagggttcatgttataattgatgatctactatatattatagtttaattgatagcgtattttgtgattcataaaatgagttttataatagaattctataattaataaaatatagatatttacataaatttatagtgtatctatgccttttttttcttttttagagatgggatcttgctattttgcccaggctggacttgaactcccagtctccagaatagctgggactataggtgcacaccaccacacctgacagagtatctatgcttttgagtgactacgtgtgctacaagaatgatttaattgaatccttcgtttatttaacttaagagcagtcaatcttgctacattatttttgtctgagagcgaatattgtggtataaattttttctttttttttttttttttacaatttaaaatgttctcaaatcagaagaattgcaaaagaatgcaaacatgttggctgggcgctgtggctcacagtgtaatcccaacactttgagaagctgaggcgggaggatcacttgagccaggcctaatcctgagcttttatttcattatgcgtgttaattttctcaagatagcaaatgctaaatttttgtcatacttatacaaaaagagaactgaactgaactttctttctatatttctgatctcttcttctctgagcaacttattgggcttattctcagtaatcatacagttttgcactcaattgttttcttggttttttgttgttatttttatcttgcactcaattgttttctatttgtttactgtatgctactttattttcttctccagttataagatatgctccctagggacataaatagtatatgtcttttatggtgttacaaaaataagatgtgcctgtagtaaataatttggaaactacattaatgtataatatagtaatcacattttatctcattatccagataatcactgttttgcttctttttttatttattctttctatgcagacataggtatacatttttattaaagtaaaattataatgctagtctctttatttccctacacaataccttgacaaattatgacaatataataggtaccagacttgttaaattattgatcaattgattgtttaacaatggaattttgagaaatatttgggtagaaaaaaaactagttttaaaagaagagaatccaaccattaaaacatcaaaaaatgaaattatttgtaaatattatgtggcaatccattcaattttaaacaacttacagtgtcaataaaactataactcaataaatttctcaggcagagcccatctgcctcttctttaatatgaatgcaaacttgatatgtggtttagtaaattgctagaacgaaatgatggcatagttttgggttttgaggggttttctgtgtgtgtgtgtgtgtgtgtgtgtttgtttgtttgttttaaacagggtctggctctgtcacccaggttgaagtgcagtgacactatctcagctcactgcaaccttcacctccaaagctcaagccattctccacctcagcctcccaagtagttgagactataggcatgtgccaccacacccggctaatttttgtattttttgtagagacagggttttgccatcttgctcaggctggtctcaaactcctgtgctcaagagatccacctgcttcatcctcccagggtgctgggattacatgtgtgagccaccacacccaggtgggtttcttttaatgtttgttttaatgatgatttttttttttcaagagatggggtctcgctttgttacccaggctggtctcaaactcctgggctcaaataatcctaccacctcagccttccaaaatgctgattataaaatgacattacaggcaggagccaactgcacttggcctggatgttttctttcttttttttagagatgggggtctcacctcagtccctgaagtagctggcattacaggcctgtgccactatgtcgagccaataatggcatagttttctaagcaaagaataatttcaggatccttccaaatttcttattatttaagtgtattgcacttttaaagttatccttgcatatcttatctcatgaaatctgtggtttgttaatggag

SEQ ID NO: 2137 - DNA, 523 bp, Homo sapiens
agagatattcagaggtcttttaggatgcgctaaagggtcgtgagggctctcttaaaattttcttcacaagcggttatccagtcgtgccccgcggccctgctgctggccccggggatctgagtcgtaccctcttgtttttctctgagtcagtcttaaggtgaaatgaagtgtggcccagtggctcctcactgtcgcttctctagttttctgcctccttttagaaaattgaattgaaaagacaggatgaagtggacacagcatgtgaagacaattctttcaagaagtttggctgtcaaggaaaacagagaatgtgctaaagaacatacagacacagagcagacaggccacctttgcaaccacatggaggtttgtctgatattgaagctaaagaagctaagctggaagacagagagaccaagtcctgatgacattgtttgaacccagagatccagacatgcctgaaaactagttttaccactggacttatccgttgaatgagccaataaactctcttttatactta

SEQ ID NO: 2138 - DNA, 747 bp, Homo sapiens
cgctgccgggccggggctgggccggagcggcggcgcctggatgccggcccggggctgggccggagactggcgcccgccccgaagcgactttcggtccccgacccgctccgcctgacccctatgatgaagagggcgtccactggagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttgg

SEQ ID NO: 2139 - DNA, 6620 bp, Homo sapiens
agagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctgatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctggtgaaatataggtgcctttgttaagtaggggaggtgggatcatgaacatctggcagctgctgc

SEQ ID NO: 2140 - DNA, 3546 bp, Homo sapiens
agaggtgttgtgaagattacagattataagggcaaaatggtggctgtatcagtgaacagtagtcaggattattttttactttccagtgactcaaacctctcctaaactgctctctcagttttggctccgtcttcccatgataataataggtggtgtagagaggtgacagagtcaaggaacatggttcttgttttctgaagatggttctttcctcaagccctttgagtcttctttggtcttatattctcatcacagaaggagaggtgattgtctttccccagttttgtctaccattccggttccatctgcattcccggaggagtcctgttgagggcagagtgactgtgagcaaaacaagaagagctgtgtcaccaagttccataaaatctgggagcccaagcagcatatttgtgggatttgtctgacagaacgcaatggaaacagagcgtggcattcgctccatctcccccaggtcacctgtggagaaagaaacatcatctctcaacagaggattgttcctccgtttgatgatacgtgcatcctgccatctggaattcaattgactgttctgtcttggagccaagaatctagaaactctccaatcctgaagtcaaaatggaatgcatctctgctcttcctctgggcatcatctaatttttttgttcttgttttccttgtgctggaatctacaacaccctctcctagcccctcaaccagcctttcttctgcagagcaacttagttctaattagcaactacaaacctattcacctacatccaagagttcagtagtgtcttttaagtatgtaacaggcaattcttttacattttattgagatgactactttaaaaaaattggttgctacccagaactgtttagaacattgcttgctttaggtaagtgagtgaagcaagatgtgataacatagggctgggggactagagttgggtaatatggtagcacatgattttgttacttgagattgcctgtaattgtagacatcagtgagcagggtgatatgaacctcacaggggctcttgaagttctgcttcttccctattccttaatgcaatacaatatttaggttcatcttttcaattttcctggagaaattaaatactgtgccataataaaaaaataagtaatttgaaagtaaaggaagggcatgaatggagagaaggcaggaaaacattctaggttggaaaaaatggcagaagtaatgttgggacattggagtgatggtggaggtgggaatagagtctaggatctcttcatcccatactatgcatctatcttcacaaaattagtatggccaaatattaaatcagctcatttctggttgggaaaagtagggtgaatgtgcctttctagctgtccttgagatgtaaatctcctgtaacatagcttccctagtggtcacctcaaaggctttgttctctccaggatagatgctacagagtgggacagtacttggtgtgtgtgtatctcaatttttttttaacatgacaaattgaactaggggcaagagaaggatagacagaggagcctatgatggggtggtggatactaaatattttccaggtgtaaggagcagaggaggaaaagggagactgggtaaccctttttcagaccatcatttagtccattttatgttgcaaatattagcaaacctactccagctttcttaaacagtagggttttcattacaacatagttaagagagtaggcttaggagtaagattgcttgatcctgagtaagttacttaatcttggtgtctcagtttcttcattccagttaagtaaatatatttaaattaaattatattagttagtaaatgtaaagcacacagaaaagtgtttggcttctggtgagctttcaataagtgttaactattatttgttattattattttaacaaaaccaacctccaaaacctatgaagtcagtttacagaaagccaccaggaaaagggaaataagaagattctttactttgctgtcatttgatacacttagcattttaaatgactatatgtacaatattaaccatgcctttccacaaaactatgtgtgtgcatatgaattacagggctttcatttgaaactgaactatctgtgtttgtagtcactttaatcatacaacaaacctacaaaatatttaagcataaattatcatgatgactaaatatggaaaagcttctgttaccaaaacctgcacccaaattgactgcacaggatgggtaattggatggtggtgtaaagaatgctcatgaggactaggctgctgctaattagatcttctatgctatttaaatgttctccaagcttcagggagtgccctgaaggcagttggacattagccttgtggtttttgagggtaacctacagtttgtcagcacaggggtggaggtgagcaccatgggacttttcccaggctgctggttaacatactgtggtttcaatcctttaagccaataaatggaggagagagaaagaaggcagactgaaattagaggaaaagagacaaagaaaggaaaagtggaagtaagaataatattcatgaaatgtcttctttgggccagatatttttttaggaactttcacatattgtgcttacatcaactctgtgggaaatgtatgattatactatcctcatttgtaacagacattgttgggtgcctatataacatataacagctatttttcttcatttttttcttgctgatggcgcttttttttttttagtgtttacttcccatacaaaacttatgtctccatgtctccatccttcagcaataggggtaattctgaaaggtcattgttttgcaattgcccttgaaaggaaattcttggacataacaacagataagattctagccaatgaaaggtgatgagaaggttgctgagaagtttctgagaaaggtttctttattctttaacaaataccctggaaagagacaggccttctgctgctgttcatggttgtacctgcacaggatgcctgaaaaggagtaaccgtggggtcagaagaggagccagcgtgaggacaaagcagatacactgaagtaccacctgtcactgaatttttgtgcaagagtataaacattctcattgtttaatctttctgtgggagacgctttactatgtgtagcaaagtcattctaactgacataccattttccattgtatgagaaaactgatgtacagaaaggttaagaaacttgcctgcatttgcatgcataatgaggagtggagagaacaggttgtgccttctaatatacaggcaagatatgtctcttttaaacagcacatacagacacactccaaaatgacaatttccatcattttttaaaaattaaatgagacaaagactctaaaactatttaaataacatgtacattactgtcttgggatttatttttgtttcagctctattgagatatagttgacaaataaaatggtatgaatttaaggtgtacaatgtgatgatttgatgtatgtatatattgtgaaaagaccaaaataaagtcagttaacatatctatta

SEQ ID NO: 2141 - DNA, 1025 bp, Homo sapiens
cggcgggccaggccggggtgcagagcttggctgtcttccgcggagagcgagatcccgtttcaaaatcgcaaaactgtgggggaggatgaaggcgagactttcccaaaccatcctgggcaccaaagaaggtagcgccactcagtcttctttgttgttctcaatgtatcaagcaaaactatttctaagcccacatattcgtgtgtcatagttcagggacacaggtcagcgacaaacttccatgctattacacccaaagagattctttagagtgcaaaatcactctgcactctgaaagataccagccttcctcttctcaaaatctttcgtggaatcataatttctgtagaaatccgcctatgccttgcctggttcagccacagcaaacttacagagagctgcaaccccagggatacaacgaatgcttcaacaacgtgacgcggcagaagcctggccagaaggccacacacctgagagttcgtcgaagggctggaagccgtgagagtgacagtcctcgagacagggactcgctgttacccaggatggagtgcagtggctattcacaggtgcagtcattaagcacactgcagcctcggactcctgggcttaaatgaccatccttcctcagcctcccaagtagctgggattacagatgcattccaccacacccagcttgtatcaacttttaaatgacagacttcctgttaaattcattcacatcaaataagttcctcaatttacagaccacaataccaaaatctgatgaagattaaaaagcgatatagacaactttttgaatgaaaatagtttcagccctctccctctccccctccccctcccgctttccaccgtcccccctctgatgcccagcggaggctggacggtactgccgccaactcggctcatggcaacctccctgcctgattcttctgcctcagcctgccgagtgcctgggattgcaggcacgcgccgccacgcctgactggtttttgtattttttggtggagacagggtttcgccgtgttggc

SEQ ID NO: 2142 - DNA, 2439 bp, Homo sapiens
gcgttcttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgtgagttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactaccgtca

SEQ ID NO: 2143 - DNA, 2337 bp, Homo sapiens
gtgctcaacagaaggggtgacgccatatggatgccatgttatgggagcctgtcacctgctaaccgagatgagaaattacaggttataatccccttcctgctgtctgaggagcccagcttcaaagatagccaggcaggagttattttatagaatggaagtaatttctacggggccaagcaataataaggaaattggaagtcaaggactatcttccgaatggagaagaagctccatcaaccacagaaggaaattatgatcactcctgccatcctgctcctttgtgtatccaggatgaaggggagaattggagtcttgcacaatgaaaggacaacattgctgccaaaacaatccatcgtgactgtagacatattttccaccctcatcctgcaggttttctgccagttgttggcccctcaccaattttgctcctgggcagtctgaggtggaacataattttgtataaaacaaattatgctcaacctcacttataatcagggaaatgtgagtcaaaaccacaataaaatatcacctcatgctgtttaggattgctgttatcaagtagacaagaaagaagtgttggtgagggtaaggagaaaataaaatctttgcacactgttggtgggaatgtaagttggtaaagccactatcaaaggcaatatgaaggattctcaaaaaattaaaaataaaattgccaaatgatccatcaatccttcttctggacacataatcaaaggaaatgaaatcagtatctcaaatagatatttgcaccccatatccattgcatccttttttgtaataaccaagatatgggagcaatcgaagtgtccatcagcaaatgaatggataaagaaatcatggtacacatatacagtggaatattattcagacataaaaaggaaggaaatcctgtcatttctcaagacattaatgaacccagaggacatcatactaagtgaaataagctagatataggaagacaaaaaccacatgatctcacttacatgtggaatctaaaaaagtcaaactcatagaagcagcgagtagaatagtggttgtcaagggcttgggataattgaggagatgttggttaaagggtacaaactttaagttataagatgaacaagttctggcgctctactatatagtatgggtgatgacggatgtgttaattaatttgattgtgacattcattacacgatgcatatgtataacaaatcatcacattgtacaccttggatatattccatctttatttatcaattaaatatttcaaaatgtttttaaaaaggaaggcaaaatgggccaaaaggagtaactactttatgtagagctgatgtccaggctagaatttctaaactttttctgtaacctagagtctctgttatacttttgacttacccattattcataacagatctcaggaaccctcatcacactgcctattgctaaaaactcaaaggagttattgttatatgaacaacccaagttaatgcagtcattaatggaaatacagagtcttgactgaaagagatcatttctattttttgttgcgatagtcagatcatagccagtcacatcttttagggaggatgcaaataggctggacttccttcagcaaacaggatgctgtagaataaaatattctacatgagaatacttaaacaaattggagtgcctggtgccaccatgtaaattgtgaggtgtcagacaggctggtctttggattagagattggacttactctctgtggccctatgagtagagcaggtcggggtggggctgggcagggaggaagatcatcttaaagtgatagatgtaggctcagtgtgaggaaggatttctaagagttggagctgctcagaggtgaaatatcaagagaatgcccttcaggagcagtgtctgaagacagaccacatggccaatagggagagataagcgggctgggtggccctcagcgctttgcttccagtcttgggagtcttactgaaatagctaatgaccactcaacccaaagaacagacacatgtctgccatgtctctccaggctcatcctgcttattgcaagtgaggcccaaaggtggggctgttattccctgatgtttcaggtccatgtgcaacttattcccagatcttttctgaaaaaaaaagcagagagactgtttgccagacagctggaccagaatgaggtaaaagaagataaggcccaaccgagaagtcagaaaagcttcacttttcattagctccacattccaaagtaagaaatcaatgtgcttagctgcaattcaaagcaattagtctttgttctcacacactctcaaagaacgacttaaagaagcc

SEQ ID NO: 2144 - DNA, 478 bp, Homo sapiens
tggtggacagcaaaggctttgatgaatacatgaaggagctaggagtgggaatagctttgcgaaaaatgggcgcaatggccaagccagattgtatccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaaccatgacatagtaatccaacattaattgtccttgttcaaaaacgttcccttgctacccagtacagaacaaaatgaaacaagtaaaaaaaactgaaaaaattaaacttgtggccagatgcagtggctcatgcctgtaatcccagcactttgggaggccgaggcagacgaatcacttgatgtcgggagttcgagaccagcctgaccaacatggagaaacc

SEQ ID NO: 2145 - DNA, 1097 bp, Homo sapiens
caattgtatgcctcctagtagaatggtgaaaattagaaagactgatgattccagttgttcgggaagatgtggagtactggaactctgatgccttgttgctgtctttgtttagtgttggtataacagaatacctgaggctggatattttactttaaaaaagaggtttattgggcttatgattgtggtgactagaagagtcaagattgggcagctgcatctgatgaaggcctcatgttgcttcaactcatgacagaaagcagaaagagagagtgtgtgtaaagatcacattgtgagagaggatgcaagagagagaagccaaggaagccaaactcatttttaacaacttgctatcatgggaactaattcattctctcagagcaagaactactcacctctgtaggagggcattcatctattcttgagggatccatctccctcacccaaacaccttccactagcctacctcccaacaccaccacactggggataaaatttcaatatgcattccagtagggacagaccacatccaaaccattgcagttggtgaaaatgcaaaatgtacaagcactttggaaaacagattggcagtttcttatgtagttaaacatatatttaccatatgactctacatttacactaaaaaatagttacacgacagaaataatgagtccacaaaaaagcattcatagcagctttatgcatagcagccaaaaaatgaaacagcccaagagttcaacaacaggttaactgacaaacaaattgtggtacctatatttacataatagaaccctgctttggtataaaataaaccatggatacatgcaaaatgtagataaatctcaaatacattattctgagtgaaagacgtcagaccccaaaattacaaatggtatgattcaacatatatgaaattctaaaaacacaaaactgtagttacagaaagcaaaacaatggtggcttggggtatcagatgaggaggatggacttgaaaagagcacaggatggacttttggagtgataaaaatctgtatcatggttatagtgatgattagatgagtgaatgaatttgtcaaaattcatttgtctgtacacttaaa

SEQ ID NO: 2146 - DNA, 3757 bp, Homo sapiens
ttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataattt

SEQ ID NO: 2147 - DNA, 634 bp, Homo sapiens
gctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcaca

SEQ ID NO: 2148 - DNA, 637 bp, Homo sapiens
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcaca

SEQ ID NO: 2149 - DNA, 1634 bp, Homo sapiens
atggctgcagagcggccggctgggatcttagataggaggggtggatttgcaaggcctagaatagctggggagtggtttccccgcggaatcggcctccctgccgctcctgctttgtactgtgacgctcagcctgtgatgactggtgtggaatccgctgagccaccttggcctaaggagactttaccactctgagattgtaaatctgtaaaatagagatgtaggattagcccatacggtagttgtggtaaatactgtgagacaataaggggcctgggacacagcattcaaatgggaataatgaaggtcaagactgtgattcctgtatctttgacgctctcggtataagcaccgtcgtgggcacagggcagtggcctttatgcaggagtttaagagggaatgaaggaatgaatgggcaaactctggagttcccaagtattctctccaggagctgtttccattcttttcgtttccagcagattcaagaggcaattgttggaatgtaaaaagagcacgggacttggagtcaaatacttaagtctaccatcaagtagttgttaagaattaaacaacaatttttgtgtacccagttaaatgtgggctgcttaggaatgatgactgtgtcttaatgatctctgtattcttagtgacatgtagaatcattgtgcctgacacatagtatgtactcaggaaagaaatggaaaatgtggttttagcattgaaggccgggagagagggtctaacagactacaagccctgccaggagcagagtaagggaaacagaggagaaaagtgtttttagtctgtgcctgaatgtatttacatctgtttgtagcccaaaagccaaaagcatacatacgcttggcttttctgtagctatgtttatggctttacagcagattttatggagctgcaattactttgatcatgagggactgatgctagtggatttacttcaccaaatggaactcactttgtggcttctgaagaagggacctttgtggactgtcatggagtagttaagagtgcaggctctgatttagtgatcagagtctgcattgtcaggaatgggacaaagtgaagttatgtggcacttgataggatgccctgagaagattgcaacatcacccctgtgatattcctgctgaagatccataacctggatgtaatcatgaggatatatcagacaaacccacgtaaagagacatgctgtatacaaaactgtaatcttagaaagtgccaaggtcatgaaaatcaaagatagaccctggaactgttccaaactggaggggaccaaagaggcatgacaactaaacacaacacatgattctgaactggatctttttgcttgaaaggaagttacagggacagttggaaaagtttaaatggggcctacaatgccgtggtaatgatgtgtccgtgttaatttcctgattttcatggttgcctgttaagttacatcagaggatgttcttgtttgctggaaagtaaatcaatgtatttggcaggggataaggcatcaaatggtcaccttaatttcaaattattacagggaaaatgtttctctctgtacttaataacttttttgcaatttcttaaaatgaaagctctggagtaaaaacttcaaggatccaaat

SEQ ID NO: 2150 - DNA, 3196 bp, Homo sapiens
ggaggggggaagcgcacagcccgaggactgcgaggacggggaggacccgccgctgccgggcaggaaggagaccggcacccagacaggtggcgacggcaaaggaatccttcttagaaattcctaaggctcaatgctttgtggaagattctgagaaagaaaatagtttccgatctttgggattcccgagatggtccaatctgcaaaaagttcattgccatttccatcaaggacactgagaacaagagtcttatctggattggatcctgggaattgagaagcttcagcagggcttccgctgggactaggatcaggatgtgaacacccccaacctggaccatctggccagggagggcgtcaaggccaagtacctcatgccgccccttgtgacaatgacctccccgtcccacttcactgccatcacaggtgatcgagtgtggatcaaggactggaaagtagcctctttgtgtccactgtggaacggaccccagactgtcgtcctgagcactcccaccgctgtgaaggtagaaggaatcccagtctggaaccaccacagctgtgtaaaacctgcagcgccggaaacctgggaggcaagaccaagcccagacaacccttgcagagtgaccctgaagaagacgacaagccctgctccagtcacacctggaagctgactggtccacgcatggccgaagcacgaggaagctcatcgttagattcatttttcttaaattttggacttatacagtaagggcttcaactaaccttactcaaaatggggactgttcccagtgtatttatcaggtcaccgaagtaggacagcaaattaaaacaatctttctgttctatagttattatgaatgtatggaaacattaaaagaaacttgtttgtataatgccactcagtacaaggtatgtagcccgagaaatgaccgacctgatgcgtgttatagcccatctgagccccctgcaaccaccgtttttgaaataagaactggccttttgctaggtgatacaagtaaaataataactagaacagaagaaaaagaaatccccaagcaaataactttaagatctgatgcttgtgcagccattaatagtaaaaagctagaaataggatatggttctcttaactgagaaaggagctaaagagtagaaaataaatatgtttgtcatgagtcaggggtttgtaaaaattgtgcctattggccatgtgttatttaggctacttaaaaaaagaacaaaaatgactcggtttatcttcagaagggagaagccaacccctcctgggccgccggtcactgtaacccactagaactaataattaccaatcccctagatcccctttggaaaaagggagaacgcgtaaccctggggatcaataggacagggttaaaccctcaagttgccattttaattagaggggaggtccacaagtgctctcccaaaacagtatttcaaacgttttatgaggagctgaatctgccaacaccagaacttccgaaaaagacaaaaaatttgtttctccaattagcagaaaatgtagctaattcccttaatgttacttcttgttatgtatgcggaggaaccactatcggagacagatggccttcggaagcccgagagttggtgtctactgatccagctcctgatataattccagttcagaaggcccaagctagcaacttctaggtcctaaaacctcaattattagacaatactgtatagctagagaagggaaagactttatcatccctgtaggaaagcttaattgtataggacagaagttgtataacagcacaacaaagacaattacttagtagggcctaacccacactgaaaagaatccatttagtaaattttctaaattaaaaactgcttaggctcatgcagaatctcattaggactggacggttcccactggactatactagatacgtaggcacagagcctacattcggttacctaataaatgggcagacagttgtgttattggcactattaagccgtcctttttcttattacccataaaaatgggtgagctcataggtttccctgtctatgcctcctgagaaaataaaggcatagttataggaaactggaaagataatgagtggccccctgaaaggatcattcagtattatgggcctgccacaggggcacaagatggctcatggggataccaaacccccatctacatgctcaactggatcatacggttgcagtccgtctaagaaataattactaatgaaactggcagagctttgactgttttagctttgcaagaaacccaaatgaggaatgctatctatcagaaaagactggccttagactacttgctagtagctgaaggagtttgtggaaaatttaacttaaccaactgctgcctacaaataaatgatcaaggacagatggttaaaaacatagtcagggacatgacaaaggttgcacatgtgcctgtagaggtttggcacgagtttaatcctgagtctttatttgaaaaatggtttccagctataggaggatttaaaaccctcattgtaggtgtattgctagtgataggaacttacttgctgctcccctgtgtattactcttgctttttcaaatgataaaagattttgttgctactttggttcatcagaaaacttcagcacacgtgtgttatataaatcactatcgctctatctcacaaagagactcaaaaagtaaagatgagagtgagaactcccactaaaaagtgaaaatgctcaaagggggaaaatatggtatgagaccaccacttctcctgttgtccttcccagtttctccccaacctccccttttccctagtttataagacagcaaaaaagggagaaagcaaaaagctggaaaaaacagaagtaaaataaatacctagacgactttggcgccaccacctggccctggtggttaaagtaacaataatattaacccctgaccaaaactactgttgttatcggtaaatcccagacattgtatgagaaagcactgtaaaaactttttgttctgttagctgatgtatgtagcccccagtcatgttcctcaagcttccttgatctattatgactttttcacgtagaacccttagagttgtcagcccttaaaagggctaggaatttctttttcagggagctcggctcttaagacacgagtctgccaacgctcccggccgaataaaaaaac

SEQ ID NO: 2151 - DNA, 2855 bp, Homo sapiens
gaccaggcggctgggcagcgccagttgaaagcggttgagcaggccgggcgcagtggctcacgcctgtaatcccagcactttgggagaccaaggcgggccgatcacggggtcaggagatcgagaccatcctggctaacacggtgaaaccccatctctactaaacatacaaaaaaaaaaaagtagccgggcgtggtggcgggcgcctgtagtctcagcactttggaaggctgaggcgggcggatcacgaggtcaggagatggagaacatcctggctaacaggtgaaaccccgtctctactaaaagtacaaaaaccaattagccgggtgcggtggcgggcgcctgtagtcccagctactccggaggctgaggcaggagaatggcgtgaacccaggagatggagcttgcagtgagccgagatcgcgccaatgcactctagcctggacgacacaaggagactccatctcaaaacaacaacaacaacaacaacaacaacaacaacaacaacaaaaacaacaaaaaccagctgagcagcgcgggccttctggcagcgggtccagctccagggcgccctagggcagcggcgtgcagtgttcgggtaataggacgcagacggtggggtcgccgggggcttcggggtggcctcggccccaggccatccagccctgtggaccgaatggagtcccacacgctgttgaggtagttgtgggttcccctggcctcgggctcggcgcagggtcagcgctcctgcaggcggcgcttgcggtacgggctggtgaaagtggagacggacggcaggatggattcacttggcgacatggcggggagctgggaagacggacaccggaacgtgaggaacacgagtagttcaagaaaatgctgaagatgcgcttggctgggaagctaggataggctgacgaagtcagacttagtgtgggaacctggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcacccccacaaaaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaatctgccacctcctgctggcaggatttgtttttgcatcctgtgaagagccaaggaggcaccagggcataagtctactcacttatatctgtttgtctggaacataacccatgtttgtttttacaacaaataaaattgatcttgaataa

SEQ ID NO: 2152 - DNA, 2045 bp, Homo sapiens
gaggcgggagccccgaatgcggttctcgcttgctgcgtggcggtaaaggaccgcaggtgtcgtaaaagggccgcagtggcagcgtcctggccgacggctagtagcccattttggataccgtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtaggcagggaggggagcgcagagccgtgccacgctctccgcggagttggtttcattcttttttcataggtaattagagaaaataatttgatatgttgttgtaaagagtcatgaccactggaagtattttcaggacgtagacctggtgggtcactacgtggggggagagaggtgtgaagcggaggtacatgctggaaacgtgtgaatgttgttacgagattggagcgtttgcgatgaccttcctgcaggtggaagcattgtgcacaggtggttgggtttgtttgactcccggatatgagaatatcaagctcaaaatttatgttgtgatgatgaatttctcccacttgtactttaggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaag

SEQ ID NO: 2153 - DNA, 3373 bp, Homo sapiens
tttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgaac

SEQ ID NO: 2154 - DNA, 596 bp, Homo sapiens
agctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaaggtgcctggcacgtagtgctttaaaaacactgaaggaaggggaggatgaaaaatggaggactactcaggccttcatccacaccaacccacgtagaactctgcaggaagtttcaaagtactggagattaaagtggtcaacagtacagaaaatgtccctgcccacatgtagcttacactctatcatgtatatggtctatcagaccataagtaaataaaccacacatagaatatcagatagtaacaagtgctaggaagagaaacaaacctagacaaggggatagaaagtaatggaacgctgatatttagatatattgattatagaaagcctctcagaagaatttgatagggagtggcagcataatttttttccctcctcatgtctctgggttatgat

SEQ ID NO: 2155 - DNA, 2757 bp, Homo sapiens
gaccaggcggctgggcagcgccagttgaaagcggttgagcaggccgggcgcagtggctcacgcctgtaatcccagcactttgggagaccaaggcgggccgatcacggggtcaggagatcgagaccatcctggctaacacggtgaaaccccatctctactaaacatacaaaaaaaaaaaagtagccgggcgtggtggcgggcgcctgtagtctcagcactttggaaggctgaggcgggcggatcacgaggtcaggagatggagaacatcctggctaacaggtgaaaccccgtctctactaaaagtacaaaaaccaattagccgggtgcggtggcgggcgcctgtagtcccagctactccggaggctgaggcaggagaatggcgtgaacccaggagatggagcttgcagtgagccgagatcgcgccaatgcactctagcctggacgacacaaggagactccatctcaaaacaacaacaacaacaacaacaacaacaacaacaacaacaaaaacaacaaaaaccagctgagcagcgcgggccttctggcagcgggtccagctccagggcgccctagggcagcggcgtgcagtgttcgggtaataggacgcagacggtggggtcgccgggggcttcggggtggcctcggccccaggccatccagccctgtggaccgaatggagtcccacacgctgttgaggtagttgtgggttcccctggcctcgggctcggcgcagggtcagcgctcctgcaggcggcgcttgcggtacgggctggtgaaagtggagacggacggcaggatggattcacttggcgacatggcggggagctgggaagacggacaccggctgggaaagggtttcttctgtccataaaagctactccaatggctgtgggagacttaattccaattccaggtgatacagccgtcagtctcccactagctgtaggatggtgtgctgcagttcacagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcacccccacaaaaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaatctgccacctcctgctggcaggatttgtttttgcatcctgtgaagagccaaggaggcaccagggcataagtctactcacttatatctgtttgtctggaacataacccatgtttgtttttacaacaaataaaattgatcttgaataa

SEQ ID NO: 2156 - DNA, 3070 bp, Homo sapiens
cttcatggacacccacacagattcactggagagcaaagcctaccagagtccctgtcagcagcactgtttctagaagcttccacatgagcagacagcatggagtcctgggggctaatgaagcagcaatgtcagcatgagcacaggcagggagaggcaagaggagcagagtaaaggggaacgttctcttcattcttccacctgcctgtcccccagccgacacgtcccttccgttccctgcaaggccatttccagggaggcttacgaagacagcagatgatggtgatggaaggagtctgggtgctgagctgtgccatggacctggagagaaactgagtccgagggatgtcaacatgccaagtccatggaaatatcagtgggctggaattctagctgcctgaaagaagacattcctcacacaagacctcacaatcatatccatggaattatagcactgggctctccagatggtgctacaggaagacctccagaaatttgactcctctattcaaggccctaccacagagacacacaggaacggaactcagaatcacaaacaaagaaactttgatccaagaaagaaaatgatctttaaaaagaccctcgtttcatgctggccgatgctgagaaaatctgctctgaaggatatttggagacactgattaaaaggtagtaccatcaccacatatttaacttccccctctttttcctctgcttctaggagtagagaaaccaacaaaaccaaccggagagagatggtttcaaacaatctgtcccccaccccaccactattcacacctttcacaagggcccagccacaaagccagtgcaacatgacatcaatcatcagcaaagtggagatggttgtcccagtggagggggattcttcgtgttacgtagataggaagcacgatgcaaaagtgttgaagcaggagtgtaaagaataattaaaacacctgcccaagacccaagcaaggataggatttcccagacattcgtgagggagaaaatgccatgtcctttccttctggtgtcacatcagaatctgaaggctgctagagaagggagagaaacatgaaagtgagtcccatgctgattgttgttgaaatacctggaaagaaactggcaaagactatccaagggatgctaagacatgtccgaacttacaaaacagtagaacctgaataggaatttgaagttgtctatactctcctcagccacaccctgccattttacagattgtcttctctggggaagttagctgtcatgttgtgaggatactcaagcagtttataaagaggttcatgtcgcaaggaatggaggcctcctgccaacagccatgtaaaggagccatctaggaaatagattctccagccccagtcagaccttcagatgattacagcccctaccaaccttctgactgcggtggaaggaaggttccggaaccagaaccacccaggttaatgtgggtaagtctcatccaatcctttgaaggcctgaagaacaaagagtgaggtttctggaagaagaaaattttacctcaagcctgcaatgtagaaattctgcttgagtttcccgcctgctggcctgccctgtggaattcggagtcaagaaggagtcttgtaagcattaactgagatagtatatgaagagtgcttttgcaccgagtgaaccttcaatcaactgtactagtttgtatgcctggaagagctgctatatgggatcagaaagaaaaataaggtgcatacgccagaaaaaaaatacttgcatatgagtactaggagatgcatgacaatgttcacggcagcagtattcatggcagtgaaaaatgaaaagaactgaaatgcccattgataaaaacgtctacttatttgtgtcatctttgcacagtggaattgtgcgagtggaaatgattgatctacagctaggagaagcagcagagctcaatctcaaaaacataacgttgtgtggaaaaagctaacctcagaacactttgcggctctatcttagcaaaccaggagagaaattctcctgatggccttgaagaagcaaacagccacctggttaagcccctgtggatagtgccaagtggcaggaaagtgggagccacctctaggacctgaggattaaagtcagtaagagctgggacctcactcatgcagactcgaggacatgaattcgaccaacaacttgaatgagcttggaagtggattcttccctagtccagtcttcagaaattaagaatgttcccaaagaatgatggagacatttcaaaaggatacggaagccagattgtgggcgcttctactggccaactctgggacatcgtggacatcaaaataaatttgtaataataaaggattatagcctattagttaaatcagaaaaatctgatttaactaaatgagtaggaggaaaagaaagctcttccttatattagaaagtcaattaataaatgcagaaaggaatgaaaaaattagaaaagccaccatttggcaaccatggcaggcagaatggggagtatgcctccagacagtaattcctttcaaactggtttataggaactcactgagcttgctgatcgacctctgagaggcaaagtttctgaattatgaagtactgattatataaacttagacagagacatgcttcattatttaataggactgtgtcaaaagcctactattaggatgatgtgttgggtgtggaacagggtctcttcctgccaggaacactggtgatttcactccgtgttcaggctgatctttgaagttgaagacaagcagaagaatccttctaaaatttagccatgcccataggctgggagggacactgctccattcagaggcagcaaagcacattactgtatctcctatagagctttgagcagtccagtgtacatggagaaacttagtaaatgttgttgaattagtgaatgaacaaatcaatggaccaagtcaggggtaagtcttacatttgtcatctaggtgattaagaaaggaaaaagtatctgtttcaagaggattacaatctaactgtactccaatagtaaaatttactcttttggaatctg

SEQ ID NO: 2157 - DNA, 30245 bp, Homo sapiens
aggagacacagaagatggagggagggatggcagcctaccctgtggcaacgcgggagtcgcgttgccgcagggggcgcattggggtccagccgtccccagaacgcagatcagaggtagtcggacctttcccgctggcgcgcagcctcagctagggcacacagagtgaacagaaaaagaggatacctctgcgatcccgggtcatctccagatgctagggttatgggtgagtgctctttatccttctgaatcctcttccttatccttttcaaaaagtctgttttggccaggcgcggtggctcacgcctgtggtcctggcactttgggaggccgaggcgggctgatcccatgaggtcaggagttccggaccagcctggtcagcacggcgagaccccatctctgctggaaatgcaaaaattggctgggtgtggtgccaagtgcctgtggtcccagctgcttgaggggctgaggcaggagaatcgcttgaacccgggaggcggaggttgcagtgagctgagatcgtgccactgcgccccagcctgggcgacagagcaagactctgtcataaataaataaataaacaaaacaaaacatcataacatatagaaaaaattttcaaacaatacaaattgacacttgactgattcccagagagtgaaggcagtgtggcatagcagaaagagcgaggtctgaagtcaaatcgtatgggtttaaaacttggctttgcctgatatgatctgtaaagtgtaggcaaatctgttgacttctttgggtctcagtttatcatctacaaaataggcttaacaattattttcatgattgctgggaggactagataggatgatatatgtgaaagttcttagtaggtacagaaattatactaaaaaagacaaacaaatccacatgctataatgcagtgtggactatctttggtaacccacatgtcaaaggtagtcttaaactgctctggtttggtaaatgttggcgtaaactagaagtcagagactatgggatccacccttatctgctctcgagctttggtttacaatgagctcaagtgtggggattgtgtcaaatgattcctggaatcccatacatttgtaaaattctatgaatttgtgaagtctgcaaaatgtgaatctgaggtgtatgtactgtagagcaactattagaccatttatcacattatatatagatagacagatatatctatatataattttttttttaggcagagtcttgctctgtcacccaggctggagtgcggtctcggctcactgcaacctccgcctcctggcttctggccgttctcctgccttagcctcccaagtggctgggattgcaggcacctgccaccatgcccggctcatttttgcatttttagtgaagatggggtttcgccgtgttggtcattctggtcttgagctcctgaccgcaggcggtccacccaccttagcctcccaaggtgctgggattgcaggcgtgagccaccgcgcctggctatcacattatattttacagaagccatcatcccatacctttgagtccagccccagaaagagcggtcccttgcataccattcaatatgaccttgggcatcctttccccactccccagccatagctgtttgggctagggttggaaacctgtccatggtaggccctttggagtctcttgctggccacttgggattacaatggagacagtcaagttaacagacagtaatgctggacctggacagttgccagcacgtgttggaggctgagagcaccatccagtgtaagccatggtggatggtgtagtaggagagcaaaggaaggcaatctgcaaatgggttggatggggagggggagaaaaggtgggagaaagagagaaatataaaatgagggaagcagaggaagagataacatggcaatgaagaaagtaacatctttggtcattttctgttccaatcacccacagcaggcctgtcggttctcttttacctaagtagattttagtggcttttctattcttgatctccaaccatgccctaagacatacggcaatggtaacacagactgaggattctctgatggcagggctttgtctcattcctttttgcaacaagcacaaagtagatgctcaatgaatttatactgaaatgacatgaaaatcatgtttgtgtatgaagtgtcactgatggcatttatatgaaaaaggttaattaaaataattatgtttttaaaaaagtctgttttatcctatgaaatgggcagtggttctgggatttcagcccatctacagaagacactgctgaggcatgtagataactggcatggggcaatggtgccctattctgtagctttccaccatgcttagtaggaaagactttttgaatgaggtcctgatagtgaggcccaaagtaggaagtgcatggatgagcacctaggcaagatgtgtttccttcaggggattgggatcatttcttggaacttgaggtcagtgtcctgtagtgtaggggagaggggaaatgggttgggactgggactctgggaggctggccatctgccagttatgggatctttgggctcccagagttacttttaagaagtggtcctggcctcacttaagaagagaaagtctgttggagacccagggaagacagacaggtcttttgggccttcaccttattggtgttgagtacagctctgccttcttgtcctgcccattatctcccaatccctcttgggcccaactcactgcacaatggccctcctgactggtgaggacatggagtgcactctgccttaactgttagagggtgattgggctaaaaggggtgggaggccacactcacgcagcctggtgccaatcgctcaatgtcccttatgtctgtctcttgacatactgaggagaaatgtgggggaatgtgtcttgaagaggtgttattccacacaagccatcagaagtacacctaccacaagcctgcttgtaagaattgtcctgccattgatcctggcatggacatcacatatgaggaggatgggtatctctagtttggctcctgtctcccctcctcactgacccaagcgtgcaaccttccttgtctggagaccattcctcatctggagggtacggccatgtgaaaggagcggggtcctcaggccacattgtcttgtgatggcagtttttcctcactgttcaccccagttctggtgccgctgcgccaccattttgtgggtattgcatcctgagacctctgggtcaagctgaccttttagtggcttatgtcaatgtccaagtcaaaatgttacttggtaagcagagtttaagtctggctccaactctctgcccagactcaagatattttcctgtggtctcagccagctccagtgctaaagattcagccatggcttttaggtatgatcataaggtaatgattagagccatttctccttgtcaagaggaaagtttgagaccaccctactgggatgaagccctgcaagatggaggaccagcaatgagaactgggagccccaaggattcagccaggataaacactggctggctttttcttcagtagcaaatggcagagggatggaatattggggaggaaagaggggaaggaatgctggcatttctggcataatagtgccatctagaagaacttgtttgacaatcccatgaacccttgctcatgattgtctgaggagtggcttgggagtgaagtggggtttcaggagggaacagagctatctggatgcatgggagaagtgtggccaatggccatttggggctgtcaagcttcagagacaagcaccaggtcaagacccccagagcacctggtgggacctgtactggaagccctggctcatgattctgttggtagccatgtctggatagggctagcataaatctctgcaaaggatccccaccctgaggttacagccattttaccacctgcccctttactggctgcagtgcctgctcctgagagtgccatacttctggcagaagcctgtttttagtgctgtgtgtcccacaccaaagagagctagtgcctagatccctgcctttgcagagttcttcttggccaccttccttcaaagtcccaggagcctcagggcaatgagcaggaattggccttgcttcccattcacccctggctctcccaagtctgaacctgtgtttatccaggtagctgggaatcaagaagggccaggagtccatgccagaatctaaccactgtagggttctgtcatcatccttcctttctccatgcccatttctctctgtgcatccagccctagcctcctccccatttccctcagatctacttctcatcaagcagtcctgccgagccaagaacgaggtacatactcctgggtacatggcctattttatacactccatcttcctaatggcctactcctggaaaacatcgtggttaagttgtgcttttgccagctcttaactgactgaggctatgctccctggtcagtgcttgcccacaggcctggtaggaagactcaaggcccagatctccaccttttttttttctttcacctcccaaatgggtgccaaaaactgctctagtcctttctcagtttcatacttgtgagtttcctaaagtgttgcccagtggtcttatgtgggcagagccttttagggtcaatcaaccttcttttttccaagcctcagggcaagacctggacctacaggatctgattgatcctaagctcaaggctgtgagtgtgatgctctgagagtgttccttaggtttgagccaatgctgtaagacaagcagatacacagaacatagatcttcatgtttgaacccaggtttcttccacgaggagaggaaccagatcatactaaggaactagagcctaacaaacagtgcacttccggattgttcttgagctgaagtacagcacaatacagacctaggtcctctgacaccagagctcaatgttggtatcaacttgatccccaatgagtgtcagcactctctgccccatgggacaaaatgtgtgcaatggcacgctgtgagacctttgacccagactttctttgacaggagcaaaaattaaccagacaaagtttgaagtgcaatgtacttcaactactctttcttgtatcattgtagtaccccccaaatcaggaaattttctatcctttttatgagctacacctagcaatgtggctactgccacctcccctttatttggctggccctgggacctccagggcagtgcctcctttcttcgcttgaagttacatcttcaccaagagcaaagatccacagtcaaaatgccctgtggtagctccaggttcccaaacatggctgccactaaggcctggcctctgccgcctcccgagcctggcaggcctggcagcccagggtttcttggtgggcaagctcggctccctcgcttttgcactgaatctggaggcacccagtcaggtgcccacatccagtcccagaattccctgagtgccccaaacctaccctttgttctattagaaaccttcccctctggatacactgcgaagggctggaagccatgctcaaaaagcttcctcttgatggcactgttgttccagaaatgccaaccgccccgtcctaccaggcctctccctccaccctttgtggatgaaaaaacaccagggaaggcccacaaccagtataagccttagaagcagagtttattctgctatagtgctacaaggcagggctgagtgtacctttctctggggctcttggttttaatataaatgtctgtgtgtaagtgttcatcaaaaagaacagatgtatccatgtatctgttgctgttaatacatcatccctttatgagcgttaagtctaaatatcatgtaaatgtgtcagtggcttctgggcacacttgtgggtttatataggatatcttaggtagaattcttgctcttatggggacattgactcatagcttgaggtgggctgagtacctggatttcccttcttatcttggagttgttgcttctcttctgtcctcatggagccagggcaatcttacccaaggcagtccagcagcctcttgtagcttaagatgtcagcagcaggccctagagggaatggcaggctattgcggggcctgcaggaattgacaggtgctatatcaggtgagaagactttttcaaagtgaaaataaaaatctagagatgaatatctaaatttaacattttattacaggaggaaaaattgcagtttggtgcatacatacagattcggtggcctttagtatttctgaagaagaaagaggaggttgcaggttttataaaaggagaaatgtcacatacagtttttctagaaagttcattggtactagtaacgtattgtggagctagcagtctctgatgggtgagtgatagtcttgggtaaaagtggtcttagagttttgagcaggttgtttcagtagctgttagataaaagtgttttcaggatataacaggcagttttatcatccaggctggtagagaattacattcttagagcaatgtaataatgccctgagtgcttcttccccctgaactcttgactgttttagttttatattgtaagaatgacccaatgtgtgtgatcaactttcacacgcccctctttgatcaagatccttctatgaatgcatgactgatcaaccattgtgaagttaggcttaattgtctctcggtgctgggatggagctgtcctgttgtcttcctcattgagggtaagtcataggggtgtatatcagtgacctgggtcatattggagtaacaaggaggccagaaggaaaaattttctcatggtaggttcatctggagtccagcatcaagtttcatcttacagttccatagtcatcagcagtcaccttgaaacaatgggctaattttatccccttcagagagctggctttacaaagattagacaggtaataagagcaacacttaaaaatcataatacaaaaataaaaaacaatataataaaattagtttgcacaatggttttgctctaagagcacaaacttaagggcaacaactaaacaaatcaaaagaccatagaggaaactaggtgagacctgttatagccactgagtagcattttctgacttggtaaaattaaaacagagaatgccaattttacaaaaggaaccaccattataatttgaacaaaatttttaaagttgcccactaggtgaactaaaaggatttctttggtcaggttttgtcaagttatctatagcagttactggttgctaaaaaaaagtaattatgtcaacttcctgccaagtgaaaaaaaaatatcattaagggaagtaagactttcattatgatatgtcattctgatgtcttaggaaaggtcgtttatggcatgaaaaatgtcaacttcttgtcctggtttacagtttgaatgtctctggctttggtgtcagggagtttggtgacctttctgtgtggttcatatatcaggcacaagatttgttccttaaaatttatctagttttagcttacaggccttagaaacgaagtagttcctgccttaggagttttatggaaaaaagttggattggaggaacctagaataatttaggaccacgtgtagtgtataagtagataataagagcttgaaaacaatgtgcagagttaaaatctaataacaggtgtagtatagctcttttttagaaacaaccttttctttctacattgatcatataggaaatctcagattttaaaacctcatgaggctagaaagcaaaaccaagaccaactttagattttattataatcttaggattcctggacctgctgggaagtgacagtttttatttactcactataaggctgggaacccttaagtcaggcattttatgcatattttcaaatatgtcatttcagtcaaagccttggtaataaccatgcttttaaattgtattctgctataaagaagacagatttttattgggcttatgcaaataatcatattaccataagaatactaacaaatactttctgaattctggaggaatcaaggagaaaaatccaaatgattttcctttttttcttttttcttttacaaaagtatatcttaccaaattgctataaatgatagctcaagagagaaaatgttcctaaatctgaaaaacaaaacattaagaaccacatgtatcaagtaaaaaatcataaaaacattgtcttcattagttattcagtctcatataatcaacatttgttctctttgatctccactagtagttttctgaatccatcagtttattagagttctggaagttttcatttagtccattgatattaaagttatcagaaacctgtatttaagagttcttgtgggccaggcatggtggttcacacctgtaatcccagcactttgggagcccaaggcaggtggatcacctgagttcagaagttcaagaccagcctcatcttgaactaaaaaaccccatctctactaaaccccgtctctactaaaaatacaaaaaaaaaaaaaaaaatttcctgggcattgtggcagacgcctgtaatcccacctacttgggaggctgaggcaggagaatcactggaacccaaaaggcggaggttccagtgagccgagattgcgccattgcactccagcctgggcaacaagagcaaaactccatctgaaaaaaaaaaagagtacttgttggagttttttccattaatttgatatttaattttattaattagtttatttcagctctgtcatccaggctggagtgcagtgacaggatcacagctcactgcagcctccaactcctgggctcaagtgatcttcctgcatcaccctcccaagtaatcaggactagaggcaagtaccaccatagccagctaattatttttttgctttttgtagagacaaggtctcgtgatggttcccaggctggccttgaacccctgagctcaagcaatcctctcgtctcagcctcccaaaatgataacttttcaagtgtgagccaccatgaccatcccttgttcatgaatttgattgtaaatgtttttacagaataattcaaaatgataactgtggattctaaaaacttggaatggccgtggttaaaaatctgatgaaaggttgtaattgatgagaaaatttagttagttctattacatatagcatttttaggtaacaactagaattatgattgataacatatttctatgaatttatataatttttgaaacatttgcattaatagtacatttataaatgcaactaagagaagatctaatattgcttatccttcaacaacatttcttacacaattttccaaataagcttaatcatttaatgtctctacaaaatgaaaaaaatatcttttgttgctttccaggggtctgaatggaaaatcctaaagttaattctaggtcaacaagacttaattaaggatttgatcttgagtaagtttgtcaaagatgttaaagcgctcaaagcatttgatcaaaacagaattgcaggccactataaaataatactcatttaaccaaagtgatcatcaaaagacttcagatgcaacacagagagttacacggatataaaaaccttaatccttttaaagctcaattatcctcagtaatcaaaaacctaataaagtcaacacagcaaattttcttgataaaacaaaaagcctttgattcttaggccaactaacaaaaagccaaagtaaaaccatcagccctgtgactttttcttcttaatggaagctcatttagatgaactggaagttgaacctgatgaatttaattagacacaaggataatgtttccaaggttatgagtggaataattcaggtaaatcaaaaaagccaagaatacagagtcaaattttacgggagggaaagtgcttttttaggcctgcaaggtaaacattttagtgttaggccataacagcaggttagaactagagaaaaaagaggggctgacaaaaaagttgaaggagagttttcataacaggcattctcaaggggataaaaaggtgaatgtcatgatgtgtgacctgcaaatcacgtgcagtgaggtacagcaaaagttgtacctctgaggtataaatctgagaaatttgaaaagtaaaactttaccttaacaaatgaaattagggggcaaagcaagatggtggaataaaaggctccacctatcattttcctctcccaaggacataaatttaacaactatggacacacaaagaataacaccgtgacaagaataaaaaaatcaggtgagcactaacaatacctggttttacctttctgtcactgaaagaagcactgaagagatagaaaaaaagtattgaagtgctaatgtcacccctccctcacaccctggcagcagcagcatggtgctgagagagtttccgtgttctgggggaagggagagcatggcagttgtgaggtgttgaactcagtgctgtcaagttagagcagaaaggaaagccagtccaaactcatctgatgcctgccatagtgggagtatttaaaccagacctagccagaagggaatcaccgcttgagttcctctaaacctcactaccacgttctaaagtgctcagagactctaaatgaactcgaaaggtaggctaggccacaatgatttcaacctttagatgagttctaatgctgaaatgggcccagagacagtggactggtggggcacataacctactgaaacatcagctggggtggctaagaaagtgtgggcattacctctcccctaaccccaagctacatagctcacagctccaaaagagaccccttccttctgcttgatgagagaggagggaagagcgaagaggactttttattgcatgttgaataccagctcagccacagcaggataggacactggtcagaatcccgaggcccccattccaggccctacctcccaggtaacgtttctagacacaacccaggccagaaaggaacttgctgccttgaagggaaggacccagtcctcgcagcatttattacctactaaccgaagagccctagaccctgaatagcaagcagagatatccaggtactactttgaaggacttcagtgggactctgagacttactggcttcaaacatgtctcagcacatttccaactgtagtggctacagggcgagacttcttctgcttaagagcagaggaaagagtaaaggggactttgtcttgaaccttaggaaccaggtcaaccacagggggctgtaccaagtgggctcttggagtacacaattccaggacttgcctcttcaatggtattcctggacctctcctgggccaaagggaagcccactgccctgaaaggtgagtcccaagtcaggcagcattcatcacaaacagacataggagcccttggacctaaagggaacattgacagtggtctggcaatactccccatgggcctgtgatggtgatgaccacagagtgaggcttctttacatttggaaaggggaggggagactggaacgactgcattttgtgccctcactgacagctcagccacaatacaatagaacaccagcaagacttctaaggttttggactcttcttcctgactccaagatggcactcttggacccacatggggcctgggagcactcactgctctgaagggaagggtgcaggcctaactttccacctgctgattttagagtcccagggccttgagtaaatataggcagtagccagggagtggttactgcaggcgttggaaaacatgcagtgctgtgctggcttcaggtctgacccaacacagtcatagtggtggtggccacaggggtgcttatattattgcatccccagtttcaagtcgctcagaacagagagagatactatatttatttgaaagaacataaaaaagagaacaagaattatctgcctgggaatccagagaaatctcccagatgttgtccaagaccatcaaggtagtacgtctacgaatctgcaagaaccacagtgttactgggctcatggttcctcataaagcagatacagcttagatgacaacacccaagtcctctcaaatatctgggaagccttcacaagaaggataggtacaaacaagcccagactgtgaagactaacataaatacctaactcctcaatgcccagacacagacaaacatctacaagtataaaagacagtccatggaaacatgacctcaccaaatgaactaaataaggcaccagggaacaatcctggagaaaccgagatatgtgatctttcagacagaattcaaaaaagctcttttgaggaaactgaaagaaattcaggataacacagagcaggaattcagaattctattagataaatttgataaattgaaatagttaaaaagaatcaagcagaaatttgggagctgaaaaatacaattggcatattgaagaatgcatcagtgtcttttactagcagaattgatcaagcagaagaaagaaatagtgagcaagctattgaaaatagggcaggcagtttgaaagtacgtagaggagacaaaagaaaaaagaaataaaaaacaatgaagaacacttacaggatctagaaaataggtggaaaaaagcaaatctaaaagttattggccttaaagaggaggtagagaaagatataggggtagaacatttattcaaagagataataacagagaattctcaaacctagaaaaagatagtaatgtccaagtacaagaagattatacaacaccaagcagatttaacccaaagaagaccacctcaaggaatttaataatccagctcccaagaaacaaggataaagaaattatcatgaaaacagcaagagaagagaaacaaataacatataatggatctccagcacatctggcagcaaacttttcggtggaaatttcacaggccaagagagtggtatggcatatttaaagtgctgaaggaaagagacttttaccctagaataatatatccagcaaaaataatcttaagacatgaaggagaaatgaagacattcccagacaaacaaacactgagacattttattaacactagacctgtactacaagaaatgctaaagaaagtacatcaatcagaaataaaaggatgttagtgagcaactaataatcacctgaagggaaaccaaacaagagcaaaagttgctgcactgatatcagacaaaatatatttctagacaaaaactgtaacaagagacaaggtcgctatataatgataaaagggtcaatttagcaagaatatataacaattttaagtatatgtgcagtcaaccctggagcacccagatatatgaagcaaatattattagaggtaaagaaagagatagaccctaatacaataatagctggagacttcaccccactttcagcattaggcaaatcttttagacagatattaacaaaaaaactcaatctgcactatagaccaaatggatctaatagatatttacaaaacttttcacccaatggctatggaatataaactcttcagcacatagatcgttctcaaggatagaccatatgttaggtcataaatcaagttttaaaatattcaaaaaatggaaataatatcaaacatctactctgaccacaatgggataaaactagaaatcaataacaaggaattctgaaaaccatacaaatacattaaaattaaacaatatgcttctgaagaatcagtgggtcaatgaagaaaccgaaaaaaagttgaagaattccttgaaacagatgataatgaagacaccatctaccaaaacctatgaaatacagcaaaagcagtattatgaaagaagtttgtagctaaaaaaaaaaaaatctaacagtgtgcttgaactagaaaagcaagagtaaaccaaaaccaaaatcagtaaataaaggaaatactaaagatgacagcagaaataaatttgaaatgaagaaaacaatgcaaaagattaatgaaataaaaagtttgcagtttgagaagttaaacaaaattgacctttagctggactaagaaaaagagaagatccaaataaataaaatcagagatgaaaagggagacattatgactactacagacattaaaaggattactagtggctactatgagtaactatacgccaataaattggaaaatctagaagaaatggacaatttcctagacacatacaaccttccaatgttaaaccagtacgaaatccaaaacctgaacagaccaataacaagtagcaagatggaagccataataaagtccctcagtaaagaaaagcttgggacctgatgactttactgcagagctgtaccaaacatttaaagaagaattaataccaatcctatttaaacaattcaaaaaaaaaaatgaggaggggacacttcctaacttattctacaagaccagtattacattgatagcaaaactagacaaagatacatcaaaaaaattaaaaaaaaacacaagccaatatctctaatgaatattgatgcgaaaatcctcagcaaactactagcaaagcaaattcaacaatacattagaaagctcattcatcacgaccaagtgggatttattccagggatgcaagggtgattcaacatatgcaaatcaatcattgcgatgcatcatatcaacagaagaaaggacaaaatccatatgatcatttcaattgatgtcaaaatgatgttttcatcccttcatgataaaaatcctaaaaaaactgaggatagaaggatcatacctcaacataatacaaaccatatatgacagaccccagctagtgtcatactgaatgaggaaaaactgaaagcctttcctctaggacctggaacacaacagggatgcccactatcaccactgttattcgacatagtactgaaagacttagatagagcaatcagacaagagagagaaataaagggcatccaaattggaaaggaagaagtcagattatccttgtttgcagatgatattatcttttatttggaaaaacctgaagactcttagccaggcatagtgacatgtgcctgtagtcccagctacatgagagcctgagacagaaggatcatatgagcccaggaggtcgaggctacagtgagctgagatcctgtcactgcattccagcctgggcaacagaatgagaccttatctcaaaaaaggaaaaaaaatgaaaaaaaggaaaaactccacaaaagaaattagaacttataaacaaattcagtaaagttgcaggatacaaaattaacatccagaagtcagtagcatttctttatgccaatgtgaacaatctaaaaaagaagtaatcttatttataatagccacaaataaaattaaatacctaggaattaatttaaagcaatcaacaatctctgtaatgagaattataaaacactgatgaaagaaattgaaaaggacaccagaaaatggatagtctatgtttatgaattggaagagtcaatattgtgtaaaattccatactacccaaagcaatctacagattcagtgcaatccctatcaaaataccaatgttatttttcaatgaaatagataaaacaatcttaaaatttctatgtaaccacaaaagacccagaatagccaaagctatcctaggcaaaaagaacaaacctggagaattcatattacctgacttcaaattatactacagagctatactaaccaaaccagcttaatgctggtataaaaacagacacagaccaatggaacagaatagagaatctagaaacattcacactcctatagtgaactcattttcaatagaagtgccaagaacatacgctgaggaaaagacagtctcttctttgataaatggtgctgtaaaaactggatatccatatgcacaagaatgaaactagatccctatctctcattgtatacaaaaatcaaaatggattaaaaacgtaaagatctcaaactatgaaactactaccagaagtcattggggaaaatctccaggacattgttctcagcaaaaatttcttaagtaattctccacaacgacaggcaaccaaagcacaaatggacaaatgggatctcatcaagttaaaaagcttctgcacagccaaggaaacaaacaaaaaattgaagagagaacccacagaatgagagaaaatatttacaagctacccatttgacaaaggattaataaccagaatatatgaaaagctccaacaactctataggaaaaaaatccaataacctgaccaaaaaatgggcaaaatatctgaataaacatttcttcgaagaagacatgcaaatgaaaaacatgaaaaggtgttcaacatcattgatcattagagaaatgcaaatcaaaactttagtgagttatctcaccccagttaaaatggcttatattcaaaagacaggtaataacaagtgctggtgtagatctggagaaaatggaaccatgtatactgttggtgagaaattaatacaaccactatggaaaacagtttggaggttcctcaaaaaaactgaaaatggagctaccatatgatccagcaatttcactgctgggtatgtaccctaaagaaagaaaatgaatatgtcaaagagatagctgcattcctgtgcttgttgcagcactgttcacaatagccaagatttgggagcaaccttagtgtctatcaccagatgaatggataaacaaaatggggtacatatacaaaatggagtactattcagccataaaaaagaatgagatctagtcatttgcaccaacatggaaggaactggagatcactatttgaagtgaataagcaaagcacagaaagacaaacatcacatgttctcacttatttgtgggatctaaaaatcaaaacaattgaactcatagacatacagagtagaagaatgattaccagagggtaggaagggcacttgttgggttggggaggaaattgcaatgggtaatgagtacaaaagaaaaaaaatagtatgattaagatctagtatttgattgcataatcgggcgactgtagtaaataataattgaccatttaaaaataactaaaagggtataattggattctttgcaacacaaaggataaatgcttgagaggatgtatacatccatttttatgatttgctcattacacattgcatgcttgtatcaaaagttttcatgtaccccataaatacatacacctactatgtactactcacaaaaattaaaaattaaaaataccattttaaataaagaagatagctttttggggggcggggacagggtctcactctccatctctcactcagactgcaatggtgagaacatgattcattgggaaataaacacaacttcctgggctcaaggtgtcctcccacctcagcctgctgagtagctgggaccacaggcacacaacaccatgcctggctaatttttttttttttttttttttaatttgagacaagatctcactatgttgcccaggctggtcttgaactcctgggctcaggcaaacctcctgccttggcctcccaaagtgctggcattacaggcatgagccactgcacccagcagcagtcttactttctttaaaccagaaactagggatattaaagagatctcaggaaaaagtggcaggaacagaatctgtctgtagtgtacaaaatggctgttaaacagatttttgaattaaacttaaaacctcttgcaatttttaaaagcgtgtatcaatactttaagaaaactttgttgtttacacagactctggtcctgtatcatgtcatccctgacagcaacatttaatttttagaatatcgtataaacaatttcttttcaatctcagtggacccagtcacacatgaaacttttttcatgagaccagtgctttagaaatcctcttctacttgtttagttctttcaccacttttcaacccccaccccccaagtcttatttctgtaatttttctttttaaaaaaattatggaacaacaattttaaattaggtaaaattttaccacatacaattttttacacaaaattatttccttctaaattcatattttgattaatagacacaaatgtatttagtctttccataaaatttaaaaagccaagaatgaacttatgtgtacttaacaatttgtttctgtttttttcttatttggatatggctcagacatttaatgagtattatttaatttaacataactttaagattttaaattacatgaaaatttatttgtaaatgcttactctgtttgcaattacctaatttatttattttttaacaattataccttgattacctatgaaaattgagatactagacatagctagttattaggtttttattaacgaattttattgcctgttaatatcaggaatttccctaagtaagaactttaaggttaaatacataggtcaataagtcctattgtataaatcctgtcaataagtcaggagacacggctgattttattaaagcaacaatattaaattaatcttatcaaagggttaaagattatgttgttttaggctttatcaccttattacattaaaagatctagcagaggcatatataaaactgtgtgaccagtaaactcaagtgagaatgtatgttgacacttttgaagatatttctaattttattttttcaaccatttttaaaccaatttatcaagatttacttgtgaactaaaaaaaaaaaaaaagttggggtgccaggtgcctataatcctagctacttgggaggctgtggcagaaagaatttcaagggcccagaatttcaaggttgcagtgagctatgattatgccactgtactccattctaggtgaaagagcaagactgtttctataattttattgaatgggataattagtatactattgattttatatgtgcacccaatatatctaaataaaatattttgagggatgtcaagctaattataccagattttattatgtacatgtaacatataacacagtacatgtacatatgtgtaaacacatctaaatgtatatatacacatataaaaatactttcatatatatgctcatataaaaatactttcaactttcattttagaattttggtcatgagatagtaaaacatagagactcactgattttttttaaaaaatacatttatcaggcgcatatgctattttgttacatacataggttgcatggtggtcaagtcagggcttttagggtatttgtcacctaaataatgtatgctgtagccattaaataatttctcatcattctccctactcccactccctcacctttcaagtctacattatctatctatgtccattatctgtctatgtccatgtgaacacattttgtagcacccacttaggagtgataacaggtaatatttgtctttctgtgcctggctcgtttcacttaagataatgatttccaggatgagtgtggtggcttgtgcctgtaatcccaggaatttagaaggccaacgcagccagattgcttgatgccaaaatttcaagaccaggctgcgcataatttcaagaccttctctttacaaataaaaataaaaataaatagctggagctgtggcatgaacctgtagtcctggctagttggaaggctgaggaggagggattacttcagcccaggatttcaaggctgcagtgtgctataattgtgccaagacactccagcctgggtgacatagcaagaccttttgtctagaagatagcaaagataatgaccttcagtttcatctgtatggctgcaaaatacttgattgtattcttttttatggttgaataggattccattatgtatatacaccacattttcttactcatttatctattgatagacacttaggttgattcccctttgctatgaatagtggtgtgataaacatgcaagagcaagtatgtttttgatatattgatttttttcctttcagtagatacctagcagtggtattgctggattgaatgatagttcttttagttctttgaaaaaccatactgttttccgtaaaggctgtactaatatccattccgagcaacagtatatgagttctcttttctccatatcctcaccaacatctgctcttttttgtctttttaataatggccattctagctggggtaaaatgaaatatcattgtggttttgatttgcatttccctgatgattaatgatgagcattttttcatatacctgttggccatttgtatgtctcttttgaaaaatgtctgttcatgtcttttgtcccacatgggattatttgattttattgtttgagttccttgtatattctggatattagtcctctgttggattgatagtttgaaaatattttctcccatataacaggttgtctcttctctatgttgattgtttcctttgctgcgaagaagctttttagtttaattaagtcccatttgtctattttttcttctgttgcctgtgcttttgagttcttaatcattaatttggtgcctagatcaatgtccagaagagtttactctaggtttccttctaacatttttaaagtattgggtcttacatgtaagttttaatccatcttgagatggtttttgtatgtggtgagagataaggattcagtttcatttttctgcaatagatattcaatttttaagccatttattaaagcgggtcttctttcccccactgtatgtgttgttggttttgtcaaaaatcagttggctgtaaatatgtggctttatttctggattcactattcttttatattaatctgtatactatttttatatcactatcatgttattttgcttactagagcgttgtaatattatttgaaggcaaataaagtgatgcttccagctgtgatctttttgcttaagattgctttggttacttgggctttgttttggttccatatgaatcttatggttgttttttctaattctgtgaaaagcgacactggtattttgatgggaattgcattgaatctgtagattaggcagttatggtcattctattagtctgttctcacactgctataaagaactacctgagactgtaatttacaaagaaaagaggtttaaaaactcacagttccactttgcaggaagcatgaatgggaggcctcagtaacaatcatgccagaaggtgaaggggaagcaagcacgtctttaccgtggtggaacaagagcaagcaagggggaaatgccacacacttttaaaccatcagatctcctgagaactcacagtcacaagaacagcatgggggaaatccacccccctgatccaattacctcccacaaggtccctcccccaacattgggaattacaattcaacatgagatttggttggggacatggaaccaaaccatatgagtcactttatttatattaattatttcaatttatgaacatgtgatattcttccatttgtttgtgtcatctacaatttattccagcagtgttttgtaattttccttgtagaaatctttcacctccttgtagaaatctttcacctccttggttaaatttattgctagggttttttttgtagctattgtaaatgggattgccttcttgatttctttctttgcaaggtcattattggtatatagaaacactactgatatttgtacaataatatttttgtattcttcaactttattgaattcgttcatcaaatcagagttctttggcggagtctaggtttttctagatatatgattctatcatcagcaaacagggataattaaacttcctctttttaaatttggattccttttatttatttttctttcctgattgctctggctaggacataccctaatacattaaatgagagtggaaaaatttggcatccttgtgttgtttctgttttagagaaaatcctttccaagattcccccaattactatgatgttaagggaggagaccacccctcatattgtcttatgcccaatttctgcctccaaagaaagaagtagtaaaaagtaaaaggcagaaatgaaatccacaagcggacagcctggcgccacaccctaggcctggtagttaaagcttgacccctgacctaatcggttatttgcataagaaaagcactgtaaagatccctgtcctgttctgttccattctaattaccagtgcatccagcccccagccacataccccctgcttgctcaattgatcacgaccctctcacagggacccccttagagttgtgagcccttaaaaaggacaggaattgctcactagaggagctcagttgttggagatgtgagtcttcccgaagctcctggccgaataaagcccttccttctttaactcagtgtctgaggggttttgtctgtggcttgtcctgctacatttcttggttccctgaccaggaagtgaggtgattaacagacggtcgaggcagccccttaggcagtttaggcctaccccatggagcatctctgtgggggactccggccagcttgagcaacgcagatcctgagagtgctcctgggtaggcaattgtcccagtggaacgcctcaccagagcagtgcgtggcaggcccctgtggaggatcaacgcagtggctgaacgccgggaaggaactggcacttggagtccagacatctgaaacttggtaagactagtctttggaaattgcctactccatttgagtggaagcgtggcctgatcacccatggcatgcctgtactggcagtttggttttttgtttttgacttgacttggattgcttgatactttggttttggttttgacctggcttggatttcttgatactctgattttggttttgattctggtttggtgtaaactgtaaaagtgtgtgtgtgccctttttacccgttctttttgtggtgtgcgtgcggtgtgagcgtggtgttttgtcttgaggaagcatgggtcaggcacaaagtaagcccaccccactaggaactatgttgaaaaatttcaagaaaggatttaagggagattacggtgttactatgacaccaggaaaacttaggactttgtgtgaaatagactggccagcattagaggtgggttggccatcagaaggaagcatggactggtcccttgtttcaaaggtatggcacaaggtaacctgtaagccagggtgcccagaccagttcccgtacatagacacttggttacagctggttttagaccccctccctacccccacggtggttgagagaacagcagcataagcagctggcagaggcaaggaaagaccagcaaagagacagagaagaaagagacaggaaaagaggcaaagagagagaagaagagagagaggaagagacagagagacaaagagggagtcaaggagaaagagagagagaggaagagacagaggcaaaaggaaagtcaaaaagagagacaatgtcaaagacagagaaatatacaagtagttaaaaaaaagtgtgccctattcctttaaaagccagggtaaatttaaaacctataattgataattgaaggtattctctgtaaccctataacactccaataccactttgttgtcagtgtaaacaagggcatatcccgaaagcacagaggccactgataacccgtagccttcctatcaaaaatctttaacccagtaacccacgaatggcccagatgcattcagtctgtagcggcaatggctttgctaacagaagaaagtaaaaaaataacttttagaggaaacctcagtgtgagcatacctcaccagttcagaagtatcctaaggaaaaaaaaaaaaaaaaaaaaggatgttttaacattaaccacgaaaaaaatcccttaacccagaagttttcctaacagggcatctaagtcttaattaccatacaaaggtccgaccagaccagaattccctacaggacaggaccatcaatggttcctcccgggtaattgaaggaaaaaaaaaaaaaaagccatctataccaattctaagttaatttggacaaaacaaggtcttattaatagcaaaggataattaaaatcccaaacttgcaaggttttcaacaaaagtaaagtttgctaaaagctaacattgtaacatgtattatagtaaattataatcttgtggccttagacagtctagtccacagtcataaagcaagttcgctttggaaaagaatggttatctctgaaaaaaaaaaaaagaagaaaaggaggggcagaatttatgtaaaaaaagtgttatatggtaaattcttgtcctgaaataaattaactggttgtttaaagaaagaaatgtttgtaataagtcagaaagttcaggcattgctaagaattgtctgcaaaagttgtgaaagagaaatatgttataaaaaaaaagaatttatgcaagaaaagttgtataatttaaaagtaactaggcctcctgaatgtaaaactattgaaataaacagtttatgtgcaaggtgtataaggaaagtaaaatataactttggtaaaaggattataaggaggcaaaagaatgtaagttgttacatacattaaaaggttaaaaaaactattttgaaggtttaagcaagttttaaaatgttaattgtaaaggaaattctgtgtgtaaacatattagccaaaggtaaaggggtaacatccagtttttctgtgaattggacattaaagtaaaaacacaatgggtttttcttaaagcactaacctgctctttaacaaagattataaaaagtgagtctataaaaatcttacctgatggtccaacatgaaaaattcaataaatatgtatacaaagttttattaaaactaagtttaacattaataacacactaatataaaggtgaaatttagcttatctggtataaaaatcatacaggaagcattgtcaaatataaaatggtatttggcttctttggtctaaaaactaataaaaataggtgctaaaggaaatttctcagtggaaaggcaccaagaactataaagtccactgctgatgtccccacatttaaaacaaaaggtcaacttcttagaaattatatacttggtttatcttccactttcctttccctcaaaactaaaagtcttttagcacatgtaccacccctagaatttccggtaaaccagcaccagcctatccgctcggggatgaacaagggctgactgattgataagctcttgaaaattcttaagctcactgcatcccttcaggtctccaaggaacgctaagtttcttccctgttgtgagagacacgaagtgaacttagtgttgggagacggaagctggatggccctcgggggctgacccgcagggtaccggactttgggatatagcagagagagcttggcatgacttactactccaggctgtagaatcctggataagagctaccatgcagcccacgtgtggtcgactggaggatcagctgcttagtggaaagaggacaatctgggcctctggcctgccatgtgcacaagcataacaattgcttttgtttaacgtgcagatggaatatttgatccattccaaccaggcatttgcatcttggtatcctgtcttaattgccaaagtttgttttaagtctttaacttctatcatcctctagtaaaatgaatgtatgattttaggaaattacaaaaaccggttggggcagcccatccttgctctttagtggtccacagaatgttggaccaactacggcataaaagctctacataggggagcaagactcctggttgacactggagtcttaatcaaaatttccccagattaaatggtcctaatttactaatgcccagtctgaggagagtcaggagggacagaggtacttttctgaagtagagagctgtctttgactgggcaagtccccacagggtataacaaggcaagcattaaatgcaatagtttgaggcaaaattgacttggttatgttaataaccagatggtcagcaaaagagcgaggtaagaagaaagagtaatagaatagattaagacttaaatttttgttagctttagtttggtaaggttttcccctgggactatggcccatgactctggagggggtggcactttcttgacttggttgtgattagtccatccttttttcactgtatgaacagcagtctcggtgtttagcagcacaaggtagggtccttcctaggctggatcgagtttcctttcttttcaccctttgatgagaacgtgatcttcaggatgtgtggtggtattgtgattgtgtgtggacctttactgggcactctgccgaataactggagtggcacttgtactttagttcaattggctatccctttcaccctggcatttcatcaaccagagggaagaaaaataagacattgtaaagcgagagaaggcccttatgggttttttgactctcacgtctatttagacacaattggagtcccacggggaataccagatcaatttaaagcttgaaatcaaatagctgcaggatttgagtcaatattttggtgggtggcagttaataaaaatgtaaattggataaactacatctattacaaccaacagcaatgagcttttcatgagttaaaagaaaaactcctgttggccccagccctgaggctacccgacctgacaaaagcctttacactctatgtgtcagaaaaagaaaacacggcagttggagttttaacccagactgtggggccctggccaaggccagtggcctatctctcaaaacaactagacggggtttccaaaggctggcccccatggctaagggccctggcagcaatggccctgttagcacaagaagcagataaactaacccttgggcaaaacctgaatataaagacccccccatgctgtggtaactttgatgaataccaaaggacatcattggctaacaaatgctagattaaccaagtaccaaagcttgctatgtgaaaatccccacataaccattgaagtttgcgacaccctaaaccctgccaccttgctcccggtatcagagagcccagttgaatatcactgtgttgtattgcactcagtttattctagtgggcccaacctctgagaccatccttgaacatcagtagactgtgagttgtacatgggcgagagcagcttcgccaacccctgcaaagtgactctgaagaagatgacaatacctgcttcagtcacacccggaagctgactggtccacgcatggccaaagcatgagaaaactcattgcgggactcattttccttaaaatttggacttataccatagggacttcaactgaccttcctcagactgaagactattcccagtatatacgtcaagtcactgaggtaggaaaaaagttgctacagtcctattattttatggttattataagtataccaggactctaaaaagaacttgtttgtataatgctattctatacaaggtatgtagcccaggaaatgaccaacctgatgtgtgttatgacccatctgagcctcccatgaccacagtttttaagattaaggactgaaacctggtgggggctcataaacgatatgagtaaagtgttagccaaaacaaaagaaaaaggggtgcccaaacaagtcaccttgaagtttgatgcctgtgttgtcattaatagtaataagttaggaataggatgtggttctcttaattaggaaaaaggctatatggcaaaaaaaaaaaaaaagtacatttgtcataaattaggactgtatggaaatgaacgtgcatactggtcttgtgtcatttcggctacttggataaaaaatgaaaaggatcccgtccaccttcagaaagggaaaagtggcccttcctgtacaagtggtcagtgtaaccccttagaactagtaataaccaacccccttgatcctcactggaaaaaaggggagcgtgtaaccctaggaattgagggggctggactggatcctcgagtaaatatcatggcttgaggagaagtttataaacgctctcctgagccagtatctcaacccttctacgattaactgaatgtgtcagtaccagaaattccaggaaaaacaagaaatttgtttttacaattagctgagcatgtagcctagtctctcagtttcacttcatgttatgtatgtggaggaactataatgggagatcaatggccatgggaagcctgagaattagtacctacagacccagttcctgatgaatccccagttcaaaagaatcaccctgataacttctgggtcctaaaagcctcaattattagacaatactgtatagcaagagtggggaaggacttcaaccttcctgtgggaagactcaactgccttgagcaaaaactgtataatattactacaaaaacagccacctagtggagttcaaaccacactaagaaaaatccatttagtaaattcccaaagttgcaaaccatgtgaacccacccagagtcccactgggactgggcagcccccactggattatactggatatgtgggcatagagcttacaccaaattaccctaccagtgggcagatagttgtgttattggcactattaaaccatctttcttcctactgcccataaagacaggcaaactcctgggcttccctgtctatgcttcccacaaaaagagaagcatagctataggaaattggaaagataatgaatggccccctgagagaatcatataatattatgggcccgctacttgggcacaagatggctcgcggtgatatgggacccccatttacatgctgaactgaatcatacggttacaagctgtcttagaaataatcactaataagatcggcagagccttgactattctgacccagcaagaaactcagatgagaaatgctgtctatcaaaatagattggctctcgactacttgctagcagctgaaggaggggtctgtgggaaatttaaccttactaattgctgtctacacatagatgatcaggggcaagtagttgaaggcatagggatatgacaaaactggcacatgtgcccgtgcaagtgtatcatggatttgatcctggagccatgtttggaaaatggttcccagtgctaggagagtttaaaactcttataataagagtcataatagtaataggaacctgcttactgctcccttgtttgctacctgtacttcttcaaatgataaaatgcttcatcactaccttagttcaccaaaatgctttagcacaagtgtactatatgaattactatcaatcagtcttgcaagaagacatgggtagtgagaatgaaagtgagaactcccactattgagtgagattctcaaaggggcagaataagggaggagaccacccctcatattgtcttatgcccaatttctgcctccaaagaagtaaaaactaaaaggcagaaatgaaatccacaagcagacagcccggtgccacaccctgggcctggtagttaaagatcgacccctgacctaattggttatttgcataagaaaagcactgtaaagatccctgtcctgttctgttcccttctaattactggtgcatgcagcccccagtcatgtaacccctgcttgctcaatcatgaccctctcacgcggacccccttagagttgtgagcccttaaaagggacaggaattggtcactcagggagctcttggagtgagcaattcctgtcccttttaaggacaggaattgtgttggagatgtgagtcttgccaaagctcccggccgaataaagcccttccttaactcgatgtctgaggggttttgtctgtggcttgtcctgctacaatgttagctgtgagtttgtagtatatggcctttattattttgaggcatgttccttctgtgcttagttctttgagagtttttattatgaagggatgctgaattttatgaaatgttttttctgggtctattgagatcgtcatgtgggttttgttcttgattctcttaatgcaaagtatcgtatttgttgatttgcatatgttgagttgtccttgcatctctggtataaaacctacttgattatggtgtattatctttttctgtgccctgttttgatttaatagtatttatatgtatttttttattatactttaagttctagggtacatgtgcacaacgtgcaggtttgttacatatgtatacatgtgctatgttggtgtgctgcacccattaactcatcatttacattaggtgtatctcctaatgctatccctcccccgtccccccaccccgtgacaggccctggtgtgtgatgttccctgccctgtgtccaagtgttctcattgttcaattcccacctatgagtgagaacatgcagtgtttgattttctgtccttgcaatagtttgctcagactgatggtttccagcttcatccatgtccctacaaaggacatgaactcatc

SEQ ID NO: 2158 - DNA, 479 bp, Homo sapiens
tgaaatgaatctgaaaattccatttattaaaacacatacattgtccatgtgggatgaaaatgtgcacatcacattcaggatttacttttacttgcagaatcaaagctatcatgtacacatgttaggaatagtgaaaagagaacacagacaaccggcattttttgtcgttgttaccatgaggatacaccacggggaacatctccctaaacattttgtgtgatcattcttggagttcaatctgatagaccagtccagccttatctccacactactctaatggggaggggtggaaggaggggtagaggagaaggaagaaagaaaaagaaaggcacagtgactatacatcaatgccattaaaccgaattgcatctacacgggacagctcagcttatcaaagggtattctaaagacaatattcattccaagaaggtcacacatatcttacctcagtacagctgtctgttttaattgttattttt

SEQ ID NO: 2159 - DNA, 6642 bp, Homo sapiens
agagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctggtgaaatataggtgcctttgttaagtaggggaggtgggatcatgaacatctggcagctgctgc

SEQ ID NO: 2160 - DNA, 544 bp, Homo sapiens
agcagccgggctgtgggaagatgggtgagagtcagctctctgagtgcttggcggcaggcggtcagctcagctggtgggaacagcaggacggtgtggacgtcagcctggcacggggcaggggtgcccctcagcagaatggcatgggggctgtggcaagctcccctccatctctggtccctggagtcagactagaccttcgccgcatccggctcgaaggctcggatggatgatggattgcccggcccatcttccccggggggttggatctgagaccatcagcatccagcagccgtgagtgtgatggatgaaccgaggccagtcacctagtggggaaacgacatctcacatttaaagaacaccaggcgtttctacacagcgggggaaggaaatccgtcctgattttaaactttggcacagctgtgaaaccgagggtagtgaactctgaggagaggactcttttctggacatacatttaacgtccgtgaaagcctcagaccccctgagcacacctgcctagccgtgttgtggacgaacaagggctgac

SEQ ID NO: 2161 - DNA, 369 bp, Homo sapiens
ctcataccagctcaattttaattttaaagtgacaaatgtacaggtggaataaaattttaagcgacaccctccaaattccttttatatgacaagaaggagctgaatgtaattttacaccattaccaactaaacagtagttctttagcaataattaggaagtcacagcacaaaaacgacaccccagagttgtggtccatttataaatagattttcacctaggcttcgttggaagaagtgattttatatctatcctcaccaatggtcaaagtgggcacagaacagtaggaactaagttggccctgttaagcaggcacatgcagccatgtccgatccacggatgtgcttttattctttaagaggatcatctag

SEQ ID NO: 2162 - DNA, 3313 bp, Homo sapiens
gggggggttggggcttgggatgcagccggacctccgggaacagcagggggccctggagccaccaggagggagaaggccccgtccctgagccaggctcgcaggatgtttatcccaggaaatccagaggatcagaaccaggcaggacccggcactgggacggaggcagctgtctgcggggcgtttaccgtagatacgtatcacctgttctgagacagagcctgggaggctgtttttaatcatccgggaggttgtaaaatgtttcccgacgttacgaggacagctgctggaataatgatgcaggtagctggcacacacgcagtgcaaaggtttcaccagacatggtcttctatgcctatcacctggtcaatacgagcagcagccacgttaaggtgtaatacacactggcgtcatctaacgttccatgtgaggaaactgaggcacacaaagggcaactggcttgctcaaggtcgcgtgaatggcaaagcgtggatctgggattcaagcccagacaattgggctccagaattgactttattagtcatgatcactccagagaaaacatcaagcacttttcattacatgtttaatgaaaatgatgttaaagtggttttgtaggagaaaacatttcattcatgtaaatacattttactgcattctaaaatctagcaggaaaagatgtggcctaactaccgtcaagatctgggtacatttcattggaaatacaagcacattggacatgggaaaatactggggaactttacatggaagagaatgcatctgatagtctggcgcactagcatttgctggatttttaggacatatgggaggccgggtgcggtgacctcccccagcaatcccagcaattggggaggctgaggccggtggattgctcgagcccaggagtccaagactagcccgggcaatatggtaaaacctcatctctatgaaaaaaaatacaaaaaattagccgggtgtggtggtgcacagctgtagtctcagctacgtgggaggttgaggtgggagaatcacctgagcctggggaagtcaaggctgcagtgagccgagattgcaccactgcactccagcctgggtaacagagtgagaccctgtctcaacaaacaaaacacaaaaatatatatatgctgaatgctcagtgagctgtaacatgtgaggcagcccccaggggtgccgagatgaaccgctaagaaggcgtatgttcccacggggtgcagagatgaacccctgtctgagaaggcgcatgtacccatggggtgcagcgatgaacccctgtcttgagaagccgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaagacgcatgtacccacgggggtgcagagatgaacctctgggaaggcgcatgtacccacagggtgcagagatgaacccctgtctgagaaggtgcatgtacccacggggtgcagagatgaacccgtctgagaaggcacatgtacccacggggtgcagagatgaacccctgagaaggcgcatgtacccacggggtgcagagatgaacccaactgagaaggagcatgtacccacggggtgcagagatgaacctgtctgagaaggcgcacacacccacagctgcccctcatcttagcaccacagtgccagccccaccctgtctttgataagccctggccttccagggcctccctcagagaaccagcccctgcggagtccctgaacgtagctgcggtctggggtgccgaccctcggcactgggagaaaccctcaccagtagcatcaccccccagtgagccaagatcgcaccacggcagcatcactggggagggagtcacgtggttgtcactgcagaactctggagaggcaggctcttgcgtgggtgggggccatggaggacgcagcgtgggatttaaaatgagcccagtgaagggaaatgctggttcttcaatgtccatgagctcaagccctgtgggaggtgtagcctcgattattttgcacagatctgaacagcattcacccccagttggatatggccctttcctcgaagcacagattggaactcaaggtcactgaagtgctttctggccgcatcatggagagaaaggcattttctcactcaggcatcaccccgggaacgtggcgtgccatgttttagcatctaagtgtgtcccccgaggaggcagggttatgccgtaatcacaagcaaaccccaaacctcaacggcataaacgacacagggtaatttatcatgggattgcgtgtccacctgggtccccgcggagctctgttgactggagtcgctcggagcccccggcgcgaatgctggatggctgggcggggaggagcgctcaggggcttcacgctgtcaacaccccactccgaagtgactcccgctgcttccagcagtcacctgctggacagagaccgtcacacgggccccttcacgcagtggggtgggaagggagatcctaccgcgtacctggaagacgggagaacaggggtgtttcggtgagtagtgctctctctcagtccgcacggcagccttccagcaaatcgggattttatgccaaactcgccccacgcccccaaatgccaggttccccggggtagcaacgaatgacacgttgtccaatcagacttcagtgtaaccatgtcacagaagacatgactaaagcaaaacaggactgggtggggcgcattttggttttgacgaggttgggtctgggtctctgcttccctctcctgggccaagatcctctgggcgtggagttcaggaatgagggtgggaccttccccaggagacccaagtatgggcagcggttgctgggaccaagtcctcactgagagtgacttcgacaaacatccattggcagctccagcttaggcccaggagacaaagtgggggtcactgacaccccggattttttttttaatgactgagtcatgatttgaacactggtctgttggatttcaagatctgtgattttctcactgaacacgctaactcctgggacagcagagagttccttagattggacctaataacacactgatcccctcccctcctgcttttctgtattttttaaaaattattttgtttttaattcacaaatattgtatatgttatatggggtagaatgtgatgttgatatatgtttaaaatgtggaatgattaaatcaggc

SEQ ID NO: 2163 - DNA, 3684 bp, Homo sapiens
agaactggggttcgtgggcagagtggtgagcgacggagaactggggttcgtgggcagagtggtgagcgacggagaactggggttcgtgggcagagtggtgagtgacggagaactggggttcgtgagcagagtggtgagcgacgcagagctggggttcatgggcagagtggtgagcgacggagaactggggttcgtgggcagagtggtgagcgacgcagagctggggttcgtgggcagagtggtgagcgacggagaactggggttcgtgggcagagtggtgagcgacgcagagctggggttcatgggcagagtggtgagcgacggagaactggggttcgtgggcagagtggtgagcgacggagaactggggttcgtgggcagagtggttggctgccccactgtcagcctgttctgaaagtaggaatgaccctcagctgagctgagatgttgctggtggagactctaagactgtggattctgactccctgggctcaggaaggacggtgctgggaacaaggtgcagacaaggcacgacgaagctggagtgcctcataccacccccatgaaagcgacgaaggactcccagaaccattcctgggggcccgtgggaacgaggactttgggggcacaaggacgagctgaagaagtcttcctgattgtggttgtcagagggaggacatggcatcgtggtgggccagagtatcggcctcaacaccacccacttttcaggctgcagtctccaccgtggccgctgtgtgcattggagggcacttggcagcatccccagcctccccactagaaaaccagatgccaggagcatatgcgcccctcctcaaggtgcaaccaccagaaacgacgccagacattgccaaatgtcccttgagggtggggacaaatgcccctcatcccccttgaggactgcagctggaactcaatgaagagcagcgaaaggggccacaagccaaggcctctgccgcagcatctaacagctggaaaaggcaaagatacgggatctcctggagcctcgaacaggagccagctctgcagacaccttgattgcagcccagcaaggcccatgtcaggcctctggcctccataacttgataataaagttgtgttttagttctttgttacaggagcaatatggagagggactaatgaactgccattgtattaaaccactggcaatcagagttgtttgataaagcagtcaagtcaacctaagtaaaacacttaaggaccaagaaataaagtcctcacttgaggatagtgagatctgagagcagtaaagccacttccttctcgtgagaccgacccctcttgcagacctgcctctggcctggccccatggagtggcaggccccggtcctccgctcttcgggtcacaggtggcccagcaggctctgcgcacagcatttcggcagcacagcaatgcctaacttaatactcactccgggaacaagccagctgcaagctgtcaacgctaagtccccctaatgctttaattggtacttactctagtaagttcatttaaaagtccccacctctgccagatgcacagtgaagctgacccgacaagagggcctgacggtggcagagcaatgtgataattaatgcgtcctgctttcctctgcttgaattaatgttttcatgtcacttagacatcactcctggaaacctttctggttttcagtaatcagcagttctccatcccagaacccagtagatgatcaataagtggttgccgagtgaacgaatggctgagtcagagatctcgaagggtcagatttcacttggttcaaaccccaaccagtctctgagaaactgagccagggaggcctcaggaggcctcgagacgccagggtacgagctaactgtggctgggaaggttgtgtaaagaggaatacaaagcagcctgggcatcccaaatgctgccacagacgtgtcagagtggctaggagccatggcctgcacccaggcaggggccactccccagctgtgggagcagaaggggcccagcacagccggccgcggagcccgcaggagccccggtactcgggaggagccggacgccgactccagcagcgcagacgccgccggggaggcccgttgaggagcgcgcagctgagtcccggtagaggaggcgccggcctggagaggctgggggcggatccgctggaccaggcggggtagcgaagggtggagttgcacagagcggcctcgagtccggactggggaaggctcagacagggggtggaacaaaggccagaaaggaggcgggggtcagaccggggctggatcatgaaggcggcagagagctcggagggagcccaacaaggccgtgctgcggcccggttttccttccggtgctgaggatggcggcggcctggttttccttccggtgctgaggatggcggcggcctggttttccttccggtgctgaggatggcggcagccgcgggacggtgctgaggatggcggcggccatggaaggtgctccctgcttctgcgcggatccaggccttcgggatctcgccctctgcagtgcggagaactcactggacggagacgagagaggcggcggcggctgcacagctggtgcgtggggactggggggcgggtgagcgctgtccttggctggggaggaagcgcagcccccggaagcccgcctggggctgcagggagaaaggagggcgccccagagccaaggctgcccgctggtccctgcgaccggggcccggagaaagtgcgggaaggagagagaaggctggtggccgcctgcctccagggcgggcctccgagcagtgccctgtcccagccacagccttgcttcttttgatcctcatcacgaccgctctccgggccaggccgtgggtgaggcccccaggccttcaggggagaagccggggtctccagagagaggtaacagagtgagaacggccgtgggtagcgcgcccctcggccccgcagctctccacaggcctctggcgagctcagctgacctgccccatcagtgaggtctctgctcagctaccacctgctctgagaagccttctctgccagggtgactcattaccctgatttgccaggactgagtgggttcctggagcggcctgggagccggcggcggtggtggctttcctgagccctgtttgtctaatgtaggcccggttcgcactgttcattcactctgctcctcagttactttacggcaattaacaccaatctgttctcaaaacgtgaggtcctcttgctcagggctgtgttcctagcacgcggcccttgcctgacacacggctgacattcagcgcacatttaaacgagtagatcaactgctccatcttcccccagaagctctgtctgtccctccacaacttggctcatgccatctcttccataagcgccgtgtgctcttctctctcagaaaaaaactatttgtttcttgacagctcagctcaaatatcagcttctctcgaccccaggcacgagcgtgggtcccgaaaccctggtgccctccacagtgtgtgttcagtaaatgactctacgtttatccctgtagctgccagtgttatcaactttggcctatgttttctgaattatttttgaatctttattttgtaatccaatctattagtgacccataacaggccgtgtcatccacaattaaataaatgtgcactctct

SEQ ID NO: 2164 - DNA, 1116 bp, Homo sapiens
aggttttcacgtgttttgagagaaatcttactgaaagactagtgatgtccattttccagtaaatactgagcgaaaaacaatttttataccccaatctgaggtataaacttgctttttgtgggatcacaactgctgtaaattagacagttgtagcaacaatccaagacaataacagaatgcctatgacagtctgccatattctggtgagtgtctatcaaagctcatcatgattttttgtgagatcttccccgtaattggtagcttggcttccaacaaacatgttccagttctccaatatttcctctttagttagcttctcatccttgtttttgtctgactcatataccagatgcctggcctcagcctgtgcatgatcataatcttgagggaggatccagtggcgaatctcatctttgtctaacttcccgtccttgttcagatcccggaattcgttaaactgctcccgttctgataaaacccagtctggctcagggccattctcctcatgggaaaacatatccgcaatatactcatcctgatccacaaacccatccccgttcttgtcgatgtcctccagggtttccaaagccacaatttccttcatatgttcaaactcttcaggatgcagaaaggcagtgaactcctccggagtagctgtcaggtcaccattgaggtctgcagctttgaatcttctctcatcacgtggcagcatctttttaaaggttttcagctcctcagtagtgacaaagccatacccatcattgtcgattcgatcaacaatcttccctagcctctccttgctctcgtccggggtgagctcgtcgaagttcttggagtcctccttgcccaggaaggcctcgtggtcgtactggaagctctggttgtcctcagggggccgctcgcccagctccgagtcgggccgcaccacgcgctctttgcgcaccgtgggcttggcccgcagaacccgcggcgccagcaccagcgccagcagcagccccagggctaaccccaggcggccaccgcgcgccatcgtcccgaggagagggcggccgggagggagacgctgagcgagcgacaacagcggcagctcgggaatgggggctcggagcgcggcgg

SEQ ID NO: 2165 - DNA, 3255 bp, Homo sapiens
atattttcagcatcacattttaagaataatatgtgaaatacaatatgttttattagtcacctttggaaaatacagtcttccacaatctggaaccacctctttggttcaaaatgtgccattcttctgtaatgtgtgtgataaacttaaaaaaaatctgtatcctttatcctaatcatcttacttgaacatcatcctgaaacaaatgacaaaaacattcacagttttatatacaaagttattggtaacaatgttcttaatagaattcaattagaaaacatataaaggcaaaggtagagttatttgatgttatggtttgaaaggattcccacactctcatgaatattctttattatgccagagggaccctaattcccctgcctttgagtgtgggatggcattgatgagttacttgtaccacatataataagcaggaagtgatggcacgtgacattggaaacaacttcgtaaaagtcaccgagactcactccttgctttctcctatgtctcccacctggcaggaagccatttgccatcatgtaaggcgagttcttcttagtgaggcattgacatctccagccagcagtgccgtgagggaggtgggcagctcaagcctcagtcaaaccctgagatgaccatggtcccactcaacatctcagctgtgaccatgtgggagaatccaagcctgagccaatcagcctagctgctcccagagtcctgactctcagaaaccatgccagattatacatatctgcagctttaagcttctgagattttggaatgactgatgacagagcaataaataactaatacatttcaccacatatcacttagcagaatgccatggagctattaaacacaatattttatgaagattagtctatgatatggagatatactcacaatgttattagcaacacaactagaccaactgagtataggtagtataatctcaatttgttctaaaaatataaatctgtacaaagatagaaagaccagaagaaaaaaaccatttaatacttgatagataattacaatggtaaagaatttagccttgatcacttgatttgagatggaatctaacttgctagctgtatacccatagttgtggatgtgtaaccaatgatttgtaaactaattctcagtttactcgtctatataaaagagctagtaatattacctatttcatgcggcttgggagaaatgaatcaataatatatagaagggcttagttctcatattgtggcaagtacttcacaaatgataatttttactattacaatttttataaggctttctgtaattcacaaattttctaatatctattttatgacttttgaaataattcttacaatatcccttttagtaacctttattacaaaatctattgtaatctcttaaaataatattcctttttgtttttctccgagatagtctatctaatgatgttacaatagagttaccaacaaatgccatatttcattcctgagcgtctatattcttgagttcctagcaacagagaacaaagtagcaaccatttcttaagaaaatgctgagatggacaccagagtttcaagcaattttcatccagaaggtcacatgttaggagtaaaagctatatggaatcttgaacaagcatagcatctaatagccttatttgattaaaaaaatgaatacacacaaaaattttttgaagactaactaccccttagaaatgttcgttaacttggtcagtaatataagcctacctcccatttattcaatagatcaggtaactcccctctttgttatgagcctagttttctagaggtggaccagattccatcatatgtacatcactcagctagttgagctctctaaatgaaaacttcagccgtagccactggatagaagaatacaagaaggaatgccgacttgaggagcaagttgtgttgagttcaggcattgctttggagaatctgcttcttcacctgctggcttaaagggttggatgacctgaggcagcagcagaagtttagacaattatggttggatgattcttaactgtcctaatcccaagtcctcaatttataagtgaggaactggaaaatcattcacacagctagctgcaagcaatgacagccttggagagaaatcaacctgtgtacagctcagtcccatctgagttctttggagaacaaactccagcagctacttctagaaaatatagacagcatattcagccaatctcctgagctggtgggacatttttacatgaacaaggcctccctccacatgaattgcaaagattcagtggactttgcatgattattcttctaatcttacattaagctttattttggattttaaaaaaatctgccacgtgtaagggcaccaatgtccaccaatattgttatataaaataacattattaatccttcctgtttatcttttaatcagaactaagagggatggtggatgatgaatgcatgagtcatacttacttcatgattctataaatcctaattttcactttttttaaataaaaattgcacgcaaaccaaaaagaagctgcctaaaacagacgtggagatactctacttaggtttcccagggaaagacaattttaaaaaacaattttagcaacaaaaatacatgggcagggaatacacgcatttattatcatttttcctcttaaagcagctatgatgagacacgtccaaaacacctgctcttgtgtactgcccagtttcacgtgagttctgtgggataacactgaatccactcttcagctacagtgaggaagtgatagaactgcttctggcacaccaaagaacagcacagaggtccaaatacatcttccttaggtgcccatgaatttaaatttatttctgctttatcctttaaaaaaaaatctaatgatttcaaatgccttgctgaaatcaacaccctctgcaacagccctctcaggatagttcatcctagtaggtctgtcaaaactgaaacaccaacatgtgagttcctcctctgggttttaaatgttagtactgtgactacttctttgtttgttttcacttttaattgacaaataataactgtatatgttatacagtaaatctgacattttgatataaaatgataactagtgactatttattgctgtgatgttgtccccgcttgtttattggctctgatggaacttttcaggggaatggttataactgaaaaatctgtaatgctaggaatttaacttttctacataaaatgcattttttctta

SEQ ID NO: 2166 - DNA, 5559 bp, Homo sapiens
ggttttgcatgaagcagcagaacatgatgaagcatttttcccccatctaaagatccagtcgtgctccagtttgcagagggcaaggggctggttgcaggtggtgctgggaggatggagagatggggtttcaccgtgttaaccaggaatgtctcgatctcctgacctcgtgatccacccgcctcagcctcccaaagtgttgggattacaggcgtgagctaccacgcccggccctaggctccacaactctaagaagctttgtgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactcggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgtgtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggagtttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaaaaacacacacacaggcatgggctcacctcttctgctggaagctcctctgtcctccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgtgaagtgagttgtgctttcttccatttgaatcaaccccgaatcttttcattttcatgcctttctgtgtagtgggatctttactgctttgttttcaaatttcaaataatttgaatataatcttatcattttccctattccctttggcacatattaaaggaattttctctttttgcataattaaaaataaag

SEQ ID NO: 2167 - DNA, 5559 bp, Homo sapiens; identical to SEQ ID NO: 2166

SEQ ID NO: 2168 - DNA, 5001 bp, Homo sapiens
tatattattcattacacagatgatattctttgtgcagcaccttcacgctctgtattaatatcttgtttttctgcattacagcaagtggtcacagcagctggcttggttatcgccccagaaaaaattcacacttcatctccttatcactatttagagatgcagctagaggataaggtcattaagcctcaaaaagttcaactcagacgagactctttaaaaactctaaatgatttccaaaaattatttggagatattaattggattcgtccctccctacgcattcctacttatgctgtgtctaatctttttgcaatattacggggcaatcctgatttacgcagtaaaaggtctttgactcctgaggcagattctaaattacgacttataaaaaaatgcattcaacagtctcaggttaccagagtaaatccacatttaccttttgaagtactaatttttcccactgaacattcaccaacaggactcattattcagggacataatttaattgaattgtgttttctcccacacagctctttacgtacactaactatctagatcaaatttctaccttaattggtcaggctcgttctcgtctccttcgtctttcaggaacagagcctcaaaaaatcgttgttccccttacccgattacaagttcaacaggctttgctacttgcattgcttggcaagtgcatttggcacgtttcccaggtataattgataatcactatcctcatgtaaaattatttcagttccttaaactcacgtcttggattttacgtaacattactagaaacaccccattacctgaagctgtcactgttttcactgatgcttcctctaatggccgagcagcatatacaggacccagagaacgtgttcttaacacaggggctatttcagcacaacgagctgaactgcctgctgttatggctgtccttgaagattttcctgagccagttaacattttctctgactcagcgtatgtcgtacatgttgctcgcaacattgaaactgccttaatcaaatttctgcctgatgataacctattccttctttttcaaaagtttcagtctgtgctcagagcaaggtcttctcctttctacagtactcacattcgggcccacacacccctccccggacccctctcggcagcaaatgccagagctgatacattagttactcccgtttttacagatgcagaaaattttcatgctttaactcacgtcaatgctgcgggactccgaaacaagttcccccttacatggaagcaagctaaaactactgtgcgtcactgtcctacttgtcaagtgttaattttaccaccactgtcttcaggagttaaccctagaggactttcacagaatgctctttggcaaatggatgtgactcattatcctccttttggcaagctttcttttatacatgtaactattgataccttttctcattttatttgggccacttgtgaaacgggcgaaagtacagctcatggtaaacgacatgtgccttcctgtttctcggttatgggctgttctgagaaactaaaaactgataacggccccgcctacactagtgctgcttttaaaaagtttcctcagacatgggcaattactcacacaacgggcattccctataactctggagaacaggccttggttgaacgagccaataaaacactcaaagatcaacttcgtaaacaggatactaaatcaaagggagatgctattactcctcatgcccaattaaatctggctcttttcacactaaatttcttaaacttaacaagaaatcaacctttcacagccgcagaacaacatttcactggaaataaatttgatccacaaaaaggaatgcgggtatggtggaaggacgtaaaaactaacacatgggaattaggcacggtcataacttggggtaggggttttgtttgtgtttccccaggaaaagaactacagcctgtgtgggtcccctcccgacaattaaaattgcaccataactccaaagatgaaacgctcccagaaagaaaaggcaaagacccatcggaaacaaaagagcaactttcaccgcctgatacatacacttcatgacatccacattgagacaaaatctcgccgtgtgacctacaacacctctcgttcaaccccacctacttggggtcgaatacagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataattatgatgcctgatgcacaaactatagaatgtcataactgtaagctgttcacttgcattgatgcaacttttaatcccactacaagtattctcttggtaagggctagggagggggtatggataccagtttctctacatcgtccatgggagtcttccccctctattcacatagtcaatgaagttcttaaagacatcctcaaaagaacaaagagatttatttttactcttattgcagtccttgcaggactacttgcggttactgcaacagcagcaactgctggagttgccatccgcagttctgttcaaactgctcactatgttgaagcatgccagaaaaattcctccagactttggaattctcaggcgcaaattgatcaaaaattagctaatcagattaatgatctccgccaaagtgtaacctggctgggagatagagttatgaacttgcaacaccgtatgcaattacagtgtgattggaatacttctgattattgcataacgccttatgcttataatcaagatcaacatagctgggaaaatgtctcaagacatttaaaagcctgggatgataacttaaccttggatatttcacaacttaaagagcaaatctttgaggcttcacaagcccatttatccacagttcctggctcacacatttttgaaggcataactaaacaattacctgattttaatcccttcaaatggctcaaacccgtcagaggatcattgttgttactggcattattaatattggtatgcttatgttgtctccttttagtctgcagatgcctctaaggagtccgaaaccaagtccgaagtcaacaacaagcaatgatggcgatggcgattctagttaataaaaaggggggagatgtgggcggcaagccacccaggcaccgaggcaagagacagaggacacgagctgttccagtataataaaatataaaacaagaatagttataccagatatagatcttagatatgattatatacgaatatcattaatcatgagtttgtagcaattactttttattccaatattatgataatcctcgctctataatcatagcctaggaaaaaccaggccatacagagataggagctgaggggacatagtgaagtgtgaccagaagacaagagtgcgagccttctgttatgcccggacagggccaccagagggctccttggtctagcggtgacgccagcgtctgggaagacacccgttaccaggcggatcgtggcccagccgtagcaaaaggtgtcaaggaacaccttttgcaaaaggtgtcaacacccgctacttagcagactgggaaaggggggcggtctccctttccccgggggagtttagagaagactctgttcctccacctcttgtggagggcctgacatcagtcaggcttgcccgtagttatccggaggcctaactgtctccctgtgatgctgtgcttcagtggtcacgctcctagtctgccttcattttccatcctgtacacctggctctgccttctagatagcagtagtaaattagtgaaaatactaatagtccctgatatgcagaaataatggcataagctgtctttctctctgtctcctctccctctctgcctcggctgccaggcagggaagggccccctgtccagtggacacatgacccatgtgaccttacctatcattggaggtgactcacattctttaccctgccccttctgccttgtatccaataacagcgcagtcagacattcagggccactaccggtctccgcacattggtggtagtggtcccccgggcccagctgccttttctctt

SEQ ID NO: 2169 - DNA, 3753 bp, Homo sapiens
acaggaggatttttgcagagcttccatccagttcagaaacaaagcaattcaatacatgtcttcaagatttctaaaggcaatgacttaattctaagttccatgaaagcaggcattgtgtgaatttctcctgcatctggaactggcctagcacaccaatagaaccatggagaattgccaagattgctgactagatgtggccaggagaaatatctcccactgagagactgggacattggaaagactataacacacctctgagtagatcttctgatggaagacattaagagtggatgcagagaggatgcagatgctgggctgaagagagaggaagctggaaaccctgcatagtgtggctgagcctcaggacttgtacctggccctcagagactcctgggggaagggtgagtttacaggtgaggagtggcctgctctcaccatggacccattctggtaggtccctcaacctctatgggcatctgagatggtaggaaaagctgctcagagaggtcatatgggcaggactccagcctatgcagagcccagagtggtgggagaacagctgcagtgaagcacatccagggacggccatcctccaaggctcactgtgcttctccaggatactttagcctcaatatgactgttagagctagacaaagcagggcagtcttgctcgtgggatgcggcctgatgcctgatctgatgctctgttacctgctggcctctcttggggagccagtctggtcgtgcttgcttgaagtgcagccttggatacccaacaggggtgcttctaggaaccctcatcatagctccttcaatggcagacttagctccttcaatggcagactgtgcctgattatcagagaactccagcagaccaggccccacttacatgaaccagcccacgcacagcttcaccctatcacagccctcccgtaatgctttactgacatgcatttgctcatggccattctccatcgctgtgcttgtatgagtccaccttgttgcttccccctgccattaacatgcaggttcactcctgtgccagcactaatgtgtgcacagatgctggcaacactgttctccccccaacccctgctaccaccgccaccaatgctgccggtgtgaatgcatacatggacaccagcaactccatctctgctagtgtactgcccttgctgtgctgtcatcactggcataaacatgtgcaggaacaccacctccctgctcccacagttgctctgtgcaagccaacatgtgtgcaccttgccacattgctgtggctgctggtatgcatgagccagcatggatcccactgccactactccagtgacatgctttgaccagcacccctccccatcagagtgtggtggccagtggacaagaacacctcagtctctccagtgcagcagcttcctaaccttgaggggccagagaacaaggctgggggcccagtaccagcctcccagagttaaaacatgcagcccagcagtgtagagctgagccttggctttctaaaatcttccagaaataaatgaagccagttgactgaacccatcatatgccacaatctaactcccagggcatcaaagaagataaaagccaaaatccccatccaaaggacagtaatatcaaagatgagaaagaaccagtgcaaaaaactctggcaattcaaaaagccagagtgtctttttacctccaaacgatcactccatttcctcagtggtggttcttaactaggctgaaaagacagaaatgacagatatagacttcagaatatggataggaaagatgatcaagatttgggagaagattgaaacccaatcctaggaagctaaggaatacaataatgcaatacaggagctgaaagatgaaatggccattttaagaaagaaccaaactgatgtgatagagtgacagagctgaaaaactcactttgagaatttcacaatacaattgcaagtattaacagcagagtagaccatgctgacgaaggactctcagatcttgaagaccagttctccaaagttaacttggtcagacaaaaataaagaaaaaaggatataaaaagaataaacaaaacctccaagaaacatgagattatgtaaagagatcaaatttctgatgcattggcatccttgaaaatgagggagagaaagcacgcaacttagaaaacatatttcaagatattgtcaatgaaaaattccccaacctcgctagagagtccaatattcaaatccaggaaatgaagagaacgcctgcaagatattatacaagatgatcattcctaagacacagagtcacctgattctctgaggttgaaatgaaagaaaaaatgttaaaggcagctaaagagaagggacaggttgcttacaaaggcaaccccatcaagctaacagcagacctttcagcagaaatcctacaagccagaagagactgggggcttagattcagtatttttaaagaaaataaaatccaaataagaattttgtattcagccaaactaagcttcataagcaaaggagaaataagatccttttcagataagcaaatactgaaagaattaccatcagatatgccttacatgaggttgtgaagggagtacaaaacatggaaaggaaagatcattatcagcaaccacaaaaacacacttaagtacatagaccattgatactataaagcaactacacatcaagtatgtataataccagctaaaaacatgatgacaggattaaatctgcactatcaatattaaccttaaatggcaatgggctaaatgcatcaattaaaaggcacaacatcgcaagctggataaagaagcaaaattcatttgtgtgctgtcttcaagagatccatctcacatgaaacaacatggataggctcaaaataaagagatagagaaaatcaaccaagcaaacgagaaacacacaaccataaaaaagaatgtattcatgtcctttgtggtgacatggttggtgctggaggtcataatcctgagcaaactaatcaggacagaaaaccaaatactgcatgttgtcacttataagtggaagctaaacactgaatacacatggacacaaagaagaaaataacagaccctgaggcctacttgagaatgggaggagagtgaggattgaaaaactatctattgagcactatgcttattaccttggtgaaaaaataatctgtgcagcaaatccctgtaacatgcaatttacctataataagcctgtgcatgtacctctgaacctaaaatgaaagttacaaaaagaaaaaaaaagaaactatacaaaatatatttgtaggaaaaatgagtaaagtgaattcagtgttaaactctttgatgattattattaaaattatgtaaatctatgtaatttaagtagacattttgccaaatgtggtttcagtgaagacttttaatatcatggtatttttgttttcatcttacgggatctttttgagtaataaaaataatattttcaaacaactacaaaaatatattagtaaacattataggatctaaacaacactatttgccatcttgatctagttggcatttgtagaacaagaatccaacaactccagaatatacttttccaccctaaatacacatagtacattcaccaaaatagaccaggaacttcagtcaggaatgagatagatgtcatgacttgatgtttaagaagaatctatcaccaccaaagcaatcactttgcaaattgataaaacctatatttacattttgaaatattt

SEQ ID NO: 2170 - DNA, 2951 bp, Homo sapiens
agtttgggctagaacctgacaattggcatcacgaacaggatcctaagcggctgcaagtgagcaggtggttagtggcagcgcaaggagaccacaccctgactgagtggctacaggcagccatatgaactgtgtggaataatgctggtgaaatgcccaaaactatttagaagcagtggcacccctcttgtggcaacatttggcagcatgcagttgggccatcaacaaatccaaggtccgagggcctggattacctgctaaattcttgggagttatctggtcggggctgaagttccaggctggacctgatgctccaaaccttgaatgaatggccatggaaaagcagcccagcccaggtggaggctttgttacatgggccaccacccctattcagttgcagatacacaccaagggtaaccgcctctgaccaggttaacatgctccaactgcattgtggactgggcccacacctacactgaagtgaccaatgtttccaactgttggatctgcaccgcccttctagcagctgcagatggcttgccttagcacatacattcagcatctgcagagaaccagacatggctggagacttggggtcccatggctgatgcctggaacgcaacgtggcaagttttggacaaaggatgccacaagacccacagcacagccattccctggctggcccatagcatttatgatgggtggggctggctagtgaggtaacgtgcagtacccctggcccaggcactgtggtgcatatagcaacactggggtaatagcactgtgggatgggtacccgtcacagtgtgtgtaagcataatacatgtcaccacaccaaaggtatggtggaagacgcggccccaccaaggggcctcgatggactgtgtgccccctgggagtttatgggtctgtggggacacagggtggccttacctataagcaaactggactggacattatacctgagggtggcctcatgtacctgccactgttctcacattgcccagatgcctgcataactgggaggtgctacactctcggtttttgcaagtgtaatgagcaccctggtggttttaccccttgacaggcactagccctggagtgtgtgtcacaactgtagaagccaagttactgctcttgcagagcatgctgctcaggctctgaattacacctgagtggccctcttcccattaatggatgaggttgatcagatcagaaaggtggtgttgcgaaaccgaatggtcttagacatagtaactgctgcctaaggaggcacctgtgcccttttaggaacacaatgttgtacctttatccctgacaattggcagaacataacagcagccctgcaaggggtctcacaggagattaaggtagtcaagagccttactgatgaccccctgcagagatggtagacatccctgggctctggcctacgctgggccctgatagtcataagtagcatagctggaatcctagtcgtgagctgttgctctccgtattgttgctgtggattatggattcagggctccaccctacgggcacatgtccctacctggaggatgcccctggcctaggggtggagtgtaaggaagatggctgcgctttagtcaggagcaggctgaggccactttttggtgcaccatgactcagtgggtttggagcgtaggcacacgactccgcacattatgaaccatgccacttgaggtgcattaggtgaccactcacgtgagctcgtgattgcttcagagcctctattgtctgtaaaaggtataattaccctgctgacactggacatatggctcgtgcccagagagaggataaggccatgttcaaactgcctatgattcctcgggtgttttttcagctacccctcacccacccaccaactcccttcggacttcagtttgggctagaaccttacacccacataaactaaagctgtatggggtcctcagttttcaagcacataaaagtattctgtatccaaaaagtttgtgaaccactgccctagagaaactttccatggcgtgcaagatgtatgtaagaatgcccagtagagacataataagaaaccagaaaaagtggaaatctcaatgcctgtcatcaagagagataaatgcagcgtggtctatttctgttctcctcacattgcccagatgcctgcttaactgggaggcgttatgttctcagtttttgcaagtgtcataaaggagtgaatggagcattacctgtcattatagacactgcaaaatgagctagtagcaggatttttaccacaggtacccataagcaacatgtggcatggttcaccatggttttacattgttgtgtaaataacttaaaattatgtgaataatgtaaaagcatggtgaacaatgccatgttttgcttatgggtacctgcggtaaaaagcaaaaatcatgaccctgaaggggtgagcaggcctacaggtgctgggcaggcactgtcttgcaaagagcacaaaatgtgcaggtccctctgggagtgttatagtgggtagctagtcagaaagagcagggcaggagagggctccccataccccacacaccaggagtgtcaggtgaccatcaggtgatggtctggcggttgttgactgtctttctaaagtaataattggtcacacccggcaacagggaaaagccggctcctaatagatagaaaacactcgaaactggtgagcagtagtttccctataagatctcaggagttgagccagtgggctcaggcaggcacatgggacagcccaccccaagggaagaaccaggggagaaataacgcaagaccccgaaagcatgctgacgtataaaaccccaagtcaaaaggtcaaaccacgcacttgctttttaagtcgtccacttggccctcttccaagtgtactttccttccttttgttcctattctaaagcttttaaataaacttttactcctgtgct

SEQ ID NO: 2171 - DNA, 4115 bp, Homo sapiens
gctaggacaccgcacaaccaccgctgccggtatttgccccgggcgcctggcaactctgacgccccgctgcgcggtccaaccccttctccgacgcctggggacgtggacctggccgagggaagggagagggtaccggtccttggtgtaatcacgttttactctgctgggaaggcgtgttcatcttcccaccgaaacgcgccatagactggatcaggcgttttttgctcatcatcgtttcaaaaaacgtttactgaaggaaagaaaggaagaaggcaggaggagcgataaagagatagcaagagaaagaggatggaaagtggggaaaatgaatagatttctaaaggttgggaaagccttttagcagggagatgttttcctggaggtcttggaactctcttggtctcacagcctctgtaaaccgagggctgcacacctgtctctagtccccagctgatttccagaggcccttccagctcctgtgttgattcttctgcctcgactcacttctagcagacaagtaccatccagctgaccctggaatccagaggaattctcacacacaaggcaagacgtatgaggatgttgctgcagcatcgttactagtgttggaaataagatgttccccctttctccttctgatatgagaagatacttgttagccctcaagctgctcagatgagggactttcctgccgagaaccaacgtgaagagtgcagcttctataaaggatttcactggatttttgtactaatgaacaaattttatttggatgagtagatatttaatgtgctgttattaccactggagttaaaagtatattataaattcttatgtctttaaaactagagagaggattctgggaagatggcagagtagaaagcaccaggaatccgacttcccacctaaacaactgttctagcagcatctgtctgacacaactattttaaaactttggggtctattgaaagctagcaacttctaggggaaaagttgtacagtaagctgcagttaatttcagtgaatttcagcacagtaatagccaatagtagccaaaccctactcctcagccctgtgtcaggcagctgtgtatgtgttcctggaccagtttgcacacaacttgctggaatcaaggttgaaaaaaaaaaactgtcctccaaatattagggctctgattgctgattgttgctttacaaaggtgcagaagaagaaatgacagccattgttttgttgttgcaccttcccccccattgtggcaaactccacctcctctggctgaagcaccttccaggggatttaaacgatgagcctttttctgcccttcatttttctctttttctccatttttggaagccagacattgaaggctatgacattcaaaacaactgtatatacacttgttacagaagatattagaaagtcactgtgcgtgcccagggacaggcttagaaaagacccaagaagactgtaagcttatatttcaggctaatcctcagcacagagacagcctataacaataaaaaacaaaaagctagtaaaccctggggaaggaaaataatctgattttcagaattaccagattattagattcaaaagtctagttttcaacaacaacaacaacaaaaacaaaaacacaagagatacaaagaaacaagcaaatatggcccattcaaaggaaaaaataaaccaacagaaactgtccttgaaaaggatctgatggaggatctattagacaaagactttaaaacaactgtcttaaagttacccaaagaactaaaggaagatgtggaaaatgtcaagaaaatgatgtatgaacataatggaaatatcaataaagagagagaaaacctaaaaagaaaccaaaaagaaattggtttccagaaattttctggaactaaaaagtacaatagctgaaagttaaaaaaacttgctagagagattcaatggcagatttgagcaagcacaagaatcaacaaacttgaagaaaggacaaggaaaattattgaatctgaggaatataaagaaaaaaattgaagaaaacagagcctaaaggacctgtaggacatcgtcaaacagccccacacaggctttatggggagtccttgaggacaagtaagagaaaggggcaaagagattattcaaagaaattatgaccaaaaacttgccaaatttaatgaaagacatgaatataaatatccaaaaagctcaatgaactccaagtaggataaattcaaagacacaccaaaagtattaccatcaaactattaaaagctggagacagaaaattttgaaagccgcaagagagaagtgatcatcacatataaggaatcctcaataagattatctgcagatttctcatcagaaacttcagaggccagaaagcagtaggctgatataaagtgctaaaagaaagaaactatcaactaagaatcctatatccagcaaatcttcacttcaaaagctggaggattcacacttctttgtttcaaaacttaccacaaagttacagcgatcaaaacagtgtggtactggcacaaagacagacatatagaccaatggaatagaacacagtccagaaaaaaaccctcttagcacaagggtgctaagattatccaatggggaaaagatgatctttttgacaaatggtgctgggaaaattgccacatacaaaagaatacagttggacccttacctgataccatttacattaaattaatgcagactagatccataacctaatgtaagaactaaaactataaaactcataggagaaagcatagggcaaaagttcacaacattagaatgggcaataatttcttggatataacatcacaagtacaggcaacaacaacaacaaaagaacacaaattggattgtattacaattttaaaattttgtgcatcaaaagtactattaacagagtaaaaaaggcaacccacagaatgggagaaaatatttgaaaatcatctctaataagggattaatatccagaatatagagaaaactcctaaaactcaacaacaacaaaaaacaacatgatttaaaaatgagcaaaggacttgaatagacatttctccaagaagatatacaaatggccagtaagtacatgaaatgatgctcaacatcatgaataattagggaaatacagatcaaaataacaatgagataccaccccacccttattaggatggctactatttaaaaaataataattattataagtgttggcaaggatgtggagaaattggaacccttatgcactgttggtgggaatgtaaaagggcaccaccagtgtaaaatggtggttctttaaaaactaaaagtagaattaccatatgacccagcatttccactgctgaatatatacacaaaagaagtgatagcagtatcaaagagatatctgtacatctgtgtttatagcagcattattcacagtagttaaaatgtggaagcagaccaagtgactattggtggatgactgaataagcaaaatgtggtaaacacatacaatggcatattattcagccttaaataggaaggaaattttgatatatggtataacatggatgaatcttgaggacattatgttaagtgaaatgagacaataacaaaaaggcaaatactgtattattccacctatatgaggtacttagagtagtcaaatggtggttgcctggggctgagcagagggaagaatgggagttattgcttaatgaatacagttttgcaagatggaaagacttctggagatgggtagtggtgatggcagcacaacaatatgattgtacttaatgccactctactgtacacttaaaaatgattaagatagtaaattttgtgttatgtatgttttaccacaattaaaaattgtggtaaataaacaataaagtttttttaaatgttgtctctgtacctaacatgactaagcaccctcctattctccttcccatcacatctctcctagattatcttgggcatctgaacctaagcaggtgcaatagtttcatttgattgccccctttaagtccgctccttgttggactcatagttacctttacctgcttacttcttgatgatcactgggctgagctaggaattctgcctactgctagttcctg

SEQ ID NO: 2172 - DNA, 2937 bp, Homo sapiens
catggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatcgtggacaagtgagagttggctgtggctttatttcttgaggcaaattattttgcattcatgttatttggggctaggtattgcttaggttcgtgaatgctgttcttacagacacagatggtacctgagcccctcagacacctgccctttcagggacgtgagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacgaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctataaagaaagtggtttttgttctttgagtttgttttatttcttgaagattacaataaatatctaagagactatattcctg

SEQ ID NO: 2173 - DNA, 2424 bp, Homo sapiens
ttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactac

SEQ ID NO: 2174 - DNA, 2425 bp, Homo sapiens
cttttcgaggtcggccgcgtggctggaagacatggccactccagtcggtgttgagcacggcgagcagtctcaggcctttagtgatgatggtgcagtcagcctcagtttccaaagccggaaaaggatcctctagtagccacggtgtggcagctgctctgaaccaggacctggacccggacccaaagtgccatgtctttaatgttagctcccagcgatgccagatgggatcagcacagccctgcctctgctgctaattgttcctctaaagtaatcgccatgcgttctttgggcttcatctttaaaggaatgaagcaactgagattattctggaaaaccttttggcagttagtgaaattagagtacaactaagaacattttcagacctccactgtggatgacctgggtataatctcacaaatcgatgggactgcaaggattgtaaactgaaatgaacatgattatactctgttggaagagcctaagaggaaactgatgccatgagtttcagagagtaatgcttaaccccagttacacaggatgccgtcttgtgtttcctcttgtttagttacccactacagtgattttgtgatctgctaatgggttgccacccacaaccattgctttagcacttttacttcaaatcaatgaaggattgataaaagttctcctggtgtctccgcagagtgccttccaggaacagatctttgcatagaatatcagtggtttccttttttgtttcaaatagtggtcagaaaatacccagtgttgactcaccaaggcaatcagcttcctttttccctttttttgttttttttttaacattttatatttttgctttattttattttattttattttattttattttattttattttattttttgagacggagttccactctgtcgccaggctggagtgaagtggtacaatcttggctcactgcaacctccacctcccgggttcaagcaattctcctggctcagcctcctgagtgctgggactacaggcgcgtaccttctttagtagagactgggtttcaccatgttggccaggatggtctctatctcctgaccttgtgatctgcctgcctcagcttcccaaagtgctgagatgacaggtgtgagccatcagacccagcatttttttttttaatttaaatttaaattttttttcatttttttgagaggttttttttgttttgttttgttgttgttgttgttgttgtttttgagacagtcttgctctgtcacccaggctgggagtgcagtggcatgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgttttttaattttaaagttgggggggggtctcaatttgttaccctggctggtctcgaactcccggacttaagcgatcctctggctccaagcccactaccagtctcaggtttctttactaaaagatcactacctttttttctcttatctgctgccatgtgagatgtggctttcaccttccgccatgattgtgaggccttcccagccatgtagaactgtaagtccaataaacctcttttgtaaattaaaaaaaaaaaatcactatttaagatactaggatggattgtgactgttgaggagtacttacatatcctacatttgactacattatttccaaaccaagtattccatccaaaggaacatactgctatcatagagaccaaggagggactgtttaaggttgccaaggtgaagcgagctgagaggctttgtcctcgtgccagtaactctgaaatctctcttaattcctgctgtccaggcagcagaatgccatggtttccccaagtaggtagctgctttagcagttaaagcccaaatgtctgttctgttgatcagaggtctctgaatttctgaagtggtgtttcgtttctggtgactgagttaatcctttacaatccctcttgtaaagtgtgctaatagaaagaatccacctttcaaagctgcagaaccagaccgtgccctaaattgaccaacgtaactgatgtgcctcaggaagtctcttgccagctgtccctgtgaagacccccctcctcccccccagctgctgccttgcacactgaagcatctcagactgtgcaaagccgtgtagtcatcaagacagtaaatcccagggcttggttaagtgctgtgtgataacttgtttggatgagacttaacttaaaaccacttacaataaacttgggaaactac

SEQ ID NO: 2175 - DNA, 2183 bp, Homo sapiens
agaatgtctctgaaatgagatgagtggaaaatgccttaaacaggtggatgtggaacaggtcggggactttaaggacttcagtggaggaggggtgggttggggaagggaaacaaatgaagatgtcttagaagtcactgcaatttatatggaatctgttcaacgccgacactgaaccatatgagaagacgtttgaaactattgctttgctgaaaacatctgactgccaggctaggatgtgacacttaagggacttaccaatttgggattcttccaggagctgaaaactgattgcaaatatgaaacagatttcactacaggacttgaaccctacattaaaaaacaacaagctccccaaaataattgaaaaagatcttcaccaaagagtagctgcaatgtgaatggcaggatatgaagcaagtaagagagctatcactgccaaaggctactgactaatggtgaaaagattatcttaagcttggaattaagtgatgaaagggaccttcgaaattatcaactctaaatacttctttacaggaaaattgaaagcagttaagaacctgccccctaccgtggagttcttggtgccgtgagttggagttcttggtgcctgggtgcgtccccaaggccactggtcttcagatctttcttacttgagaagaacgcctccgcctcctggctctcccaccagtggtattgccaccaccacacaccagcataaagcacagattgctgcccagctccttggagaggggccagtgcatttgtcaggaattgaaaagttttggagccagttcgaggactttctcctgcacaaagtgttggctggaagcatgattatctcacacagagcgttggaattacttcatgatgatttcaaagaaaattttcttctctaaacactcttatcccaagggcatcctaaagttcctctggaatgcattgggtgggagagaaagttctatgtcaactcttctggcagagggaaaagctgaccgaggaagtcaaaatgaaagaaagaagcagacaggactgaggctccctgagatgcagaaactgaggcacagagcaaggggctaggattcttgactttcttctgcagaacactgaaacatgcctcctctttcctggccccaccaagcagagtttaggcttcaagaagactgaatgcatctgtacagagcacaatcccttctccaagaaggaaaccatggggcttatcaagaaaggcgtacactgaagagactggaaagtgaagatgcactatttgtcaagatgtgccacagcagaagcaagttgtgttggcagtaggaaacaagataaagagaagaactcaaagaattgagagaaggctttgaacatgatgatggagaaataacactcttgggagaaatgaagatactttctcctccctggtttacctgagtttccagcacccagtgataagaaaggatggcattagtgatgtgtacacctgcagtgatagcttcacctttctaaagcagatgccgtggtagacattttgccagccctcctttcactatacacacagcttggtgtacgctggcagacttttgacctaatttcttaaccctcaaatattccaagacagaacaaagcacacaacaaaaccagaatgaggccgggcaaagtggctcatgcccgtaatcccagcactttgggaggctaaggggtgggcagatcacttgaggtcaggagtttgagaccagcctaggcaacatggtgaaacccagtctctactgaaaatacaaaaatcagccgggtgtggtggcaaatgcctgtaatcccagctactggggaggctgagacacaagaatcacttgaacccaggagggggagtttgcagtgagccgagattgtgccactgcatgccagtctgaacaacagagcaagactctgtcacaaaaacaaacaaaaaactgaatgaatggaagcagataagtgcagagagaaacactgatttaccttcagaaagataaaaaagtagtatattgatatacttgtatattgctatctactagtatagcttcagttggtgtatgagtatagaactattgggttgttctttatgtgattactccttcccagttttagtaaagtattccaatttgagggaaattctttcatttgtcaataaaataaaaagaggtaagttttaaaatctg

SEQ ID NO: 2176 - DNA, 2012 bp, Homo sapiens
agcttccaggcaggtgatgaggatagctagtcccgcggtcctccgctagctggcggcgggggtcggccaggtgcccggaccctccgagggccccaccgccgcgcgtcccggggatcgggaccgctacccgcgcctcacctgcgcgcccgggccccagggccctgctcccgggcggtggcgcgggcctggctcccgtcgcagccacgaccgcccccaccgcccccgccgtccccgcccgggaagtggcgagccggtccggcttgccccgcccgcctcccggcccgcactcacgctccacatcgtgcagcttggctcgctcctcctccagcttgcccttgaggctctcggcctcgctcttcagcgacgccagcgtctcgttctcgtgcagcccctcggttgccatcttcgcgcggggacgcagcggagagggaagcggagagcgggaatgcgctgagccgcggcgggcgccgctccagcagccgtccccggccccgagcaccgccccgcggccccgccctccgcgatgacgccagcagctgcgggcccggctgctgcgcctgagccccaagaccccgcacctgggcgcgcgctctggcgcagtgcctggtgcgatgtccgcgtcagcctctctcctccgggagaggcagggagtgtgacgcccattttaccagcgggcaaactgtggcttagggatgctgggtgatttgcccgaggacgcacacagagggaagggccaagccgggattccaactcgggactccccgcttctggggagaccggtgaggcccccgcgacatggccctcccatccccaagcctctcgtgcagatctccgctctgtgggacttgattgcgggctgcgggcccgtggctcctgcaggcagagagaggacgggagaggagacggctacgaggcttggccgcaggtagctacggtgctcccccaacaaggaaccggaaaccctcttcgtttgttgatctaaatatacaaaaataaaactagttgctgggttctcagacggagtctctgcggcattaggaggcccacccttattttctcttttcttcacgcaggaatcaggtccctggcctgggggcggcaaaaggagatggcggtgggtcaagtgggcgcgcaggctcagacctggggcttctgagcccacgcccaggcatctcggacctctcacttctgaggccacctcctgccctttagaatgaagggctggcacagttctgccaggatgcacgtttagcgacttctgtcagactgaagcatcccctctccgcaagcgcctgaagtgtgagaggcactgttctaagtgctttaatttgcacttgtttaatcctcacaggagtcaacttgaatgggcacacttattcccactttacagaagaggaaactggggcacagaaagactgagtaattgctcagggggcatgctccaagaaagagggagagacaggatttggacccagacaggctggctccctagtgctctggactttggtgtggatgatccaactcaagccttctcctttttccctcctatgtgatcttgcatgcgtttgtgcagagaatgagaaggcagatcaaagttacagatgctgcgagaacatcgccaagcagaatcttgggtgctgtccccacctctctgtacctgctccctcccagagaagccagcctccacttgctgtcccgggccttctctatctgagaaaagttgaaggtactcgatgttaatctgtacatagttgttttgcaggttagagtctgggatcctccgtttccttatctggaaaagcttcttcataggatctgcttcataggattgttatgagaattaagtaagatggtgtgggccgggtgcggtggttcacacctgtaatcccaacacttcgggaggccaaggtgggtgtatcacctgaggtcaggagttcgaaaccagcctggccaacatgatgaaaccctctctctactaaaaatacaaaaattagtcgggcgtggtggtacgt

SEQ ID NO: 2177 - DNA, 953 bp, Homo sapiens
gcagccgcgggagcgccaccgccagtggggtggggggcaaagctataaagaaggcccagaggattcctgcggagctgtatttactttacatccatgtgaactgctgtcatcactactgtgtccaagcccagaggatgaactggaaaagaagagagggggaaaataataaaaagaggaaattggttttcacaacacactcaaagcctgagtaacagaggagaactttaattatctccagtcacaaagagagacaggaaatttggacttttaattagccatttggagtgcagttgggtatttttttagctagataatttaaacgcgaataattcaagtctgactaaatgaaagtcacataatcagaatgcaaataattgaatttctactgcattcattaattcagtgtggaggtgtgtgtgaagactactatgatgagctgtcacagctcaataaaatctcagtcaattaattttttcattatcttagtattatatcaacaaaaaagtgaagtgtgtatatatatctatacacgtgcatatgtgcatactatgtattatataaatacatatacattaaatcaaaatgcaaggaaatacctttctgaatcataatctatatcattttctttttttccttcttcatcttcttcagggaaacgtctattcattaaggcaaacttgtgaattgcttcttccacagagtacttagtctgcccagaaacacacgcctcaatgtcttctgaattcagatggctctgtaagaagaggtgaaggctgctatctgaaagcaaaagtgcattctgtaggactctatattaaaaaaaaaaggaaaaataattggtgaacaggatggtcagtgatagggtagaagaaagaaaaacattagaaaagtaccactgaagattaagagaagagttatagagcaacaatccattaatacgaacttggatcgtg

SEQ ID NO: 2178 - DNA, 5165 bp, Homo sapiens
gcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataagattacagccgaagatacatattaaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttcccacctcagcttcctaagtagctgggaccacatgcatgtaccactacacctggctaatttttttttgtatatttggtagagacagggttttaccatgttgcccaggctgctaagctttttatatacagtatatagaaagagttggttttcttaaacaatatttatttctcataataactctatgaaagcaggtatagacttcttgctttctagggttggtatcttgcttgttgaggacctacccttttgtgttgccgaatttttcattgtttgagttctgtcttttgtttcagaaagccatggagttttgaaattattgttatatcattatttgttacataattatttctacttctagaatctcatgctaacttggaagtgtcttctcagcatcaagcctgatatggaggggcagctacaccctaatacgctccaaaactagttatgctttgttttatacgtaatgcttctgttattagacaagtggtttccaaatatcagaagcagtgctaggacttaaaggaaaagggggagtgttttttcttctaatagaacttttgagcagtgatgaaaggaaaacaagaagactcaaaagattataaatctcaggcacgaattagtgttctgccaattaggaacattctgattgcttgacaaggtctatattttgctgatgaggagtagaagcctgtgggaggtgggggtggaagcagcagaaggaaaagagtagcaagtatttagtaaaatgtattcatcatagtggataaaaatcaagctttggggaaaaaggtcaaactccttcaatgatgctgtacatctgtacctttactccatcctatagcaaatatttgtataactgcacagaagaaattggacaatattccttgaaaaattcttagaaagttcaactttccaagttagtatcaccccaaggaaaattatatgagtaggaatacctaatttctagccatactctagttccaattagcttctctaagtagctggaactgcaggcgtgtgccaccacacctggctaattttttgtatttttggtagagaaggggttttgccgtgttgcccaggctgctaagatttttatatatagtgtatagaaagagttggttttcttggccaggcatggtggctcgcacctgtaatcccagcactttgaaaggctaaggcaggtgaatcacctgagctcaggagttcaagaccagcctggccaacatggcgaaactccgtctctactaaaaatacaaaaattagccgggcatggtggcacgcacctgtaaccccagctacttgggaggccaaggcaggagaaccacttgaacccaggaggtggaggttgcagtgggccaagattggccactgcactccagcctgggtgacagagcaagactctgtctcaaaaaagaaagagttggttctgttaaacaatatttatttctcataataaccctatgaaagcagatacagacttctggctttttaggattggtatttcacttgttgaacacctacccttgtgtcagatgtatagcaggttaacaaagtcaatacagtgatacacttgacataatctttgttctgagtttttttcccaattatagtaaaattggaggtcttaactgttctacattagataaatatatgcatttgttttaaagagctaagcaatgagaatcttacaactagagctgaagttcaagaaataaatgtccaatgattaaattttttccactgctgttcacatcatgatttgttgtgattaatgtatgtggatgaggacataatagaaaaagaaaatgatgagacttgtatatattgtgtttctgcacaatgagttcctttgaatgtttttcgttttaggaataaaattgaagggtgtttttcttagagaacatcatttgtcatatttatttgatcaagaagttgaagatttatataataaggtatgggacttacacatttattttgataaaagaacacagaaaaggtcaggtatgagcagaaaattgacatttatttcagcctaatgtggatactgtactctgaattaaaaatttcttttccttactcttccagcttttaaagataagtattatttcaaaatagtatttttttaattaatagattcaattcaggaaaggcattggagggggtggagcttttaactttgacagtctcactctgttgcccaggctggagtgcagcggcgcaatctctgctcactgcaatctctgcctcctgggttcaaatagttattgtggcccagcttcccaagtggctgggattagaggcgcatgccaccacacccagctaattttttttattaagtagagaccatgttttgccatgttggccagactggtctcaaacttccagccaccaacctcagcctcccaaagtgctgggattatagtcataagccaccacacctggctgttggttatcttttcttagaaataatgatataatcttttcagcacctgatattcttaaagatccagggtttacaaatgactgttagatatgccaaggatgactagcctataacttaaggatctgttcaggaacagtagaaaagaaggtgataggaaactgggaatcttaaatctaatactagttctgtcatgaattaggcttgttattgtagttgtttctcaaatttaagaaaatatgaggggtcttgaaaaagtgcatggaaaatgcatatcatgaaaaaactatgcatggatttcaaaatttttggaccaaaataaactcctactaacttgttataacatgtctgaacaggatctagtttgaagcactaagaagaataagacatcagtttgaaaagaggctctatcagaacaacacgaattctgctaaaattgaagcaagaacaaacatcaaatatatgttgacacttgggtggaagaatggtgaactaattgatgctttatgaaaagttgatagggacagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataagtgggatcaggatcttgaagcctttcattgaaaaattgtaacaggagatgaaacatggctttaccagcgcaatcctgaagacaaaacacaaagcagtggttaccaagataagtagttcagttaaagcacaagaggactggttgagagcaaaggtcatggcaacagcttttgaatgctcaaggcattttgcttgttgactttctgtagggccaaagaatggtaacgtgcttatcatgggagtgttttgagaaacttagccaaagcttcagcagaaaaatccccgagaaagaccagagagttcttcaccacaacaatgttcctgctcatccctctcatcaaacaaggccattttgcaagagttttgatgggaaatcactaggcatccaccctacagtcctggtttggcaccttctgactttttgtttcctaatcttaaaaaaatttttcagggcagtacatttttctcaagttaatgtataaagaaactgcattgatgtagataaattcccagaactctcagttctttagggatggactaaatagctggtatcatcacttacaaaagtgtcttgaatgctatagagctaatgttcaaaaatatagtttatattttttatcttttaaccatttttccacaaactttttgaagtctccttgaatatgtaccatttataaaggggaaaaattctgtgactactcatgttgacttaatgctgacttaattttctgttttgtaaatatatacaaacaagttgatacaaattttgtttatagcccttaaacaaatttgtgaaataaatgcattcagaaacaaactaaaacaatgaaatggatgctactgttttactgaggtgtaagcatagtactggctgctatggaaaaagttacataaacattcatgtatcttgtgatgattgttttgtctacaacttcactctttgcagacatcaagactgttgaaatgaggggaagggatctgaattcccaaaagaatgtcaaatgggcatggaggctcatgcctataatccttgcactttgggtggctaaagcagaaggatcc

SEQ ID NO: 2179 - DNA, 1585 bp, Homo sapiens
gggcgacagagcaagactccatctcaaaaacaaaacaaaacaaaacaaaaactctttgccttgtaaatagcctgcctttttcaaaaaaatcaatattatcaaatgatacaagagctatcacaaaaggcacccaaacttctgaatatgtgagacctttagctgagaacatttgtatctaattttgaacaatcctattcaaaaagctcctattttcgttaatggaaatgccatgtttctcttagagttacgaaagatctcagaaagtggcaaaagatatttaatgtagccagagctatatatttctgtttttctcgtacttcaagtattctgaaaaacatataactgaccttggtggtgttcacaatgggatgaaacagtatcttaggaattgactttgaaattagtatggaaattcattgtttttaatataacattgagcaacagaaagccttgaatgataagatcaagagtctcccatgaagtctcagctcactgcaactctgtctcccaggttcaagcgattctccctcctcagcctcctgagtagctgggattacaggtgcccgccttgatgcttggctaatttttgtatttttagtatagacaaggtttcaccatgttggtcaggctggtctcaaactcctgacctcaagtgatccgcccaccttggcctcccaaatgcaattacttttgcaccaacctaagaacagtaatctcagtcaatagtggcttaaaccattagaaccaaaaccaggcagagatcagagaaggttcaacgctcaacaatgttatcaagaacccagcttctttttgccttttcttttcaccatcctctgcatgttggccatctgaccctgtgcttgaaacctcatggtcacaaaatggctgcccctgtgctggacatcatatttcttttcaaagaaggtagaatgggaaaggagcagtcataaaaggttttctttcagaagagtctgttggttttggttagaaaaggaagtcccctggcagatttaccattgcttctcattgatcagacctgggtgtcatgcccatcccagcatgagtcctgctgtagggctggaaggaagggcctacgagcaccaagggatacccacagcctcctgaacacaaaattgggattctgttagcacagaagaaggatagcaatggctgttggatgggcgatggttgcaaggagcctgccgtggatgtgtaggccacagagctctcatcagcactgttttcgtggccaggaacagaaattctactcaggataattaaaattaaggaacagagctttattataagactgggatcggtagttaatttcctacaggggaaattcagggcatgtaaatcagtgaaatggaaaaggtgtaaggacaagagaaacaccagccctgtctgcaggggggggctgcaactcccttccagctgatgttgttccaccatgggtccagtgtgaccagatcttacaatgttcaaaagaggagtctaggtttttctgtgaaatctccaaatattagtatattggatcaaaaatgttcaaatgatgtgtgagctcaataaaatgcatctgcagtgc

SEQ ID NO: 2180 - DNA, 686 bp, Homo sapiens
ggtgctggggcgggcgcaggactgcaggctggggctccgctccccggcgggagcccgcgcgtggttcccagcgaagtccccgcgcggctgggcccagcgtgagtattctccgcccgctgtcctccccctggaggcggcagcgcccgtttatttgagccgtgtgaagatgtgcctgcttcgccttccatcatgactgaagtttcctgaggcctccccagctatgctccctatacagcctgcagaacggtcggctgcctccaatcctgaggtcatcactcatcaagaggggataatcccagggacagcaggatctgcttcgttacttggatttaggagccagaaacccatcaggcaactaaacagtaacaatgacccgccattaaacacactgagagaagagcatgatgaagagtttgtacaagaagaagccaggagcacttgctgacaatgcttacagagacgcaggcttctatgagctctgcctgttgaactgcagtaaaaatagatctccttccccagagaggcttggatgtgggcacaatatcagttcagacgatggtcaatgcatgtacttaatagagtgaaaagactttggactgtgaagtcagattacctgggtctgaattgttattcttctacttctttgtagtatgctttcaccacattaaaaattgtctgagcctcaa

SEQ ID NO: 2181 - DNA, 11198 bp, Homo sapiens
gcctacgggtggccgggcgggatgtaaccggctgctgagctggcagttctgtgtcgctaggcttctgcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgcagaagctcctcaatggccagcgccagctgcagccccggccgcccactcgcctcatctgagcctgggtacgtgcgccccacaacgcctcccccagccagggcccggggatccccgggagcgtccccggctacctggcgccgctcatcctgggtagggtcggccccctctgaggctgcctggcatgagggagctgcacccctgagcttgacctctgacggccctttgtaatagcattaagtctttgaaactttgtagcggggtagaaggggctaggaaatgaagaaaacatctttttaaaaatataagcagtcggctgggcgaggtggcccacgcctgtaatcccagcactttgggaggtcgaggcaggtggatcacgaggacaggagttcaaaaccagcctggccagcatggtttcactgaaaccccgtctctactaaaaacacaaaaattagtcgggcgtggtggctggtgcctgtaatcccagctacccgggaggctgaggcagagaattgtttgaacccgggatgcggaggttgcagtgagcggagatcgcgccactgcactccagcctgggcaacagaccaagactccgtctaaacaaacaaatatatgtgtgtatatatatgcgatcgagcccgggaggttgagattacagtgagctgagattatataagcgatcgagcactggaggttgatgttacagtgagctgagattgcgccattgcactccagcctgtgtaacagagggagactctgtctctaaaaaattatatgcaagtgagagcttttcttccagcgctcatgctcagactgaagaaagtaattgggccaggcccggtggctcacgcccgtaatcccagcattttgggaggcggaggcggaagcgggtggatcacttgagctcaggaattccagactagtttgggcaacatggtggaagcctgtctctacaaaaatacaaaaaattagctgggcatggtggcacgcacttgtagtctccgctacttgccgggcttaggcgggagaatcgctcagctgcagcctcgacctccaggggcaatccatttcagcctcccaaagtgctgagattacaggaatgagccatcgtgcctggctttacactatattttaatactttttttgaaaatggaaacttttacaggcaattcacttccttcaaactaatgataaggaagtgatgctgttctgttctgttttgttttttgtttttgtgggttttttttcttttttgagatggggtcttgcccaggttggagtgagttggtgcaaacaaggctcactgcagccttgaccttcgggctcaaggaatccttccctgtcagcctccccggtagctaggactacaggtgcatgctaccacgcttggctaattctttttttgaaatggagtctcactctgtctcccaggctggagtgcagtggtgcaatctcggctcactgcaggctggtctcaacctctgacttcggctggtccacccacttctgcatcccaaagtgctgggattacaagtgtgacccaccgcgcctggcgattttgctcattttagatactagaactttttaatttaaattttttttttcctgagatggagtcttactttgtctccaggctggagtgtagtggcgtaatctcggctcactgcaacctccgcctcctgagttcaagcgattctcctgcctcagcctgccagagttgctgggactacaggtgcgcaccaccacacccaggagttcaaggctgcagtgagccatgatcgtaccactgcactccagcctgggcaacacagcgagaccctgactccacaaataaataaatcaacatcatatgatctgtaccagggtataggcaggtgctatgatccccacttttcatcctcaactctaagttgagtcatacatcaacctctagtaaaaagtggcatgctctcagtcaaaggggtaagcccaaaccacgcggagagaatcttatctcttttgagagctaatataaaaagaattcctcctaggcataaaaatattgtgacaccagttacttaggctaaacatgcctattatgctaagtgagttattaacaataaatactttaactctgtgccatgttaattatcataatctgatttataatttgttttaaccttaggttatatataccttgaagccatttatattttggtatacttgtaataattactatacaccggactatgtatattggactaaacacggagagtcaaaaaagagtatgtggtcagagtagaaatcatgccctagcttccttcgtgtctacctcctaccttgagtagaagtggtagaaaaagtaattacctaagattttttggattctggtttgtggagaagcacccttatatttaggctgatgggcggcaaaattagaaagtattttttgtgatttagaattttatacggagatgttcattgtgattaattattctttgtattagcagatttttgctttttatagctgcatgatttcttgtttattattcattcattattgtctattaataaagaaaaactttatttcactgaagcagtgatatataatccaacttggatttttaaataatgactgactttttttctttgggaatacattactgttaaaaatgtaattattagatacattacttttaatgaatataagtggtataattagaaggctgaaaagaatccttggaaatgtgagtttaatttgatagctaagaaactgaggacaagttacttattctttgtagcatattttctaatgtcatttcattgtctcaccaagaaatacttgcataaagcaagttcaattacagcatctgttgaatatttaaggttgagtaaagtgggtgagtttaacagatattttcccttatttcttttaggcgaatctggattgggaaagttgatattaatcaactcattattcctcacagatttgtattctccagagtatccaggtccttctcagagaattaaaaagcctgtacaggtctacatattggtatttttaattgatgataagctggaataatattaatacacacaaagcacgtgttgtaactttcattatgcttccctagaggtaagatgcaaatttgcccttagccagtgtaagatggtaaatatgacttcataaaatcaaaaaaacagaggaagtacagttaatcgaaagaattatcttgactagaactttccaaatttgtcctaaggattctcctagagatgacactgtgacatagtaaccaattcccctggagttgtgctatgtagtatgatagtcatttgccacatgtttaaatcaattaaaattaattaaattaaaatgcaatttctcatttgctccagatacatttcaagtgctcaacagccacatgtggcaagtggctgccattttgtgcagcacatatatgaagattttcatcattgtagaaaattgcattggacagtgtagagaaaacatgattcatagaaaaactattgttatttaaatagtgttctatattagtcagtgggataataccatatcatagttgaatggcaatagcaattctgtaaaactcccatgctatatgtgatctaatttactgcttctcagtctttgctacgcattccaatcctgggtatcctgttaaatttatttcttctagtagttctgagatgggctgcctttctacatttctaacaagatcccaggtgatgctgatgccgctggatggtagatcacactttataaagcaaggggctagactctagatatgcactttttattaaatagtacagcagcctgtagccacatgtggctattaatctttgaaatgtgggtagtctgaattgtgatgttctgcaaatataaaatatgccacagatttctaagactgagcatggaaaagaaaatctccgtaattttttatattgattgtatactgcagtgataatattttggatgtatcgggttaaataaaattgactgatttcacctttttcctattttaaaagtggctactaagaaaattttaaattacttacatgaccgacatggtatttttatttggcagcgctgctctaagctgttgatgaaaaatattgttggtgagctctgcttaggtaatatgtaggacacgagcagagaggaggcacgtgaacagttctggctgaagtaggcttcattgaggccgtgatgcttttagctggatttgaagaagtggtagtgagcatcccagtgcacaggataggaggacagtctatatattctgagcagtaactcatatatatcatactgcaagaccccaaaggagtaattttttgaagtaaatatcttatttctcctttttaatgtttctattttgggaatttttttttttttagtaaccttcatagggcttgagatttaaaattacctgcaaaattctactctaaaaacttgatcctacatgcttatttattttgtgataaatattggaaattttaaacctaagcaagaaaatgaactttgaactttcttaatttgggtatctattatgaataccttcacttaagtatttatgaatttagatatgaaaggtaaaactaaccactatccaaattaatatacagttcatttccagaaccctagtttcttccatgtgctcactcgcattcagtattacaacccccaaagataaacaccttactgactgccttctccataaatttgcctgttcttgaacgttatatacgtatacttttttgtatctgttttctttcagtgaagattatgtctgtattatttactcatgttgggtgtagttgtttttttcatcgtcgtataatactccattgtgtgaatgtataaagtatatcctttattatttattgtagataagcctttgggttttcagttttttactaacgggaacattcttgtgcatgtcttagtagacttaggcactcattgctgttgtgtgtgcataaagatataaaggtatttgagtttattttatttgatttctagtgaggttgaacatgtcttgtactcaataactgttcagatttcattaaagtcttttggtaatcttaatattttctgtcattttcttgctgatttataggagtttgaaaaatctaataatcccctacattttagatattgcagacattttctccccaggtgagcatctgttaaagatgtgacatgccctcaatttattttagaattcttacattggcttagcttcaaaataaattgcctaaacccattttaccttcctttaaagtaacacttcaaaaatatcctcttctgttgtgaatatcttcccggaaactctctttatcttgaaaacaaaggggtaatggaggtactagagaatatctctagtaggatttttaagacaggcctgtgcaccactgttaaatatcttttctgtaccaaaaagaagacctgtaacatttgagaaccagattgatccttagtagaatcctgtagaagtcctctttcctgattgaaccatagaggtgtattcctttatatactgaaaactagctgaagataatctaaactcttgtgcccagttaggaaagaacatgccatattatggacagggtcagagtcattcaagaagcctgaatatagttagaaaatgagaatgtaatctttttaatagttggctggctctttaccaagcccagtagtcttgaagatataggggaaatagtgtaaacggttgtcaagatgaatctaaaatggaaattaatcagttccctagaatagattgagaaattagctttaggaaaaagataaatttcacacacactgtaccatggaaggtacagtgctgattcagacagactgggaatggtctcatttttaagtggtgatgtgaggtacttcactgagcattgtgacaggcacgggcttgggaagagcctattaggaaatgggagaggcatgagactaaggagcacataagagtaatattagcagagaaattctttttgaggttgaaggtcatgaattttatggtataggaatagaaagaggggttaatccagaatgggatttgagttggaaagggaaagaaataaaggttttgggaaggaggttgctaatagaaaatgagaggggcaagggatttgaggtctcagtaaggagacagggatatgaggagtggagaggttcagaatagaaagccaaattagagttttgggatcaactttcttctcagtaaagtagtcctgggtcttcgtgagaaggaagtattcttcaggcataactgttctactattggttacttcctctttcattgtcttgtggaacacgatgaaacatttaagatgatattcatcttttgagccaataaataagggaaatagatagtttttgtgtttgagctaagtggagtatctcaggccattccaatgtcttcagagttttggctgtaatgctacctcttgagcaagtgtaggtagaggtaagctcttgacagaaaattttaaccctctcttcaaaatgttatatgcttaattaaataacttcttaatttaccttaataaatggcgtataaacattaagttagaaaaggttagtgtatatgaagctgtataatcaacattgtttgactttttttcctcagattgtaaaactgaaaactcagtatactaatactcttgtatactgtatacactcagtattagaaaatgagtacctttgatttctggaatctcggatgccaaaagaggtctcaatagatgaattatacatagatgattcatagacgatagttttagttttatttatttttcagggaaaaacatttgacaatgttcttgattcatttttttggtattaaattatgcagctaatcttagagaaccctgagtgatgccataaaagatgttgatgtggcctgcttaaggaaagtgcacgggaaagtggccatttggaatagatttgttaagaaaagtttgaaattcttggactcgaactaatttgttttccatggatcccatgaggatacttgtaaaagcagatgatagggtccagttggatcctgtgaatggcactagtttgcagttatgttttctggatctcttccatatgtcgctgacttctttgtatttgaccatgtatggacatacagaatttcataggccagagaagaaaagaagctttataaacattccttatgtgtgtaaaatacaaatcttcatttgtcttagcaagtcaataagtaattaagttgttgaactgattttttttttaaacagggaaatatcttaaaatttaagctgttaggttaaaatgtgtgtttggtatacagcatattactgaaggtagaatgggcttcatttggtaataaaggaaccagaaatatttttaagtaaaattgggagatgattcatgtagattaactatatttttgtatcactttctagaatacagtactatgttgtttaaaagagtaagtaggtaaaggagtggtataattactttggatatttctgcgtcagccacagttaccatgaataaatgatctgtctttataaaggagatggaagtgaattcaagatattgagatgttagatttgactgggttgtcctttgactagaagatcaccagataaagaaaatgtaaacttcctaaaccagataagatgatattgttaaaaaatttttttggcccagcactttgggaggctgaaatgggaagattgcttgaacccaggagtttgaagctgcagtaagctatgatctaccatgcactccagcctgggcaacagagtgagaccctgactaaaaaaaaaaattttttttcctttggttctcatgatttcacactgatgaatctgattgttttctctgagtcattttgcctctctcatgttattagggtaacctgataatagacatgttatctgagttatgtggtatgtaacagtgatcttctaaatgatgtgcatccatcactgatactgaggatgatcagaaactattacaactcttatttattgatctttacttttaatctacagataaatgataatacatattaatacttaatattcagattgccaatagtatatatttggtgggtaaatatcttttggatctgcaaaattttcactgatagtttgtatcaggatcaaagcagtttgaagaacattaatctaaaagataagactttggcatctcatttctctaaaagataagtcatgcatgtacacactcaggcaatttttttcagttttataagttttattcttgataataaaattcttttaacagaaaactcttgattgctatagacctctgctgtgtattcagtagtcactagccacatgtggctatttaagttaattcaaattaaataaaattaaatatcagttccttatttgcactagtcagattttaaggagtaagtagccacatgggcaagtggctaccatattggacagtgtggatacacaacaattccatcatctcagaaagtgttattggatagtgtggctacagacttttcttgctcagcaatcttagtctccgcatgttagtctcttcatgcattaggtagcatctataaaacatgccaaaaggaaataggctatctctaaaagtgtcccaaactttttgtcttgtaaattagcttatcagcatacttggagcctcttgccttaaaaaggacttgatataaatgtgtatcaggagaaagcctatcttatgaaggaattattccctttttatttgaatccatgtttgctttatcttcggctcctgaaaactgatactttgcatttaacagcagcatatgcccaggatgaatgataatacatctcctgatacagagcttgaggttacagaatatcttaaattgttccaggaactgttgttatcatttaagtccaataatcagtaagatttcaccctaccagaatacacttttttttattaactgtctggacctttgctgattacattgtccggaatgtggagtatcgcatttgagaagaggattggatcctagccataacataaatataagggtaattacatccatgctgagaaagatttaggaatgatagtaagttcatttgagtgagtggtttgggccaaacttgatagagaatagtccaggaagacatttactataaacagtagattaaatgttcttgcctggttaattacatttgaactctgttaatgactgaatcactcaaactgcttaattgtattattagatgcacatttaagttatgtattacatgtctttagtggtgatcagaattttatcagttcctctgtctttctttataccaagtatgactcataaacccagtattaatttgccaagagattggcatactatttgtatatatgcttttctttcaaataatctggattcccaatgcccacaatcattgatcctaaagaaaatgtgagagtaggtagataaactcaaacatccctaccatcacccctggtaggaaatcactggtgtaatgtatgatattaacatctgcaccaattactcttataggtggaacaatccaaagttttaatcagagaaggtggtgttcagttgctgcttacaatagttgataccccagtatttggagatgcagtggataacagtaattgctggcagcctgctatcaattacattgatagtaaatttgaggactacctaaatgcagaatcgcaagtgaacagatgtcagatgcctggtaacagggtgcagtgttgtttatacttcattgctccttcaggacatggctctgttcacggaaagggcctgggagctgcaacacctcaacagcaacgagcacacctgctacctagaacttggtttctaaaaaccatcctcctctaaaaggaaacagagctctttgaagaaatggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatgggacaatttgaacatcagaataaaatggtgacagtcacagaattataacccattgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacatgagaatcttggcagaaccactttaatcaagaggtttagttgagcattatcagtaacagagtaaatcaaaatcatgagccacttgatagatacaatgagaaaataaagcatcacttctgtgacaccctataaaaaatgaatctaataatgaggaaacattagaaaaaaaccaaactgagggatattctacaaataaatggtcctgtaatcttcaaaaatttcaaggttataaaagtcaagaaaaacagacaatcttttccaaactcaggggaactaaagaggcatgaaatctaaatgcttaattctggatttcatctttttgatataaagaacagtattgagactattgataaaatttgagtggggtctgaagattcattggtagtagtaagctcaatttaatttcctcactttgatcattgtactctggttttttagaatgttctagtcaacaggtaatatgaattaaactaatcgagggtgacagggcattatatcagccacttatcaacaaacatttcagagaaaaatagttccttgtattgttattgcaattttctttgagattgccccctccaaaacagtaagaactttcaaaaacaaacaaatatatcaagccacagattcaaagtgctataaactccatgcatgattagttctcactcataggtgggaattgaacaatgagaacacatggacacaggaaggggaacatcacacaccagggc

SEQ ID NO: 2182 - DNA, 546 bp, Homo sapiens
ggattttttttaaccctgataatttgtggtaggtttctttattttttgaatataaagtgacagaaataatttgccattagaaaagagaaagaatctttgactatttacagcttttatacatcacaaagtttttcttgtttttttatcgttgcctattcctgttgtctctacctcctctccttcccctctttcttgaatccaccccatcatgcttttgcccccaccagtccactgaaacagctctcttccaggtcatcaatgggatgacctccatgtttccagatagtcttatcctactcaataatagtacttgctttacccattaaccactcctcccattgctggtcccttctcatctcctggagctttgaacaatcctccaccctgggcctcagtctagagaatcctcttctgtcgctactcattctctagttccagtatcatggcttcaaataccaaccaaacgcatacaaattttaaatatgtatcttcaggctatacattttccctgaactccaggtccatatatctaattgcctaatcatc

SEQ ID NO: 2183 - DNA, 16322 bp, Homo sapiens
ctcactccccaggcccacacactagcccactgttcagggtccggggtggcagcatggcctgggggtcctggcaccgctgctcctctgcccaccctaacttcccggcatggcggctgccccctctgagcgtccccaacccagaactgcaggggatatgaagcaagctggacttggggagacatctctgctcgagtgcacgttggcctgatgacgactgctcttgggttcacgggttccaggctctgcccgggagcctcatgcaaactggtcccgttctacagacgaggaaactgaggcacagagtgattacggctgtccctgagctcctgcagccagtaaggtgatacaccaggatgtgttcccaggttgtccgctgggctcagtaacacagtctcaactgccctgtgacactgcgtgtctgtgcttgtggggaaggtgaccagaggccccctttcctccacgcggtgagcctaccagcaaggagacagtcctcaggtgtgaggatgagcctcgtagtaggcacagagaaacaggaggaaccttctggaaggtgaagcctcccacggctgggactcttggagaagggcggatctctgtccactcctgcccactccccagcacagacagagcaagcaggacagagggcccaacgtcccaggatactgcagagctcaaaggagggcagagagcatcgccccacatgggcgccgggagaaaggtgggcggggtgctcaggggcccctggccgtcctgaagtttgcctcagagaggtgtgggcttctcctccctcccatacacagtgtctctgaggatgaactgccatgtgcccggcggggatgccgtccctggcccttgctgagtgcctctgggacgaggtcagctgagcctgccatcctaactcagacaccatctcactctccaagtcccttctcggtgagacggggggccttgcacccacctcccagcccccacacacctgagggggtccccgttcccctaccccgtggctccaccacgccccacgcatcctacctgagggacagaggggactgtgagatgccccccacaggctggttttcctctttcacccataacaggcccagcaaattctcacctccagaggccaggtctgccccgcaggtcttaggaaatacagccctacttccatccagcacaccaacccaaggaagtgcctcggagccctggggcccgaggggggcctggccttggtctcacggcggcagctccacctggagaggagtgaactcaagccaggacgccccgtctccacagcggaaaccgtgttgccggctgctccctcctggggactctgggcctgaggttcctgtgggagttggggggatagctgagtcctatggaggtgcccctctcctccccgcccagtggagcttggggtggggacaggcgaagacagggtgagaagcacggggcattccccctccacacagcgctgagaaagtaagggagcatccagaaaacggtgcccacttccgcgtcaggcggatatcacgggcaccagctccaggtgaccctagcccagccagagaacaaggaccaggttgtgccgcaaagcccgtgtccgctccctcccgcctgggaccactgtggcgaggggaagggagcgtggtggccctctcctgactcctgaggcctgaagtccaagctcccggccctcaggcaggccagggtctagacaccgctgccccaaacacaccccccagtccccgcccgcaggcttcctgcaggatcccccagtgcacctgggggctgaggagagtgagcagggcgcaaagaagcttcgtcgggagggcggtccccacccgccttggacccccggggatagtgtcctggggcctgggctcagatgcaccctgggaggaatggtgcggaggctgttttttgctccaagaggacattgcctcagcagagggctgccgagctgggaggacccacagtgcaaggccgcagaaccccctaggaagcctcagagccttcaggttccgggctgaggctgtgggcgtggacccttgtgcaaaccccactggaagaaaaaccttacagctcaggaggaggaggggccccacccgctcccagagcccgtaaacgaggggtggtgcccacatgaggcctggggaagggctggggctgggacaccccctcaccacccccagataccccaggcagcccctccctccacagagagacccactgggcctgaccctgccctgggcacagggtcgagccagggacggcccgtgggagaaagacggcttcatgggccgctggccgggccaggtgcgtccttccccagttctaggtggcaaatggggtggggccagagccttctggctagggaagacactggcctggttggtgtggcaggggcagcgaaggagggtcaaaggccactctggcctggaagagtccccagccacctggacgggggtagccaggcctggtccctgcccccactctccaaggggtcggggcagccgggcagagccagtaagtgtttgttttcagatgacatttgtaaagaaaaacagcctcccacactgcttgaccctgtgtctggaatgtggggaggcaaacagctgtgcccttcccagaccctgcacagcccctggtgggggcagggccctggtgggagcagggcccagaggtacagcctggggaggcaccggccattgtggttggagcgcggcagccaggctctgggctctgttccgggcctcactgtgtccccagtggggtgccgccaccacccccccagcctgggccccgccggtcagacacccgcagggacagcttgtcttggctagctggctacagcacctcgctggagtccagcagacacgcgctcccgtgcgcacgctgcgccccaggccagccctaacgccgctgctcgggtcaggccccccgcctgccgtgggctgctggctgccttggcccgccccagctctctccgcgcccctgcctccagggagccctcctcgaggactccagccacccaagctcagcagggccagcccgagcccctgccccacacagcctgtgtggagggtcctcagccccctgatcccccagaccctcccggcagaggctgggtccctggggcttggggaaagccggctccatggcccctggcctggatgatttcccagaggccggtcccctgccaagtgcctggtgacccttgttcctacctggctgcccatggtcctttgtgcgacccccgcccacagcccaggagctgggcaggagactctgattgggtggcagcagagccatcctagggctgcccctgaccctggccctgaccctgccctggagcctcgtttccaaatcttgcctcatgctttcgccagacccctgtggccccttcccgaccctggagtgcccctggggcttcctggaaagggcctctcctttgctcacagttgggtgccgaacttcaccagcattgaccacccgaaggcgcagggacacccccgcagtccctctcctgggggtcccatcaccaactccccatgggcgggatatcagaagaattctctgcgcaggtgctccgccccttcaggcacaggggagggcggctcaggggccaacggcagacgttggtgcctgcccctgcagcggggtgccccatgctgagacagcacacacgggggacactccgggcctcggtccaccctccatgtggcaaatgaggtgcttggcggggcttcttaactcttcaccctgggctccccacgggtcccttcccttccccttgggggccccggccccaggtccccaaggcctagacctgcctctgccaccctcagagcaaggatgcgctgcagagggagaggggctgcagctcggccccagagctccggcttcctgtctcccagaccacaaatcactaaaggccgtgggtcctgggacattgaaggcccaggaagctccttgtgttgagttaaacatagtggagcagaggcatggagctggcatttcccacgcttacgaccactctgctacgggctggggtggggctgggaatcagcttcccctgcgccccgccatcccttgtccagagggacccgtgggaaggccaggttgaagagttaagaagccccgccgagcacctcatttgccacacggagggcggaccgaggcccggagtgtccctcttgcgcactgtctcagcatggggcaccccgctgcaggggcaggcaccaacgtctgctgctggcccctgagccaccctcccctgtgcctgaaggcccagcacttccagggctgcccgagctgaggacctgtgcagagaactcttctacaccccacagaggaggctgaggggtcgaggcggctgcgggagccccagggggccaccacacagccatgcctgcccctctcctcggtgggtgtagaaagctcttaaatggtggaaaaacaagggcatggccacattgcacaggcacagaaggttccagaaggagtgaaacaatggcatggagggagcagagcctgggccggtgggggcacagggatgaggccagtgaaggccacgggttggggggtgccctgaagccaacgaccccatccttatcgcctgtgtctctctgcacacagcgtctcgtctgcaaagttagctgagcaaacgccaggagccaagggtcgaggcaacgatatccgtggggccactccacaccccctctgcctgccccatcaagacctgctttcctggttgaaatccaactcacgatttgcccccgggggcccagcagccctacccaatggagcagctgcacccacattgcccagcttcccaggcggacaggggcttggtgagccttcctgtccccactggagcatggccggagtgattttctgcttctgctgcagatcaccctggtgggagcagctgtaatcgcattatccccagttatgcctccactgggcactggggtagggacaggactgccaggacacgattccatttacctaacgccagtggagccctgggggctctcctaggtccacggggaggggtggccatctctctaggcccagggaccccaggacaggggtagaaaaccacgggagagttaaggagttaaggccagaaggggccagtccggccaagtggggcaaagctgtccaccgttgggcagggcatgactgaggggcggtgtggggaacagctgctcatctcccccaggcccatgcccgtgatgaactgtgtgactacccccaggatcagtcaggaagcttggcccaggagcctgtgcagacctaacagccagctccagccccgaggcagggcagctgtgctccagagggctcccggggccgcactgtccctcccaggtggacaccctcgtggcacgtacgcccctgctctcagccctctccttcactggatggagagactcgggacccgcagaggtgggtggcgggcagaggaggtggagctggtctgagacgcaagacgtggcctgtggattctaggagcaactggtggcttccaaggtcccccacccactccacacatgttcccaaaccccgttttgcagatgaggatggcaggctcagcacaggggcccatgtctctgtcaccaggcaaggtgggggggctctagggccagaatcgctcccacctccagccggggatcagaggtctctggttagcagccgaggcgagcgggacacaggctgagggatggggacagctgctcgcccggcacagacaaggctcccctccccatgctggagaccccggctgccccatcagtcacggcccacccaggaccatgcaatcatcctccacttctcctaatcctcctgccagcttcttcccaagagtccaagcagttggatgcattttctaaattctcaggccactgctgtttcctcctcaaattccttgtcccccacccgtggccccctcccagccatgggaaaggactgctgcggcctccccacaggcctgtgcacgggtggggctgcgtccaggcagctgtgaggtaccggggacccaggggtaagagccccgattacaggggcgtcatgggaaagtggcgaggggaggccacccagggcccccaccacagccccgctccacatcctcccctgatctctggccctggaaagaatcagatgggacccccagcagcagtcacttgagtcccactgccaccggctgtgctgaggatgcccactgggccgtgctgtggccacctggcttgcagtgtgggcaccaaggtatcggcccagattcctacccatcagagcaccagcacagggccgagccagtgccacagagcccctgggctgcagcacgtcctgcacgtcccacagaccggcctgccgggagggaggggtgctgcccagggctcggtgccctcccggaaggggcttcagtggggctgtttgccaggtggtggctctgacgcaggagaggacagatgggcagagcccgagggcagccctggccaggtgcgtacagtggtggctgtgacgccctctcccacgcctgtctctgggtccaggaggagtgatgatctccaggctccagaggactaggaacagcaggcaggctcgctgctgataacggggacttctccacctggtggggagtgatgaggcaagaccggatggcaggccccaggcctctcctctccagggacagccatcatctcctcgcctgtgcaggtctcaatcagtcagtgattacgcaaccagcaaccagcactttattgccggttgtgaagatctggaggacatgcgggtccccggggccacagccttcccgcatgggtgagcagtaagctgtgcaattagccctcaggccgtcatcgccaggccctgcctttgttcctccacctgccgcccgccggaagcctcccacaacctggccagcctgctctttctccccctccactctgaccccttcctcctcagggccctgacatgcagctatctggcacccagtttcaatacctttttctttctttttttttttttgagacagagtttcactctggttgcccaggctggagtgcaatggctcgatttcggctcaccgcaacctccgcctcctgggtccaagtgattctcctgcctcagcctctgagtagctgggattacagacatgcgccactacgcccagctagttttgtattttttgtagagacacggtttcaccatgttggtcaggctggtcttgaactcctgacctctggtgatccacccacctcggcctcccaaagtgctgagattacaggtatgagccaccgagccgggacttcttttcttttctttttcttttttccagccctcaactatccgtttcattaaaaaattcagaattctctcccctgcctgccaggatgggacccaaaactcgggcaataggcctgcccgagttgtggccctgggcctgtccccgacaagtcaccctacgttttccattccaccatcctctctctgcacctcaagcaccgtgaaccctctcccacctgcctgacctcgccgtctccaaaggagaacctttcttgtgtcatcccgccctctctaggcccgccgtctgcctgggggctgccctggtggctgtgctgtgtctcccactgctgtgcgcacggtgctgcctgctctttgcctcagaggcactggagcccatgtgctcgggggggtgtggccttcgaacactgtgagtccccacatcttgcctccagaggccacagctggcctgggccaagcctgggccacttcctctgcagtgaccaagagcagggctgcctcgagggtttcggggcaggagagagggaacaaatctcctggaggcagatgggggccacagggaggctggaggcctggaacccctcccagagagccagtggagggatgctgcctggcagatgggagatggcaggcgggtgctccaggggctcctccctccttgtagcaccttggacatgttttgttttattatggtgaaaatatgtaacaaaactagccattatagccattgagccactgagccacggagccacggagccacggagccatggagcacacacatcagtggcactcagtccattctcactgctgcgcagccatcgccaccatccacctcagacctcctccctcttcccaaactgaagctccctgaaggtgcccagcctccttgccagtagatgagatggggaggcagccctgctcgaccaaggaggcagaagtcttgattgttctccctacagtcccacgggaagcacctgcagcagggccctggctggacagacggccacaaggggtgtggtgcagtgatcgggtgccctggcctgggcaggagagtggcgcccttggcctgcccagcccctgccctgcggcccgcctgacagccgaggggagcttcaccttccagcctctggctgtcattagctgctcccggtgggaggtgggaccggcaggggaagctcagtcccacagccagtgaggatccaggctcaagcggaaccacctggacctcattattcttaagtggtccagtctgaaagtttgggaagaggggaggaaaaaactgccaatccccacgcctggggagccccaccccctcttcaagccagcactgaagccctgggggtttcagccacaatggagagctaaaccgggcccaccccagggcccaggaggggcatctgtagagggttcagccccaggaggacttggaggtcaggcaagccaacgggagttcagagcttaggaggggtgagaggtcagactctggtcctttctcatcacctggggtccgtctgtccttccaggtcacctggggtgtctacagtcaaggccagtctgacaggtgggatggtgcttcccagcaaccccaccctgaggagaaccctgctgcctctccctgctctccacccccagcacaggccccgggaagcctccagctgatgacgacaccaggacggtgctgagtggaccctggggccagcatcacaaggcacccaggaccccagaccacccagccacaccccaggctacgaggagggggcgctccggcgaggctggggtgccttcaaggtgcatcctagcaacatcctccacctgcaggagggacactcggtcacagcttggggaggatgtgctcagacggcataggaaggatttgctcagaccccatggggaggatttgctcagaccccgtggggaggacttgctcagaccccatggggaggacttgctcagaacccatggggaggacatgctcagaccccgtggggaggacatagaccccgtggggaggacttgctcagaccccgtggggaggacatgctcagaccccatggggaggacttgctcagaccccgtggagaggacatgctcagaccccgtggggaggacatgatcagaccccgtggggaggacttgctcagaccccgtggggaggacatgctcagaccccgtggggaggacttgctcagaccccgtggggaggacttgctcagaccctgtggggaggacatgctcagaacccatggggaggacttgctcagacggcataggaaggatttgctcagaccccatggggaggatttgctcagaccccgtggggaggatttgctcagaccccgtggggaggacatgctcagaccccgtggggaggatttgctcaggccccatggggaggacttgctcagaccccgtggggaggatttgctcagaccccgtggggaggacatgctcagaccccgtggggaggatttgctcagaccccgtggggaggacttgctcagaccccgtggggaggatttgctcagaccccaggcaggcatcatgaatgcgcccagcccggaccccagactggtagctcctaccacacgcggagcagcagaggctggcaagagggactcaggacttgggctggggacagagggccctgcacagctctggggtcctgacccaatcctgcatttccatagagagctgcctgggcacccatgctgagggtccctgcaccccctggtgtatcggagacccttcccccaccccctatcccccgccactgagacacaggaatgtacaggatggctgtgagggcagaggcaggcccagggcgcagcaggcagggctgggcggggctggggatctgcaggaggttggccctggagatgggacatgtctggaccctcggtgtcatcacctctatgttttgaccactgagcaaaattacactaaatgaagcacaaattagccaaggggacagtcgactctgtcctttcttcttaatccctctggctcagggtttcccagcctggacagcctgtccgaggggaaggctgcccaagggcacacgggcatcggtccggggacattcaggcagtgaccaatccctggccaccctggtgtgtgcccggcaatgtgggccttttcccagacagccagtgggggagcggctgctgtgggtccctgagtcttagccagatggtcaaggataggacaatgatggagacccgcatgcggccgcatccatgggtaaaggaggcggaacggaggacagctctgccatcccctcagccagccatgaaaagcaaccctttcccctaaggccccagcaccaccttggaggccaccatgggctggagcccagcacagccaccatcgcatcttggctgtccagctcaggacggccagttccaaggcgtccaggctggagctctgggggcggaagagcacaagctcctgaagagcctctggtccagccctggcagcggagggccaggtgagagcctgttgagggctctgaggactccaggagggactggctgaggacaccggtgggggtaatacctccccctccaatggccgctcgcaggaggcaattcccagagccccgctccatgggccaccaggtacccagagcctcatttagaaatggccatgcctccccacaggcccccgctgggatcctggtgcttcaaatgtcctgctgtggtcccagggaggagcaaaaccccctcccagtcaggaagcatcctcaaccgcatctaattccagatgctacctcccaccttggctttccaggagacggagaacggagccggcccctctccaaggccccgaggcccggcagggcacccctcggagcagataagctcacccctgctcccaggacaagcaagctcctgctgaggctctgctactgctaattggcccttgggataagcagacctgtccaggaaagaaccctctccctgatctcctggccccagccccatccggccgggagttctgacttaagcaaataatcagtccagggaattggaggctcaacagaatcgtcctccaggaatctggtcttcgttcctccaccctcctcctcccgtctccgcccggggtcttgagatcaacagcaaggttttgcactcgtaggggcttcccggagacaccctccagcctcaacccagaggagatgggtgcctgggccgtgacccctcacacaagaggaccaagcccagagaggagacgggaagccatgcgcccggccagctggggtctgcgatggactcagtggggtccagccctcctcactccaaggggagctgggagccgacccggtgagggagggcatcctgggaaagtgacaggaatcagggaatggccctggggctccggacctcctctgatggagtcattcaaggcccttggcagagctgggcatcctctgggccccagggaataaggtcccctcactccaccacagaacagcatctgggcacctacctgttggccatgggcagagcaaaactctctcctggaccccagtgcccagagccctggccttgggagggagctgtgcatcctcaggagcccccccgggctgccccccaccaccctgcaggcagctcaccctcccaccccaccagctgcaggtgcggacacgtgtcttctccttccccaaatgctcgttctgcacctgcttcgggagggcagtcctgcctgctcacagcccagccctgcccgaactcctggccatgtgtggaaacacacgggcgttagaacatggcatcccggttcccttctatgttcaggaagacgacacccatctggctgaggggatggcagagcccctctccccacagccccctctgcagtgcagctctcctttcctctccccgcatgcctcttcccgagggcagccccttctctccatcaggatcgcatgcctcttctcgagggcggccccttctctccatcaggatcacccttcctgggcctccggggtgcaacgggcgggcgctgtttcccccaagccctcccttcctccctcggggtggggccctttcctccaggctcttctccgtctcctggtctctgccatctcccaaaacccattctatttctccacatgtctacctcgtcccccatccgtctccattctcctagtctcccgcctgccagcccggccctggcaccagccacttggcagcctcctcctcctcctcccagaaccttctctttccttcctggtcccatctcaaactgcagcaagctggtcgaaaggtgagaccaggctgggaggagctgtgggccacggagatggtggccgggggaggtatgggaggtgggagggcaggcgggccaggtggggagcagggcatcttgccatgggaagggctggaggaaacaccgcatccagggatggccagagctcgcctggagcccctgaaggtcttgcttttagagccgggtggggctgctgtgtggccaagccgggcgagtggccccatccccgggtcctgggctcctggcgtctgccctggagcccaccatgttgcagtactgtgtggccgtccattgctgctctcttcactgtatgaccgggggttccctctgtgcccctcaaagccccaacttgcctggactttgggtctgcagctggcgcatgggaatcttcccacatggcagcgtagggtgactatggagccgaccaaggctgccaaggtcttacttgagtagaagacgtccatcctgagcgatcctgttggccggtcctccggatccagccttcctgggaatgcggccacccacaggactccaagcgggtctggggtccctggtcccccaggttgaccaccccttgctgcagctgctccggaaacagagggtgctgccctggccattttgctccttgctgggtgtctgggagggctgcgaggggaggaagaagggcagggagaggtgagagacccgagagaagggggaaggagtctcaaaggaggggagggacggccggccagcactgtggcgcagtgtgcaggaggggaacatggcggtgcccggcacgaggtggggtgcggggcagccctggagccctggctgcctctcccagcagtgggtccggcactagctagccagctgagcttgctgtgtttggagtctgcagaaagtgctgccccgccaagccccacaggccaagccaggcccgagggacaggaaggagcatggggccttcactcactgcccagcccggggcacggccggcccatctcccatttccagggcatccggggacgggcacgccccggatacttactgccctgtcactggaggttagcatcctccctcgtccggtgccctgcccaggtggctgttacctcccctacctcctccaagaccctgagcagggggagaaagaaagtggacagaggcacccgacctcctgacctgagtgtggtccccgctttgttcccccttcctctgcccccagttctcactgcgaaggaggagagggctcacctggggtggccccacgtgcctgccagccttggtccaagactgcagagaagggtccctgaggaggtggggaggaacccagaggcagatcctgagggtcttccctgaaagaggagggctggtgggcagcaggaagatccgggattgtgccctcagctgccctctctgtcctgacgtgtcacccgctaagggtcatgggccaaggagggaacgggcaatgtctgggagccatagagttgggatggcccggccaggctgggtgtggggtctgttggggatcccaggtgaggggaaggaattgggagtggacctgggcccgaggcaggttgggtggctggtgcaaggcagagggctggccccgggggcattctgtcctggttcctctgtcccctcacccagttcgtgagcatccctcgtggagcaggccccagggagatcacgggcggcgggtgggcagatggagtgcaatatcccccaaggaaagtgtgttgtgaggtggtggagggcagggccggagaggccccagctgtggagcaggacgctggagggctcagggcagccgagccagggcccggggcagccgcaaagtggcactgtgttcttttgggccggaccagagcccaggcagtgtcaggaggtggatggtgtggaagagagaggagttccaggggcgcactggggggccctctgtgtggctggaaggtggaggggcgctgggtggaagggctggcttcgggctggcggcttgggctaaggcaggcttgcaggggctggctcctgaacccacgcatggcgagaagtatgggctggagcggccacagcattggggaaagacagatgggagggctggacaggaagcagggctgtggccaggccggggccccgggaggacagggacgagtggtggacgtgagggtgcagaggagcaaagtccaggacttggcccggatcgggatgctcaggaggctggggatgctcggaggaaagcaatgggggagcccggctgcctgccccacccctgccaccctcagctccttctgcccgccaggactcccaggctccatcaggtgccgcagcaccctggctgcgacataacgaggtgggacagggtcagcaaggtgacttctcgtgccccagtgtttgcaaatccccaaaatgacccaacagacaagctcgaggctggattttccaagagggccccttcaagtaccaaaggacacaaagagcaggcccttctgagtctgcggcccacagatggcaacacgggccccggaccccaggaccaccttgggcacagagcggctgggcccaggaggctggcctctcccggggatcccacggctggcctgcggggctgcagcaaacacgtgcagggctttccagagccccgcacagaacaaagaacaaaatggggagagcagggcctgggctgaacggaccacgggcgggtgggcggaggggcacagcggcatggcacccactgccaggccgagggcagctgcagggggctgggctggagcagacccggggtgggggtgggggctggaggaggctctcacggccggaatcaataactcacactgggggagggcgggagacgcttgtggcggagcggggagggggtgccggacagggtgtccctccacccccaagttcaaagttttatggcgagcaggcttgacttcctcccgcgtccctcctctccaggtgttatttgaaaaaaatacttttcaaactacatgctgaaaacttcagcatgaaaatttaatgtcagaaactctgtaatctctttcccagagataagacccagcccctcgaggaggggcgaactcgatccctctaacacagaaagcagacgccaggccgggaaggcaggggcctggcggcctcactgggggaggctcaggctcacgctccctccctccctcccacccgcggctgggagggggtgactgagagaggccctgcagggctggagctgcagggctggggcgaggggtccggcaggaggggccgtcctagtgcagcctgcaggcttcgggccttcgggaagcacatcctgccgctctcccgcgtgcaccccgctccccggaacttggagtgggtgccgctgctgccaaggctcgggtttccatgacggctgaggcccctggccctctcactcagaccctaacttaggcctcgctgagggctcaggttgtggacagctaagctggggaaggacaacgtggccaccaccgcccacggcctttctgaccggcagcgccgccctgggttgggtggcgggggcgtcctgcacacacgactcctgaggtcaagcctgggtgtgggggtcttggactctgagctgccaggcccgccgggtcctggcctcagggagaggggaacggagctgccacacacccggctcttgactcgatttctctgtgggggacagacataacttctccaagctgtttccaacagcccccaccctgaagacggcctccacctcagacatcagacaacgcccc

SEQ ID NO: 2184 - DNA, 5743 bp, Homo sapiens
caaaaggatgcagggaggctgctgatttccactgaagagctaatttcctgtgagacattaacagtgatttaagaaaaagattcctgtaactggtaaatgaatttcatttgcttaacttttagatgatatgtttcaggcaaaaaaaaagttgtgcacccacttatctctttaaagcggaggatgaaaagcattgaataggtaggattcttaatgtctgagatgaaggcgatgtaggaggcaaacaatacggttaaaaatgttgagtcgacccaaacagaaagaccaggtttcaatccagactctgcggcttactgagaatatgatcttgagtaaactgcttgaccttcctgagcctcagctttcttagttgttaaatggactttaacaatactaatctgttaggactgtggtgaggatgaaatcagggaaatcagtcacagcagtgctctcctggcacagtaatgtcttacaataacagaatgcaggagagcacatatcaatgaagaaaagacaaaatgtacttatccatgaagctgaggttaagaaaccagtgtcttcaagagccagggacagcactgggtctgtgcagagttgagagatggtgatgacatgtggtttccagcattcctcacccagtccagggacactgtgggtgtgcccagcttaagtccagtaactggaaatacaagcccaagttctggagagtttgagctgcagagatatatatgggaacactttgaatcttgactcattggccataaccagcagagtggaaaatacaagaagagaaaaaaacattgaactgcgattttataacatcctttactaggcagagagaagaggaaacaccaggaaagaaaactgtattacgatgtgaaaacttaatgttgagaaattcaggcatcttggggttagtgaggagaagttttaggggcttagattcttctaaacacatgtacagaaatgcatatttcatctgatatcaaatggcatttatagtgctaatctttacctcaagacttcacatcttttggtgattgcatcttttaggtttatagcagctaagtttgcatgaaaacaccagggctgtttcatttcagtcaagaattaatgttcattgattgtgcttctgcatttcatgtaactattgtagaatttgttttagttttatgagggaataattgttccaacttctatataactcaggaatttactctcaaacaacactgtcaattagttacttatctctctggaaatgatctgggaacatggagaggaaagggaggaaggggcaaaatctgaccacttaaatctaagcatattagatcattttatgctagaaagtcctgaatgatgtgactttcgttcttgtaaaacacctctttccatagattcatggcccaaacagtatataaagagtggggaaggaactgcatttgcaaatagttcaaatcattgctccatcttaactacgcagttcacaaagtgtgaagaaatgtgatcatctcaaaaaagataatggggaaaaaatatgttttgttctgtgactttaaagtcttgcaatattttacataaatgataatgggtgctttaataagaactcttgatacttttgttattgtattcaatatatgcatataatacaacaggatgatattgttttggatttggaaatgtattctttcttatgcaatcttatgcagtcatactgcttgaatatcattacctgaatttatctttcttttttttgttgttgttttacactctacttatttggtgcctgtcagtcttttgtcgtcagtttatattctactaaactcaaaaagacaatctcataccttttgtaattgtaggcattctttactagatttttaaatacacttcaaaaattcaagtactttgatttcatgccatcaagtagctgaatctatccccccgtctctttttaaatttaagtgagtagttcaatttctgtcactttctactttgtgaattctaaatcttttaaaaccatcttgccatttttcgtgcacttacccttacagaaaactctgtgaaacactacttatctctacttttatgtttttaactccttttttatattactattccctctgctttctaaatgcacatattaatttgttctttttattctctgtagctcttctcagtgtatgaattcagtttcccatcagtctccatacaattaaaaaaaagttgagtattctgttattttaataagatatctagtgcccatattctaattctgccccttatttttaatataattttattgttgatttaaaatgacaacagtttcaattcccagaaagtgaaaggaaacaaaggaataatattataggcttaatttttatcagtgaacttgtaggtgaagaaaagatttggggaaggaaatgaacatattatattgcaaaatagtaaggaacaatcagatgtgttttctagtctctggaaaagcatgtttcaagaaattcaatgaaaagttcatcatgcttgcttagattgttgagaagcaaaaacactgatgaacatttggaagcaatgagaatgtaattctaatcatactcttttaataatgttgcaaaactctccaaacactactctgtgtggatgtctttcagaatatgatgaatactagtagtcttattctgcccttttctctctatcacaatatatacattctatattgcatacacatattttccaaatattacatataatttcatgtaatttatagacctattaaggcccaaccattttcttggataggggattctttagaagtccagcttaaataaagcccgtatagaaagtttttttaaaatttatacataatcacctaaagtaaccttatctactgaactcttagtacatgctactggaaccttttatcatgtttcttcctggcttgcattacaacactgttgacatatctcagccttacttctaggcttctttgagagcatgactcatgtttgtattcctcactgaggttgaatgaataagagaaactacagtagtaggaaaaaacagtacatgtacatatcaatgaatatgaaagggtcaaatggatctattatagtaagcacaaaatcaactgacaccagcaaagtaaacccaaaatttttaatggtattttaatagatcaagaggagcaagcagatttttgagacagttgtctcctactttctctatcacagggagtaattttaaaagaaaaatggagggtaagtttctttaagagaaaattgtagtttaaaacaggtcatgggataattagaaataatttaatttctttagaggattttaatctttcaactgcttgcaattagatcctaaggcaataaaagaataaggagatttggaaaaccattgtctgtaatctctgaagaaaagtggacattaggggagtcagttgaaaagcaaagctatcaccattttctaaagaggaaaaaggtgaacctcacaaactatagaccaaaaaaataggacatcgagagaaagaatatgaagctagcataggttcacaaagaatgagtcaaatcaaacaacatgcattttttatttataaagcatgacttgttcattgtcaattcatgttagcttaatcattaggcattaatgccatcactgcaatgcatatgtcagcaataaataatcaaagaccaggcttccatcattctgtttaatatcttcaagtaatgcttaagtttgcaaatgctcttttaacacattctccatatgcagcctgcccagcactgcacacaatagacctgttacttccccctcacgagcactcctaatatttcatgtgctcatccaattgacttctcccactggtgcctcatattgaatttgtagaatcacacctgctcctttttcaaaactcttctgagttttttcttaaataattcactgaccccaaagttgtcagatatttgaagactactcgcacaattttaatattataaatgtataatgtaaatgtaattaagatttgtataatgtacgatgtactttggtaaataaaagtatgctgtgaataaatacgtatgatacaattcaaaattttacataaatatgtgataaaatttagctcatattctttttttttttctttgagacggagtctcactctgttgcacccaggctagagtgcagcagcatgatctcagctcactgcaacctctacctcctgggttcaaacaattctcctgcctcagcctcctgagtagctgggattacaggtgcccgccaccatgcccagctaatttttttctatttttgttgttgttgttgtttttagtagagacggggtttcaccatgttggtcaggctggtcttgaactcctgacctcagataatccacctgcctcggcctcccaaagttctgggattacagacgtgaaccacggtgcccggcctagttcatgttctttaaggacaattatgaatatttttatgcactgttaattttcattaagatattgatcaattaatagctatatatgttctataaattaatcctatctagtttcaatcttaaattgtttgcatataccaatctagtttattgtttgcatatattttatagtgtagagattaggcattttaataaaattttaaaatttccaggacatactgttaatgactatgcttcctactataggccataattaatttttttctattgtcaacaatattttggtagggatgatcaggaaataaggaaatgtttccttcatttgttaacaataggtgtttggggattttaaaatgaaaattgaagaagtaaaagacaccatatatttagtttgtttgatttcgtggcttcaagagttcaataatttattgaaatattttacagaccaaagaacaacagatatattacgtttataagcccccacatattttaaaggataatggtttatatatgaaaattccctgaacctacacttcatcaggaaaagctaaataaaagaagtttacatttcctaggactaatggagatttatttcccagtcctcttctctggagacaaatgtaggtctctcttgaaaagcagaaagttttgcatatgaggtatgatttagtgggctagaaacatcttttccaccctccccaaaatgtttcactatgttttatcatactatctgataattttgcatttgattctttcatgccttcagttatactacttcttaggttagttcataagggtttccacaatttggttcccacttaaaatttaaaacttccctaacccattcccaccatatattgtgctaatccatgcatatgtgactttgcgtatgctgttttcattgtttaatattcttctcatgcattcgttctttcctgataacgaactcatctttgaaactccccttcaagcatcctctactttaggaggccgcttctcactgtctcctgcctaccacccattgaattgttcaatttttaagctgccattgtcttgtgcagttgacacatttctttgcaattactgatttacatgtctgcttttatcactggtgaggttctttaggacagagacattattaattcatctctgggcacatatgttccaacatattagaagtactacagagtgctattactatgtagtatgtagtattagtagtagttactcacaaatcatttttaaataagtgattataatatctttttgttattatgatttaacacaagatggaattta

SEQ ID NO: 2185 - DNA, 10638 bp, Homo sapiens
agagttttagttgcctgtctctgctattctgcgtcctccacctcgggagccccaggaggggattgtagcatattcctaatggagcaccaaggtgatgtgacactgctgcctggtccctgccctcagagaagattgtgacatatcactgccccgaaacccaggtgtgattgttacatacacctctgcccagcacctgagtgatttgactcttctgcttgggcccagcgtacagatgggattgtgccgcattgctggacccagcacttaggtgatggaccttgtgacatatatctgcacccatgacctagaagatgtgacatttattttttgcctgcaccctgccctgcacaggaatgattgtgacatatccttggaaccagacaccaggtgatgtggctcttctgcctctgtcttgcccacagggagcattgtaacatagcgctgagctcagcacccaggtgatgtgactctgttgcctgtgctgtgctttcaggacagaattgtaacatatccctggctgagcactcaggtgatgtgacactcctgcttggcttcttccctcagcagattatgagatatccatggctgaaatccaggcacctgagtgatctgactgtcttgtctgggaccagcccacaggtgggatagttctgctgaacccagaactgaggggatgtgactcttcttctgtcttggtgctgctcgtagaggacattgtgacatctcactgaaccttgcacttagttgatggggaattgtgacatatcacttggcccagtaccaagcaagtgtgactgttctattcatcataagtcctgctttcaagggagattgggacatattgtggggctcaacaccaatgtgacattactgttttgccttggcccagaccttaaaggcactgtgacgtattgctcggctcagcaacaaggtgacgagagatcctgtgtggacattgacaacagagagcattgtgacatatctttgggagcatcagctatttgatgtgactctccttttataccaaggctttgctcataggggagaccgtgatgtatcttctggcccagaaatcaggcgatgtgtttctcctgcctgagctttgctcacagggagcattgtgacatatcactgagcccagcacccaggtgatgggactctactgcctgtcccctgctttcaggaggaaattgtaacatatctctgaccaagcacccaggtgataagtcttctgcctggtgcctgttctcagggaagattgtgacatatccctggcccagcaaccagatgatgcagatgacgtatctctcctgctcactctctatccacaggttctgcccacaaaggagattgtggcatactgctgggcctaacactaaggtgatgttacttctctgctttggctatgtccttagaaggcattgagacacactgctgggcccagcaccaagatgatgtgagtcctctgcctgaaccctgaccacagggagcattgtgacatatttcttgacccactgcaatctctcctatggacaaagcccaggtaaatgccctattttacctatgtgatgtgacactcctcttctgcctgggccaagcacaccagtgatgtaattattctgcctgttccctgcacacaggagtcactgtgctatatatttgggcccatcacctagatgatatgactctcctcttccagggtttgtcctcagtgagaattgtgatatatcgcttgacgtagcttctatgtgatgtggctcttctctcatgcctggtcccttccctctggggtgattggaacataaagctgatccccacagctacgtaatgtgactttcctgtttataagccctacccacagggggcattgtgacatatctaggcctctcacctaggtaatatgacatttatgcctagggggtattgtgaaatattactggaccaagaacttaggggcccacaggaggcctttgttacatatctgtgcatccattactttggaggtgtgactctcttccatctgcaccatgcccatacagaaaattgtgacacatctctgggttcagcaaccaggtggtatatcttttgtgcccaggccttgcctgcagagagacatagctgggcccactacccaagtgatgtgactttgatgactgtgccttgctttcaggagggaattttagggcaacagaaccctggccaggcaaccaggcgatatgcctggtttcttccctggaaaaattgtgatatattcctgacccagcacccaggcgatgttattctctcatttgctttctactcacaggttggattgtgacatatactttagcccagctcacagttgtgataatgacactcatactgacaaatcagtcagtaggagagatactggcacttgtagctaaacttagagaaacaggtaaattattggggtcttctctaggtaagaacattataaagcataaccattctttcacagtttgtataaagtctttggatggtacagagtgtcatcacagggtcaagcacacaggtgagactgtgtttctcatatgaacaacctaccaaatgttggcaaacctaccaacaccctcacacatggacagagctcactggaaagatcctgaatttcacacgtggatgcagtccacagtaaaaattgtgactgtcatatgtgatcatgtgaccacagtcaagatgttgactcatttcaaaacaaagctcataggcagatgaggactcttctctctggtcctagccaattagagagatgttgactctaacacatgggcttaggtccatagctacgattatcagttcatactagaacagaattctcagagcaaattgtgactatcatgcatattgtataaagccctcagatggtaacagagagttttgtaacagggcccagcacacaggtgacattgtgatactcatacacacactcagccaacagtaaagattgtcatcttttcatatgaacacagttcattgttgaagttctgaatctcacacctagagatagccaaaagttggaaaattgactttcacacatggattcagtccacatgtgggctggtgactctcagaccaagattcagcgtatctgtgaggctgtgagtccactaaggggacacagtccactgcaaagattgaggctgtcatgcaggtatccagtccaccattgagattgtgacttgtgtattcagactcaacatacaaaaggtgttgactctaatacctagaaatgggacatgtgtggaattgttaatttttttttttttttttttgagacggagtttcaatcttgttgcccaggctggagtgtaatggtgcgatctcggttcactgcaacctctgcctcctgggttcaagcgattctcctacctcagcctcctgagtagctgggattacaggtgcccaccacaatgcctggctaattttttgtatttttagtagagatggggtttcaccatgttggccaggctggtcttgaactcctgacctcatgtgatccacctgcctgtctcccaaagtgctgggattacaggtgtgagccaccacacccagcaggattgttaattttatccctaccttttccttcaactgtgactgtaacatacacctctgcccagcacctgagtgatttgacttttctgcttggtgcctagtccacagatcagattgtgatacattgctggacctaacactaggtggtgcgactctgtacttttgccttggcactgcccacatgggacattgtgacatatcactgggcccctcaccctggttatgtgactctcctacctgtgccctgccttcatgggtcattgtgacatattgccatttgcaacatccaggttatgtaactctccttgctgggtcctgcctacaggaagctttatgatctatctgtgtattcatcatccaggtaacgtgactctttctcccaggtccctgttcaaagaaaggattgttacttatcaatgggcccagtgccttagctgatatgactcttctacctatattctgcttacagtgtacattgtgacatactgctgggctgaacaccaaggtgatgttacatttttgccttggcgtttcttttcatcaagcattgtgacatattgttgggctcagaaccaaggtgatgtgatccttctgcctgaaccttgctcaagagtcaacaccttttgcccaacaagaatagtgacatatttgtgaatccatcgtctatgtgatgtgactctcttacttggatttttcctataggagagattgtgacatatcacagggcccagcatctagataatgtgacgcttctttccttccatggccatgctcccataaaagagagtgacttatccctgggatcagcccacaggctatgtaattgttctgcctagtccctgtctacaggggttattgtgacatatctcttggtcccgttcttcttctccctgggacttgtccacagtgggaattgtgacatatcacttggcccagcacctatgtgatgtgactcttttctcatgctttggccctgcccactggttggttgtgatatgtagttgggcccagctcttaagtcaggtgatctttctcttcctcctgagccctactctcccaagaccagctaggtcatggagaccctaacccagcggagctagaggaattaaagacacacacacatagaaatatagcatgtggagtgggaagtcaggggtctcacagccttcagaactgagagcctcaaacagagatttacccacatatttattgacagcaagccagtgataagcattgtttctatagattacagattaaaagtatttcttgtgggaaataaagggatgggctctggctagttatctgcagcaggaacatgtccttaaggcacagatctcacaagctattgtttgtggtttaagaacgcgttaagcagttttctgccctgggtgggccagatgttccttgccctcattccagtaaaccaacaacctttcagcatgggtgtcatagccatcattaacaagtcacagtgccgcagagattttgtttatggccagttttggggcctgtttatggccagatttgggggcctgttcccaacactactcacaggggacattgtgacatatctctggggctctcatctagatgatgtgacttttctgccagggctcttttctcagaggatactgtgacatttcttgacctagaacctaggtgatgtgactctcttctgcttgggctctgcctgagatgtgacttttttttttcccctgggctttgcatacattgtgtattctgatatatgactgggtctaagacccaggtaatatgactctaactcatgggttctgttcagaagggtattatgacatatcatttgttcctcacttaggtgttatgactctcgtcttttcactggaacctgccaaaaagggtgattgtgacatatcactggacccagcaccttggtgatgtgactctcctctcctccttaggccctgcttacattgtgtctgttgaaatacggctggtccaacacctaggtaatgtgactctcctgcataggccttgctaataggggatgtatgacatatgttttgtttatcacttaagtgatgttactctccttttcttcctgaatcctgtaaaaggtgggggattgtgaccctatcactggacccagcacataagtaatatgagtttcctgcataggctctgttcagaagggtattatgacatatctttttgttcatcactttgtgacttgtcttttgactggaacctgccaaaaagggtgattgtgacatattgctggacccagcacctaggtgatgtggctctcctttttttctgggcctcacatattttgggtattgtgatgtatagctgggctcaacacctagcagttggggagctcctttcttgaccattcccacaaatgacatatctctgctatgaccgcctatgacacatgacctaaatatgtgacccttcttttctgcctgtaccctgctaacagagaagattgtgacaaattgctaagtgcattgtatcttgtgctaaccttctatctcagcctgtgaccaagaatgcctaactgccggggaatgcagccctgtaggtctcaacctcaatttgcccagccactattcaaaatagagtcactctggtttaaatgcctctgacattaagatacactgtaaaattatgaaaaaagttgatttgaattttagcaaatgagaaatgaaataattagaatgggctattctgaaagatatagcattagttatatttgtgtttgagttttctattaacctatatttgttacttatgaatagataccttgttttattctgtctaaacagatacactaggtggggtgcggtggccatgcctgtaatcccagcactttgggaggccgaggggagtggatcacctgaggtcaggaatttgggacaagcctgaccaacatggcaaaaccctgtctctactaaaaatacaaaaatcagctgaccatggtggcgggtgcctgtaatcccagctacttcagaggctgaggcaggagaattgcttgaacccgagaggtggaggttgcagtgagccaagatcatgccactgcattccaccctgggtgacagagcgagactctgtctcaaaaaataagaaaaaataagcggccgggcatgctggctcacgcctgtaatcccaacactttgggaggccgaggagggtggatcgcaaggtcaggagttcaagaccagcctggccaagatggtgaaaccctgtctctactaaaaatacaaaaattagccacgtgtgttggcaggtgcctgtaatcccagctactcgggaggctgaggcagagaattgcttgaacccaggaggcagagtttgcagtgagccgagatctcaccattgcactccagcctgggtgacagagggagattctgtctcaaaaaaaaaaaaaggacataaatttaatgttaagtgtggactcataaagaatctagacagccaccaagccatttgtttattcttgatttcttaaagcttccattattaaaagctctgcattccattactcatcacagaaaataatctaaattaaatatgaattaagtttgtgtgtgtgtgtgtgtgtgtgtgtgtgtgtgtgtgtgtgtgtggtgattattctaaattactaaacagattaaggccaatttttttatgtcaaacatataattctgagaaacaatcaatactttatgtacatttctgttacctaataggctatttaagcatttatacagaaattttatacagttgtcatttttaatgcatgttttctgatagtataaaagctttctcatgcaagaaggctgatgttataatagtagctaaaagaatattagaaaatatgtttttttttcatgggacatttctgaaaggtctctaatgatcaagatacttatttcactagacaagttgtaaaactgttaaataaggtattgttcctggaccaaactgagagttgggctgctatttctcatggcccaataacgagatgcagatgaactggggaggaagagagttttatttctgcaaccagttacagggagaaggcctggaaattatcaccagaccaactcaaaattacaacgttttccagagcctatataccttctaagctatatgtctacatgtaagtgtgcattcatctaaagagataagtgattaacttcttttatttaatctgtaactaaggtctgagtcttgaagaccttcccctgcagcctcagtaaatttacttaatctaaatgggtccaggtgctggggtaattacccttatcttgtctcctgctaaatcacagtggtttggtgaattccttcagacctccaataaacctgtttgtagaggcctggggaatttcttcagacccccaataaaacttgtttaatcctataaggcccaagaaaggcctaggcgaaactcttgatgggcttttgttacatcccagcctttgtataaggtcactggctttttttttttttttaattgagacggggtctcactctgtcaccaggctggagtgcagctgtacaatctcagctcactgcaaactccgcctccagggttcaagccatccttctgcctcagcctcccaaatagttgggactacaggcacatgccaccacgcccagctaatttttttgtatttttagtagagacggggtttcaccatgttggccaggatggtatcgatctcttgaccttgtgatccgcctgcctcggcctcccaaggtgctgggattataggtgtgagccactgcgcccggctggtcactggcttttaatatttaacttaaccactcagtcagtactgaaacagttgttagtgaggtctggcctgccacagtattacaggtacaatagtattgagcaaagctaactaaattgactggattgcttttgtaattgcagattgatgacaatcagattcacttagagtggaaaaagtatgttggcccttataaaatagtcattagaaggcctatgtgcgtaatagaacctcatgtgtcttctgctactaaagtctaacattactaaattcaacaaggctttaatgcattatggcaaagcacattttcaccaggtgaggaaagcctttactagtctactgactgaggagagtaaaaccctttataatcaagaacccagagattgaatctgcctgccacctacactgacgcaagacttcaagaccttgaacattggattgataatctcacaacttagaagggcccctccaaactcttgaaattgtaaacccataggagattttaaggtaaagctaaccaggaaagtttgtcctcaaaagcagatggccgtctccatgtagatagcttttttcacaagatcaaaaatcaagacatctcgttatcatgacactcttagttcacagtttgtttatggttctacaaaccacagaaattttaaaaagtggtctcttgtgtgcactcatgggggtatacttatatgtagagaattttgcagccaacattatgtatgaggaaacttattccttgaaaggtaaaagaagaagggccaatgtaggtgagaagttttaatgaaacatttgttttctcacaatatcaaaaacagaatattggtccactgctcttaacctatttcataagttaaaaagaacttattcagaataggttaaagagcattgccaggaggccattactcttctgaatgggtatcactgtttagagtaaatgaggcaatggttacaaatttatccctctcaatagggctctatagcagattataccataaaaactatgcttacacaatagactttaagttttctcacaaagttatgctaaatataatttcttttgattacttactggataaatagatatctgtgcagttgctaatagttgcccatggagaactacagccggtattacagagatgcagttgtagatgattcatgaacaggctgattagatgaaatgagtagatcatttatctagctaactatttgatctatttaactttaattggttgttcatggggaccctggctaaaaagcatgcttcaaactcttggtattatcctcctgatagtcaaaatggtaatcttcctactgcactgtattctctcaaaagatgtaaacgtttgaatgtagtcatctgtagaatgtcaaatggtctctctttaactggaatgacagaaactcaaagacatatgtgactatgaagacagcacaacctatgaatgacatgctaaggacaaaaaacaaaaataatggaaactgagagtggcactaaagccccgagttttggttacactgtgacctatgtaagaacttaaccaaacggggaattttttaaagaaaactattggaggccataattctggactgagcttatgcactaggtccaaacaaaccaaaccaaaatgagtcactcatgctggatgtgacataattaaactaaaaatttaaggcaacaggtagattctaaaactggccaggttttgtttttcttctctaaatagcagatttcaacacaaggaggtcccctgtactctaacactttaaaaaacaaataaaaataatttcaaaataataagctgaagtttttatttccactttacaaacccacagttctgctgtttcacagtgagattcgagtctaaataagtacatttttgatggtgacaaagtgatattaatgtctaaagttttggtctcaaacttgagaagatgacaaaagggagaaattgttaaattagttgtagcctaaagcttccctcttatgtttaattttggctaataggatttgttttttgttttttgtttttttacatagtaaacttaatgttcaaatgggacatatcttaagctgtaataaatctggctgtttctgtacctcacttccattttctgtatgtcattttgcttttctggttcataaaaattttaccaacatgtggctgtgttggagtctctctgagcctactctggatccataggttacccgatttgcaaatcatgatttgctcatttaaactgttaaatttaatttttctaaagttttcttcttttacaaattttcaaattt

SEQ ID NO: 2186 - DNA, 533 bp, Homo sapiens
gtgcctgcttttgttgatactttcttactgtaaagctctccataaatagtgaaaatgtttggtaaatttattgcaatttaaaattggtgagttcctttattaaattaattgctatgttattggagaatattcatcaaattggaattagaggatgtctacgcacaagtcagtgtggggggaaatggtttcatttggtcggacaaatgttgagtttgaacagttgtattctgctagctagttgactgaatccagcctctttctaaagctaactttctgtgtgtgtagagaccctgatgccacatcccatacatttcttttttcttttctttttttttttttggaaactggttgtgtggtttcgactgcaaagcagatcttatttttgattaatacatatgaacaatttaatcctatttcggaaaatcagtcatagtttttctggcatagataattttcctgttgattatttcattaatctggtaattttgagtatgatagcatttcatttcaaatataccccgtaatcgccttaa

SEQ ID NO: 2187 - DNA, 4159 bp, Homo sapiens
tttttaagttgtctcttgtatcactttgaaatacctccataattaaagtttgatgttgtgtggttggttggttttgttgttgtttggcattttcttttgttcagtcactattatatgctccagtctatgaatttaattgtgctccagggtaatttggtaattttataatttctacgaatgtttccaacaccatatgacctaatccagcaccatataaatggatccactcattctctcatttgtatgtaatctagcactccctgcaagcaagttgatgttgttaatttaatcatgctacctgaacaaggtatattgctatgtagaaaaatacaagttgaaacagtcaaaatactgtgtaattccattcatatgactctgtagaaaaggaaaaagtgtagtgatagtagagttcagtggtaacaaggggcttgggagagatataggtgacatcagtgaactaccgaagatttcttttgggcagtgaaattcctctttgatactgtaacggtggatacatcataatgttttccaaatcctgaagaactttgtaacacaaagagtgtagctaatttatgcaaattaaaaaccttatttaggaggtcacaagtttgccttttcacagtattttaccttttccaacttatattttttagcaatatgctttttagatttttgaagtacacctcatggtttttagatttgccttcacctaattgttgtaggacaggtgagtcacacaattggggcttatcctgagagggttattagctttgtccaggaaagaatttaagggcaagtgggtgatgttagactgcaatattttattgaatggtactgctcctagcagagcagggctaactcttaagcagtgtgttcagagttggcaacatataggcctcctggcaactgtgtttatatgcaatcaaacccacttttaattatatgcaaattgaggggcagatcaatgcaaattgaggcaggaaaggggcagtgacttctaggttgtctccatggaaaggggcagtaacttctgagctgtagccatggaatttgtaaacagttatgtggttggtaggagtgtcatatgagtgacaaatgaagactgccagggatcacatttaccacaatgtacacgcttctgtcagttttttccctttatcctgtctggagcagatcttattttggtcatcaaggttgtgaaaccagaaaacaagtccttccagtctcctacctcataatgacaaaagacattgagcataatttcatgtgattttggatatgactatggctttcttttgagagttggctatttaagattttgccatttttgattgggatatttgcctttttaattttgagttgtaagacattgtatattctggataatagaccattatcacctataaaatttgcaattttcacatattttctgccattctttgggtgcctctttatatttgatggtggactttaaattgcaaaagattttaattctaatgaagtttaatatttctatattttcttctttcctttgtgcttttcagtgtcatatcttaaaacattgtttaaccagagaccacaaagatgtattcctgtgttcctttttatgggttggccctgtttagctcttatatttagatggattatcattttgagtcaattatgtttctggtatgaggcaagagtctaacttgcatgtggatatccacttgacccacaaacatttgacaagaaaatattgcttcatacctaatttatttggccacagtataaaagcatttcaccataaatgtagggattcatttttcagtattatattctctactccattgatcaatacatatatccctatactagtaccacaaatcttgattactattactttgtagtaagttttgcaatcaagaagcatatgtctactatgcaaaccctttttgtccttctcaagagtgttttggctgctcatgatctatattatatataattttaggataaacttctgaatttaggggaaggtaatgccacctggtgttttgagagaagttgcattaattctatagatccatttggaaaatattgccaacctaacaatatgcattctgtagtttttagtgtacatatcttatacttaatttgataaggttattcctaagtatttttgatgtgatcttaattggaacgattttctgagttttgtttttagattgttaattgctagtatagagaaatttaaaatattttatatattttatatgctgcaaacttctttgaactcatctttaaattctaaacatatttgatagagtcctttggactttttatacatgagatcatgtcatttgcaaacagtcggagtttgacttcctttccatactagaaacgttatatttatttttctaaatgaattgccctgtctacattctccagtacaatgttgcgaacaagtgtcaacagtggaaatatttgacttctttctaatatcagagaaattagtgaacctttcagattacttatgatgatatgtgagcttttcatagatgccctttgaaatgaagaaagttctcttatctgcctaatttgctgcatgtttttataatactgaatctgggaattttcaagtgcttgttgcacaccttctgagacgattgtgtagtttttattctttattaatatagtgtatgacattaattgtatcatatgttgaaccaaatttgcattcctgaggtaaataccttttgccatagtttataatactttctacatgttgctgatttcatttgataatatctcgctgctgatttttgtctctgtatttataaggcatattggtcttcattctccttatttgaaatgtctttgtgtagttgttcaatcagggtaaactaattcatagtatacaatgggaagtgatctattttctacttctttattattattgtattgttttgaaatatttttgataaattagtattaattttaagtgattttaataacacatcaatgagttcctgatgagggcagggaggtgaatcctaagaacaatcatgtgagtttggaaggagacccttccccagctgagcctcagcctgagccatcccctacatctagaccgaagacccagagaaaccgtgagtagtatgtgtgtggttctgagccactaaggtatgtagtaatttgttatgcaccaagtagtaagtaatatacctgacagtaattgttaggtggtattctggattaggtcctggaatagataagtatatgattattagaaaacctggtaaaatatgaaggaagtttgtagatcagttaatagtcttgaaaaacagttaaattcttagttttcatgaatatgctatggttacaatatatattaacattctagttatctgaatggtatatgaaactgtctgtacttacctatgtgcatttatgtaaatctgcagttatttcaaaataaatatgttttttaatattattattatttttttaagaaaagtaagcaagtaaagacatcagcaaaaaacttttgcctccagatacaagtgggcatgtagggagagaatagtaaactggcttttcttttcttttctaggcaacattcgaaacccaggtgccactccttcaggaaggtaccatcaagctccaaggactcatcctctttctccttccccactacctagtcattagagcgtcagcatccacttcctgaaaggaagatgcctgtttttcacatatcccagaaagcctcattttaggacagcatttagcagagtgtattcaggatcccactaaccttttcggaagacatgacttccagatgatataaggcaagaataagaaatttcagtgacagggaacagaaatcatatttctgcattcaggatcatgttttcttggctccatcaggaactgtgcaggactgtgcactctgttgatactcacatggtggaattatattgcccttggccaaccctaaagccatcaagatagcaggtttggaataattcactgtcgaagtcttcttgagctgagcagtcatgtgagcttggaagatgatccctctccagctgatccttcagctcaggccatcatctacatctggattcctgacccggagaaactatgagtaatgtgtgctgcttttgagccactaagctac

SEQ ID NO: 2188 - DNA, 7165 bp, Homo sapiens
ctcgcaccggcgctggggtgcaggctttcagtggtctcagggctacggcttgtcggtgcctcgccgcacagtcccctttgcattgaaggacacggtcttacggtgtaggagcatttttgaggtgcattcctggatttggaggcgaacccccaatggttacctccacagaggctttgcgaagggcgctcactgacttaggtgaagagcgaaggctcaagactgtgccgctttatagtggccccttgacgtccagaagttccccccagcgccggtcataagcactcccgccgcctgggccccgccctgcctgccaggcgccctccagcctcagctcccggacgcccggcgtggccgctttctcgcgtcttgctgacccgggccgggggcgtgtgctcctcctgcagcggacggaagatgctgggccacgcaagtttccctgggcttggttaaccaccccaaagcccatttccagaaggaaagggtgttgaggaggagggatagaaagtcgagaagagggccggggtcttgctctgttgctcaggctggagtgaagtagagcattcacagcccactgcaaccttgaacacctgggctcaagcaatcctcctgcctcagcctcctgagtagctgggaccacagatgtgtaccaccatgcccagctacatgtctttcttttggggggacagcagaaacctgggcagaggaggaatcctgatacccagttctgaaacaaagtggcagaatttgtaatacagaagaaggatcttgtgactggtattctgttatccacaagagtaaatgttcccaaataaacaaaactgggatatgaaatggtggagtgtgtggtgcctgttcatgaaaaaaaaaggtctagattgcaagagtaatattagaggattttggagatgttttacaaccagagaataaaagaccatccttttgtctgacatggtacagttttatgccccttacatgcaacaagaaaacaaaagctaaataaaatcgtaggtcctgatcctccagtgcttagatacacttaatttaatttttgaaatacttaagcctacgtcagagatcattgagtatttatttgggggaaacagaggaggcaatggctcacccctgtcagagaggatcaacaacatgcagacattccttattatgagagatgggtaactggagtctgcttaccctacttccaaagcttaaatatttagcagtcaaaaatggatatagagctgtacaaaggaattggaaacattcatctttttttttcattgtagtatctcaagcatatagaatgggacttaaaatgaaatacaatagccccttgtttgaatccaccccacccttacattcactccccggaatcaacaagttttaattatttctgcttttagtcctatacttctatatctctattacttcttctttaaataaggtgattatgccattattgcttaatttaccaacttggttcattaatttttatcaactttaggatattatgagaatttagatttaatgcccccatacagttttatccgcatttgtttttttgtttgttttttttttcttttttacctttgtaactttggcatttaccattgtaactcaaaatcgtatcatgttccatttacaaagatagattgtccctactctgcaactgaagaaatggaccaggcatggtggctcatgcctgtaatcccagcactttgggaggctgcggtgggctgatcatggggtcagcagttcaagaccagcctgaccgatatggtgaaaccccacctctactaaaaatacaaaaattagctgagcatggtggcgttttcctgtagcctcagctactcaggaggctgaggcacgagaaccacttgaacctgggaggtggaggttaaagtgagccaagatcgctccactgcactccaacttgggagacagagcaagactccatctcaaaaaaaaaaaaaaaaaaagaaaaatggaaatgtattgctttgagcctccttcaacctctattctgtctttccgtctcccaacttttataagctgtgtttttgcttttgtatatcagagttgatcatgattatgttctgttctgcagccatagctctctgccatcttactatgtaggttaattttttttttttttttgtagagatgagatcttgctctgtcacccagactggagtgcagtggcacgatcatagctcactgcaccctcaaactcctggactcaaatcatcctctacctctgcctccatgagtaactggaactacaggtcaacacagattctcggaattaaacacttccatgtcccagaggatcaaagtcacttgcaaaaatacctcaaaatgtgtttgtcaagaaattacactttctcttgattttgtggaccactttctaatttccaacccagacaaaagcctcctagtgaagctggtctttcctagcacatccccctacccccccagccactgtcccatccctggatggcctgtccacagagagcactgtctgtgtggccactgggggaggcagctgcatcccagagatgatggtgtccagggcatgacgaggaagctctttgtgtggcctggagacgtcccgggagctggctggcgcccaccttctctcacttccttaccaccttctttcttgtgttgctgctttctccttcccagctctaaactcccatggtgctggagcagccagagaagaagtgttactagacctgccactgctacctacagtgagccccattctgcacacagaggctgcggactcctttttcccaatcatagaccagaatgcttgtgaaagaagatgtggctgttctgcaggttggagctctaggatcggaagaactcatctgtatcacatatgatccagctgaaagtccctacaaactgggccctctgtgtctttagaagcagcttccaagggcaggaagacttccagagtgcaggactgagcgtgctgctaatcttgttctggtcgagagactgatgagagagacaagaattatggcgcgagaaaagcagcagcagcagcagcaagtctgcagaggggaatgccaaactcgctactgggtgtttttttttgttttgttttgttttgttttgttttgttttgttttgtttgatacagagtttcactctgtcacccaggctggagtagagtggtgccatctcagctcattgcaacctctgccccctgggttcaagcaattctcctgcctcagccttccgagtagctgggattataggcatgtgccaccatgcctggctaatttttgtatttttagtagagacagggttttgccatgttggccaggctggtctcaaactactgacctcaagtgatccgcccgcctggccccccaaagtactgggattacaggtgtgagccaccatgcctggcctgctgtgatttttcattgaacctaattaactcatttttagcccctatttttggtacaataatagaacttaggttgtaatcaactggtgggttctttccgcacactgcacagataagatcagtccacagagaccacagcgttgcagtaaagaaagagtttgatgtgaggccagccacgtgggaaaactggagttatcactcaaatcagtctccccaaaggcttggaggtcaggatttttgtggacaatttggtgggcagggagctagggaatgggtgttgctgatgggtagggggtgaaatcataggggtgtggaaaacagtcctgatgtgctgagttttcctctgggtggggccacaggaccagctgaatcatgaatccaggtggggccagtgtgaagaacgtatcaaaaaatcaatcttaggttctacaatagtgatgttatctataggagcaattggagaagtcacaaagcttgtgacccctggccacatgactcctgggcagtaagagattactatgtctacattttagcagagttcatgcctttcccacaactctaatcttgtagcccttcattaatcttacaaaggcggttttcagtccctgagcaaggaggggtttatttttgggagggactattatcatcctttatttcaggttaaactataaactagattcctgccaaagttggcttggtctacgtccaggaatgacaaggacagctgggagggcagaagcaagatggagtcaattatgtccaatttatcttactgtcataatttttcaaaggcagtttcaaggttactattctcatgattcaacacatcctcaaggagtgagattcagtctgtgtaagtgtatcatgactttctataacacgccttgtcatgcactcttctaccctgctagaattggagtctggcctcagctggttcctaccagcagtactgccatcacctcatcctcatctgccccatctgttgttttggaaccacttgtgtcctctgaaatgcatatgttgaagtcctaaccacctgtgcctcagaatgggactatgtttggagaaagggttttaaagaggtacttaaagttaaatgagatcattactgtgaaccctgatccaaattgacttatgcccttataagaaaaggaaatttggccacttacactcacagaggaagaaatcatttgaagacacagagagaagagggccgaggagagaggtctcagagaaaccaacccaatgacatttcgtcttggatttccagcccccagaattactggaaaatacatttttcttgtttaggccacccaatctgtactactttgttatggcaaccctagcaaactaatgcagtcaccaacccagggtgaaaatgggacattcccaactctagctcttaggccaagcttatttgtaatagattcttgttttcaaaggatatagatattgagattctcaatgtatttgttaaaatacattgtttcttgttaaaagcataagactttgaaatgtctctgtgttgcagatatgtagatgttctgagccataatttttggaaaattctttcaaagaaaaggaaatctactggacaaatagcatgattaatggggatctagtgacaaaataatctgccctaattggatttgtgatgtttttgcaacttgaaattagcttcaaaatccaacaataatacgaaagaatgttcagtatcacgaatcaaattaaaaccataattaaatcacctcctttcattagggtagctactataaaaaaaaagtaaaacaaaacagaaaatagcaactgtcggcaaagatgtggagaaattggaacccttgtgaaaccatcccacagtgttgacaagaattgcatgctgggttctggacagaaatagttccaattaagtactaatcagtctgcacttgggcccacttactcgttgttaaaagtcatgtagccctggatgctgaccatgtacatctgcattgttcctatagataagatctctgacattagaatcataaggcttttgtttaaggatcacttatgatgtttttcacaccccaaattccagcagccagtttgaagactcccacagagtaatgggatcaatatgagaatacagcttcttcatctccctatctcatgacttcaccctctactcttccaaccaatcagtgatctccacattgcagcccattccaacactcttaaaaacccctacccccaaatgcctcagggagacagatttgaggtttcttctcatctcatttagtgaccctatgattaaacccctttccttgctacaacctggtgtctcagcttattatttgctgtgtgcatggggcaatgaacctatttcagttacacttgtgcactgttggcaagaaggtaaaatggtacagccactatggaaaatggtatgaaagtttctccaaaaattaaaaatagaattctcatgtaacccagcagtcccacttctgggcatatatatccaaaggaagtcaaattagtatctcaaagagacctttgtacacccgtgttcataatagcattattcacagtagccagaagttgggaacaatccaatgtccattgacagatgcacagataaacaaaatacggtatatacataacaatggaaaattattcagccttgaaaaaaactgaaagtctgacatgtactataacatgagtgaaccttgaggacagtatgataagtgaaatgagtcagaagcaaaaagacaaatattgtatgattccatttacataaggtacccagagtagtcaaattcatagagatacaaggtgtctgctggaatggcggttgccaggggatgggggaagggaaaatgggaagctgttgaaatgagtccagagtttcagtttggaaatgatgacagagctctggagattggttgcaccacaatatgaacatagttaacactatggcattgtacatttagaaatgattaagatggaaaattttacgttagatgtattttaccacaactaaaaatttaaaagaaagaaaaaaacagctatgaagatttctaagtcttgggccttattttgccatgaggaaaaataaatacatcccataaaaaaaatcctaaatggatctggtaatgttattctgtatgtaaagtcattttcttgagcaacataggaaatagtctttaatcttttggaatatcataggaaaaaaagcggctaaaagtcacattgttctgcctcaattcaccagagtttttatggaactcaattattggttaacagtggaagttcttgctggataatttttcacttttctgatcatctgggatagagttttaagactttcctagttcctccaggtacagagctataggattcacttggctatgttgctctcccatttctacatagttttaaaaattatggaatctttcttttcatggtgtttggttctataataatcagcggctgataaaaaaaatcagtgttctacctcttgattctgatggccgttttcatactccttgtaggaactacaatactggtttctgtctgaacttgcagccgcagagcatgagagaaataaccattgaactctaaataactgctttccaaattttgtgctggctgtctaattcaaactattatctatctatctatcatctatcatctatctatctatctatctatctatctatctatcttttatctcatagcactgtggaatttaatttaattaat

SEQ ID NO: 2189 - DNA, 3384 bp, Homo sapiens
gggtacagactatgggaaaaaataggtggtggtaggtctttccagggtcaacgccaaggagaggcctgagaggtgcatagcaaaggctgtggcactgactccatggctcagaggagggaaatccagggaagggctgaatgctctgtgtttaagggagagatagaatggacagctgggcaaacacacacccggggactcctttctccaagaccgatgggcattgggggtggcagaggaaataccagcatggaacaacatcccagggacccgcgtcctccccaggttacagtcctgggtccctgcatggctgcatgttgtctgcaggccacatctcctcaggactcccgcactcatcactttcccattgctatggaagagaggtgtcaaggtggcacctgcctccctgtccgtagtgctcaggtgtgtggctaccagaggaaaagccactcccaacctttgccgacaaccatcccgtttctgggttcctggagaagtctgggaagctgctctgttgtagaggctgaaaggagggctggtgagagcccccagctgaaaccagccctgccccttacccttcctcacccctctaccttcactctcctcctaacactccagggttttgttttttgtttgttttttgcttttctcaccccagggctcctgcctctccagcctggagacagatttgatttgggattgttacaaaaataataataacccaaatgcagagaagccacggaaagggctgagggcaaccctcccctccccccgccctcctccctccccattccaaaccgagtacaaaaccgcacccaaagcagacattctgtacaggggggtgggtgggctggggagcaagcgggaggggcggccctgcggttgctctgtacaagtccgggttggtgacggccccagcagtccccacagggcccctggggggcgcaggaagtgggcaggcgcctctagatgaaatattccttcttgtcgtcccctcctgactgcccgccttctgcattgatgatggccgtgtccgcgtctggagcatcgtcggagccttttgcctcatgtgtcagtagtggccaaggaagatgagcatgatgagcagcaggaagacaatgaaagccacgatcccaccgatgatggcgtgtcccgcccacttaaggatattcctggaagaagatgcagtagctccttctaccaccaggcgtcagcactggaaacagacgcagtccaacaggactccctctgcctggctgttgagcacaaagcagaggggagatcagcaagataccaaccacaagggcacaagaactttctctcactgccaatcatcatcagattggtctggagagatctgggggcagagaccggagctcagtgcattgtccttgctcttggcatcctacaatagccttgttgtgctgaggcagctcccacatgctgaggtctgcccctggagtgggaatcacccatccagacattctgatcccaagaactcagacctcttatcgctgggaggcctggctcttatcccctcaactgttttaatgagtgtctcaagtaagggagcctctgatgtttccccgacaatgcatttcccctattctgagaaaagataagactttctggcgggacccacagccattgggatcttcaaaaaaatcgcccgtcaactctccataaaggggcctctgtgtcaccctgtcactactcctgaagctgggttttgtggtcacagctttgagaagaacttcagagaaggagcatcacctggtccttctagaagatatggcatctgagaaaagattctgtctcttggcatagtacaagcttctctctattttctgtccagacccagtacactgtgcttaaggtgggcagaaaaaaaaatgacagcagttgcatgcacccaatacctagtcttaggagaagcaactctgagaagagccagttagagaaggaaatgcacctgcgcctgcacttgagaggctttggggcctctgcacacagaattattgttcttgttgtcagacaagtgcaggggatggaagatggtgtcacccaggccaccactaccaaagaaaggcagatgagagcccacccttctaatgttttttcactaagcggccattacacattctagagtggacctgggacctaagccctcagggaccccagtggtgggctggttttcctttactccactccccgtcacagtttggggatgttatcaggaagcattttaaaaaagggaataagatggacagagaaaggagattctggaggaagagaactgaggagggcttaccattaacattgagggtgtagtaggccttgtagctgcccatgttgctggtggctgtgcagccgtaggtgccactgtcactcttgttgaggaaagggaagatcagggcactctcctgggtcatcttcaggggtggcacactgccctccttctcccataggtactgctgggggctgtcgaggcagacaaatcagaagagctcaggagagcataggccagggagctaaaagaaaaaaaaaaataactgggagcagggatgtcaaggactgtttgatgaggctggagaaattatcggggccagagacactggagctgctatacgccaggtggcctcttggggttcgttctggggaagctgtagatctccagacttgtatcttactttaacttggcctttgtgggaaactcagggactgagttagggagtggccccttcccatttgtgctgctttgcagaagaactaattgcaggcggacattattggacagtcagggaaatgagaggctcaggtcagacaatacagaggagataggaaggagctgttatgtgaagaaggcaatctgagaatgtggagagtaaggaggagaccaggaaatggatcttcttacactggattgccgcgaccctcacagtgtagcaacagcttctggccctcacgaggatggggagggtctggcctaatcatcgcagttggtgtgtctgtggagaaggaaatggtatcaatgaatacctccccacacggcttaggagattccctcacttagttgcacactacagcttctacctctaaatgtttccgcagctcaagaagtgcaacaaagaccttccttctcctacttctcatgaacaaggaccattattgctattgaatatgtgagcaacttctcttgcaaccttgtgtgataggattctggaaggtctgtccttggtgggccctaagagatgtcttaacagaaagctgagaagggaaatgagtggtttacctgtgcctagcaaacctcctagcacataggaaagacctaatacatattttttacagaacaaataaagttgaacttgtcacatattgagctcacaa

SEQ ID NO: 2190 - DNA, 2680 bp, Homo sapiens
gtgtgggaagtggtgggagggtgagtcagatcagcccacagaagctatttaaatttcaggtttcaagcccacctccccaaaaccgttttatgtgttttttcttctgcccaggcaccatatttttatatctatttttgacatttgggcggcctatgtagttcacagtgtaaaactctctgttttactttctttatgttattgctagtgattattgcttgtagtcccacccccttccccacattagccttagtattctatattattcagcaagcttgttcacaactctcaaatatagtctatcagaatttttatctttacctctacattccactattcggaagtatatagtaaaatcgtatgaagacagattttgtctttttcttgcctgtttacactctatcttacagaggtttcaaacaaaccatctttgtttgaaacatcgcaggataatgatacttattgaaatctacatcctgcccaagatatatgccagtcaatttcctttctcctattagtgcaaatggctacctacttaaaagctgctgactatagtttgtcatcaattacttgttaattacagatatggttttcatttttttttctcaatttttcattatgttatttttggagactgtcttaggtggggagtgaattataaatatttttatttcaccacctttaactgagtcaccatatgttatttgcacttccaatagaccagggattgaccagagtatcttttactgatatgaccaccagagctacatggcttttaccttctgtatatcagatgtcactggaatcaagcattaaacctagattaaatctggattaaaccagctgtatggcaccttagaaaattgagaaggactaggaagctgatagaaagaactcctgtataaaaaataaattctttttacattttccttggtagtatttctgcaagcttctttagtttctataggggaatcccagagttttcctctgagattgcttccctttcctttgtattttcatttttccctcttgggctttacttttcagtcgtgtatttctatcccaatgttaatttattacactgtttatattttcctgtccttcaattcatcagtagattagtgaagtacttattcctttaattataagtataaacgtttttaatttctttttggataacgatacatttaatggaaaatttttaaatgctatggtttcttaatagcttttctctaccactaattacttccgttaaaaaaaaaaagaaatacccatgcgtaatataaaagaaattttgaataaaatgttatcctttccttttactagagacaaacatctccacttcaaaatggaaaaatggaactatgcaaaggaaatttacgatattcaagagtatgatattatcactgaaccgattaatttaattgaaaatactaacctgcaaaaaagaattacacaaatgtatttgaaatgtcatcagatacctcaagctatgacagagttgattatgttacacaagtagtaaaggataaattaaatatattctatattaacactaagatttaaaactaattatagtcttctttaatttttctactgtatacatttcatctagttttcagtaaaacaaacttttcattacttttacttatcccatgcaaatctagttgctataagatataacctaatttggaaatacctccctgtaatacattggaattttggtgtgagtgtgtgtgatcagagaggataaacaaatggtgtcagcaaaatagaatgtaaaatatggagataatgtggatttacacaatttgataaaaattctcccttgaattttgcagatcatatatgaatatcatcatgtgaagtgcaattaggattttttcatatattaatacatatacatcatctctttaataaaatattttgctgaactcgtttaatatttctcatgtctcatatttcatattttctcatatgtctcatattttatattttctcatatgtgtctcatttttattattactatagtatccattaaaggagactggcaaatacctgaacaaagttatgttgttggcaatataagatattaccaattgcataatattatttccaaaggcaaattaatatgcaaactatagatttccatgggtatctatacaaattattacttgaagtccatagaaaacagcttccttagagggaagtaaaagaagctctgataacagacaatgtatagcatttcagttaaagtttgattgacatatttttttctcagtcttttatacttgtgaattatagtctacattttgtctttacagatgttgctaacacagtgcagcatgttggcttgtcattttactgattatgtatattgtctcctagttcaagtatacagtaaatcagagctttcatttttcaaggggcagaaaaataattgttggttgataaggtaaggttatatgattttgagggagcttcattgtaaattgaatgagaatccggttttcatgcaaaggtgtatctatgcgataatactttgaatgtctgtagtttgaaatagaaggttaattttttccactggcttatccttaatgaaggaaatcccctgataattactttgattctgaaaatgttgaaaactccagaagaaataaagcttttctttgatttctcagct

SEQ ID NO: 2191 - DNA, 5193 bp, Homo sapiens
ggctgccgccgccatgcagcggcgcgaacggggcgcccagcagcgcgtccgcgccgccgaagctcatcatggcctgagcagtgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactcggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgtgtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggagtttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaaaaacacacacacaggcatgggctcacctcttctgctggaagctcctctgtcctccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgt

SEQ ID NO: 2192 - DNA, 2021 bp, Homo sapiens
actggaatcagcaactccctggaactcgggcctctggccccgtccctcttttctccggcagggacgcaggatgccttggtgcactctagagacggggaccggagggtgcagcgcgcctgggtggggcgaagggcgccggtctcctcacgccctctgactttaggataccagacagtgtctcttcaaccccaccccaggcgcaggtttccagaaggcggggtgggtggggcccccgatttccagaaggcgagttacctagcaggtgtgtggggtgggcattgctattcggaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaa

SEQ ID NO: 2193 - DNA, 2385 bp, Homo sapiens
gggaaagcaagagttgaattgctagccatgaggaaaacgtaagcctgagctgtttgctggccatctttgcttccacatggggatggcctgcctggaaatgaagccacacagagaaaacagaagagcagtgaagagaagggtaaaaggagagatcccatgacatgatttgcactcttagatccagttatgcctgatgcaggacccaccccttggacttcccatttccaggagctaaaactagactgagttgagtttctgtcactgacagttgacagaaaatatcaacaatccagccacatggagcctcatggcagtaccactaaccctggtcaccacatgaatactgaccagaggcatttcacctgaatcaactgtttgtgttcttaactccatctcctcatctgcttcctggaagacccaactgacatagatggttacaagaaatgatttcctccttataaaactctagatgtcaatgtgatctttcacaagcacactgaaaaattcacaccgtggaaaagaactaaagtcccatcctaattcatcagagccttctgtttcctgtaacaaagaagaactcacaagatcaggattccaagcttcttgtatagaagatacctaaaaagtgtttgctgaatgaagaaataaaggattgctcaggcaccactggcactttaagttgttcagcaagtactcgtgcctcttaagaactggccaagggccgggcgtggtggttcatgcctgtaatcccagcattttgggacgccgaggcgggcagatcacgaagtcaggagttcgagaccagcgtggccaacgtggtgaaaccccatctctactaaaaatacaaaaacttagccgggtgtggtggcctgcgcctgtagtcccagctactcgggaggctgaggcacaagaattgcttgaacccacgaggaggagcttgcagtaagccgagatcgcgccattgcactccagcctgggcaacagggcaagactctgtcctgaaagaaaaaaaaaaaaaaaaaaaaaaagaactggccgaggtcttagctggagcactctctctaccctgcatgtttgactgcatttctgtccattttcaatccgttttggttatacgttttttcacacaggtctgttgaacttagaacaccgaaggcctgtgtattttcatggctcacagctcatgttgtgttgacctgccccactgtggttaatgtttagcccctaaaccaccagctgaatgtccttaaatctgaaagaataatgaacacacgccaacagatagcttaggtttatttggtgacttgcgccacatactttgcgaatatcatctcagtcatccttttagcatctctctcaggcacatactctcctctgtggtggctcatgccggtaatcccagccctttgggaggccgaggcgggcagatcacttgaggcaaggagttcgagaccagcctggccaacacggtgaaaccccatctctactaaaaatacaaaaattagccggctatggtggcatgcgcctgtaatcccagctgctcgagaggctgaggcaggagaatcatttgaacccaggaggcagaggttgcagtgagcctagactgcaccattgcacttcagcctgggtgagaccccatctcaaatcaatcaatcaatcaatcaatcaatcaatcaataagggaaaagctatcacacagcagaatacagtccaagggtaactactgaagggccagatcaaggagcaaagtctatcatgtatcaacctttacagtgtccccaagggtcagctgtgtataggggcccacacagaatttggaatccaaatacatctctggatccccaggcctgtgtttgactcgccaggtagtaatgagatgtctccattttctgcaggctgaatgattccctcagagcagaagtataagcatatttattgtttttccttctatcataaacagttattagttgtggccctttctcccttccaaataggtgcccaaatttctggaagtggaaagggcccaactttcccatatcagggggtgggccccactgggcgtgagccaatcagtgtcttctgtcctgtgagctcccgatttatgctggtctataacctgagatggccttctcaggatggacctccagggattgctggaacttggactcttgtcagcctggtaaatggtatgtcttagatctgctgcagccgtcgtggaaaacttgaagctgccaggagagaggggttccaacatgtggtggctaaagaatgaatccaactcaaaggaagcagagccaagaaatggatccatgctgtttgaatcttggatcaaattgtgcctggatctccagtgagacaataaattcctgtattactcaagcctat

SEQ ID NO: 2194 - DNA, 549 bp, Homo sapiens
agatcagctccggagaggggaaaaccacgctcctcggaccaagcctcgggagctaagccagatctgccagtgagcctcaggctttaggaactgaagagcctccgggctcctgggacattgatgtagagtttttagtgaagtgggcacctttctagtccacggcatttgaagagagcgaggagaaccattctggaaactctaggctatgcatgtttaaagatctggtcccctttatgagaatgcaagccgatccacatcctgacttaagagatctgattctgacgaactgcctggaggaggggaatatataaaaataaaattggtgtcacttcttttctgctatcccccagccccccccccaaaatcctcatgtttctgcttcatattttgaaaaataacaattaaaacagacagctgtactgaggtaagatatgtgtgaccttcttggaatgaatattgtctttagaataccctttgataagctgagctgtcccgtgtagatgcaattcggtttaatggcattgatgtatagtcactgtgcctttcttt

SEQ ID NO: 2195 - DNA, 5588 bp, Homo sapiens
ggctggaaacctccagaatcctctggccccagatcctccccagggacccctgtggcttatctcaccagagcattcttccatctgtagatttcttggctgctccacaagggagtcccacttcaggtgtggtgctgggcatggtcactcctgctggatgtttagaaggtggaaaccaaggacctagggaaataccaggtacagcctttccaccctcatccagagaaggacaaagaggccaggcggtgtcaggagcccaggtctccagctggaggtaacgtcaaccccgcagtgagagcaggggcccattgcacatcctaggcagagatggtaacgtaggcaccacaggtatgcagggattggtacccctccctggcgtcagaaagaagccaaacaaggagctttctgcagaatgaaacctttcctttcagaagcactgctgacagtttggtggttgccattggggcagtgagccttttgtccattctgaggttgggctggtttctcctcttggccgtgccctacagaccataaaggaaatcagctagaagtccccagaaacatccacagatggccctggacatcagccacattctgagaaacatgtcatgttctgggaggtctaaggcatcaagtaagtcttatggggctggaggatcccagggcaggtggggcaatccagagccatgggggcttcccatgggaattgggaggtcccaaggcagatgcaggggttccacaggaggagtcccagagccaccaagcgctctcctgtcccagggagcagtcaacaccatggactgaacagttactgggcttcaagctctgggccaggctggggcatgtggggccatgagggagctcagagtgggagacagagagacaattgtgctcagagggcacccatttctgggtgtaatgtggtcctgagattttggctgagaagggtttccagggtttcatatgtgttatggagctgcttcctctccccagcctcaccttgcaggaatcccagtgaatatattgccaccctatttgagctcagtgccctcatagtgtaatggcaccagcagatctgcctgtgcatggacttcctgtactacccattcctgaggggtgatgcttctgcagggcctgtgaccttgtgcacaactttagacaccatcatcctggagcagccctgcaccctcactagccagggtgttcatgacttcctcaagaccaaggccacgttcaagacttgggacttcagtgatgcacttgtgctgggcaaggtggcttctccagtatcttaatttgggaggtagaatgcagcttgagatcaaatgtctgatcaaagaacttgaacttgagctggagggctctggggagccatagaaggtgctggataaaggagggacagtcagatatattttagagatgactgtagaaggctgcctggaaggagtgaacaagagccaggagacccgggagggagcttgtggggcaggtctggagatggcaagggagggatcctgcttggatgaaaagtcttcagggactgtctcaggttacactcaggtgccctcagagctaatgtgttcagaggtcttgtctccaggatgaaaatgggaaggagttgtcagatgaggacatataaatggaggctggcatcttcatgagtaccagcggtggtcccggtgtgggtctctccatccagggacatggtggatggacactacatcactccattctgcccttcctttccctcctcccattctcccgagggcctcagtgcatgggcgctgtccaacctctggtgctgaagcagccaagagacgcaagcctgcgtggctgcctcttaggatatgacagcacagccactggcctctactgaatcctatgcaacctcagaagacacccaggagtgatgccatcatgtggtgcaagagttctgagggaccacaatcctgaagacattgaatggtgggtgcagggcctcatggcctgttccccagctcctctcattggctctgctccaggtggtgaagggggataacatttctgtcaattctgccacgattgcctagcaggaaaaggagcagagcccagaagcagggcctggtatgcagcctgcctaacaaggaagaatttataggctctgtggacagaaagatctgggagtccatatctatcacccactagcttgctgagacattagtaaagtcagttttctggactacatttctgtcatctgtaaattaagaggaatttcttctaccccacaaggcttcttggataattagtgacagtgtgtgtagagtaggtgccacccagccagcatttggtgtccagaacactcctcttcccccttgattttctgcctaaatttgcattttcttcttaagattttcactccccttaattctgctcttccctctgatttctgccttactgtatatcccatggagtcaccaggatcaaagtgggtaacagtcatgtatgcatgtatgtgtgtgtacatatacacattgttggggctggagtgtggtgtgtgggtaagtgtatgagttggaatcactgactgaaactctccacaccaggctgtgttcctgctcattgctggaggtactgtcagggtccctgtcctcaacccctggtctgacacttgcagatcaggcaggacattctggaggaatcatgcccttggaaggatccctgaggagtgactggtgggtattggtggataaataccccagctcccttgctttgggtgggtgactctgaggcacatgttctgtgctgtctctgcagatgtacctggcagggctgagtcctggctgccacaggggaaactttcttgatgaaggtccctttaactgctgcattcctttcctgtctcagttccccactcctctactggtgtttcctgggatacgcaccctaaggaagaactggcagtcgaattactatcctagagttatctccaaatagaatttttgtatttgaatatttgcctcaggatctacttccaggaaaattatactaaggcacacatttttctgtcagctccttcaatccccataggcctgccattgtgctgtttttatcaaaagggaatatgaggatcagagaggggaagtcacttgcccaaagtcacccagctgaacagtggtggagttcaactttgaccatgggaagtctggccccaaggtggatgcttgtttgtatcccatgagactcctcccttaccagggtcaaatgaatgaatggaggatgttaaaagtagagtctctgatgcctctccagagaaacccaggctcatggctggcacctgtgttctcactcttacctctttaagagtataatgaaaaacatgctcagtgctgactgtgtgcctgggggtgttgtaggcactctgcttactttaattcatttaatttttacaataaccttgtttttacttctagttgttagattaaaaaacagtggcaaagagcaatacagagagttgccaaaattcacaccgctggtccaggtttgaagcaagcagtctgtacctgcagtccttgtctgtaaccatggcaccctggcttctcacacatctcatcgtggagttccaccatgtgtcaggcatggcactgagcaccttcttttaagaatataatttgtaattatgtagattattaattctacttcaaaatgccacacagccttcatgtgataaaatgaaacaattggtgagtctaagcattgagaaaaaacgttcttttttccactcccgactccattccaacagttgggacagtgttttctctgtgcctgtagaaacctcagctcctgggctgaggagcctgttccctttggggaatgtggcagtcaggtactggcagggacctcgaagcggctgaagggtcattaagaaaaagctgtttacataggtgtgggcagggccaaggggaaccaggggtgatggcgcagggccctggggttagcgtcatctgggagctgtcaccaccctccaggctggtggggccatggagaagctgttccagtaactcggagaatctgcagctgaaagaggaggccagaggagacatcactcactgtgccctttgactgcatctggatgcccccactgaccacactaccatccccttattagactggagaggctgcagggaggggttctaagcctcctatagtggctcacctccaacagtgagtcagcaccagcccccctagtcccacagcacagggtccacttagacactgtatcctgcgtggtcccctttcctgctgggaagcagatatccaaatgagcagcagaatcctgtctctcccttcaggcccctctgctccttatgagtggtgttttcccttggttttggatgagaaacaccctttccccttccagagggattgtttctgtggaccccaccctgagttttcccctggttaggcaacgggcaggtgggggtggtggaaccaactctttagaaccagcaatgacaaacagatcccacttgggggaagttgatgttaagtgtcatgggtcctctggaattttctgaagctttcctgtttttttttttctccccctaaccagctcaactgatctcctgggatctctactaagatgttggcagcccggccagctggtctggccctggacgtgccttcatggtctggttatgcttcatgacctgcactgtggtcagtggtaagcagcacctgcttctagctttactgttgggtcagattttatccccactccagctctgcagtgcggctgcttcttgtttcatccatggaccctgcacgaaattgccccatgtttctgtttgtgcatcactgagaaaggaagcatgaaggacgcacaggtcaggccattccattgccctcctggtgccgggtttgccctcccaatcctggggttgcttcaggggcttgtcattctccatagtcccctccacatttctcaggtttctgctcaaaagtcaccttttggaggggtctccacctgtcactgtgtttgtaagagctccttcagtttctttctagctcatctcactctggtaatgtctttgattaccaccaccatctgacctggtcttatgacctgttagctttcttcatcagacgtgagcaccaggatggcaggggcctcatctgtcctgttcctcctgtggcctgggtcctagcaccatgtctggtacagtgtagatgctcaagggaagtttactttgtagaaccacttacctgggagatgttactgttagtctaacctgtaccattttgtaaacctccagccattttgcagactctgatcacagtgaaacgttccatgggaacttgggccatgagaaacatccttcctaaccacgtgactgcagaaacatccttatcgcgtcctcctgggcaaaggcccaacagcctgactgcagggacatccttgccatatcctgctgggcagcaagctctaccacccagatccctccctcccagtcccatgattaccccagcctgtgagtggcagttggtgctggcactaagctggtttcctcctccccagggttttgctggcaataaagatgttgctgttgaagcca

SEQ ID NO: 2196 - DNA, 1482 bp, Homo sapiens
ggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgtcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgaggccttgggactaactcagatccagtactactctcttgggacctgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccatggctcagtcaagttgacacataaagttcaccgccccagggccccttcgttgtatttgtgtatgaataaaacacagcatccactccaggtatctgagggtcctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactga

SEQ ID NO: 2197 - DNA, 1484 bp, Homo sapiens
ggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgtcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgaggccttgggactaactcagatccagtactactctcttgggacctgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccatggctcagtcaagttgacacataaagttcaccgccccagggccccttcgttgtatttgtgtatgaataaaacacagcatccactccaggtatctgagggtcctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactgaaa

SEQ ID NO: 2198 - DNA, 1485 bp, Homo sapiens
ggccatatgactagtgctgcccaatggactgtgaacagaaatgacagcatcactcgcatggagactcctccatctctgtcttccctgttgtgacagtctcagagcctacgttctttcaatggctgggctacaagatggtgacaggctgcccaacctgacacagcaagaaggcggccatctgcaaaccagaaagagagccctcaccaggaaccggatctgctggcaccttgatcttggacttcctatcctttagagctgtgagaaatgtcgcccccaggtcaatgggatatttgttacagcaccaggtactgcctgagaactctacctttagggagcctgcgtgctgggtcactggggagacaatgaaggtgcttgacacccagtttgaatattgtgtcactgcaaagctgactgctgttgaaggatagccagtgagaggtcatggcaagccatcagaagaagcagaagtcatgagcatgctgaagctatgaggccaagacaaaatgtcacattgccacaagaagagggacaaacaggcaacaggcagagcccatgggaatcagtaatctcctgctgacactgaggccttgggactaactcagatccagtactactctcttgggacctgttctgactccagctcctgtccttggggtccactgagatccctgtagccttgtaataagcccacattatcatatttcccctgccggctccaccctagagcatttccaacaatttccagtgcttttccccttctcataccactgggcctttgcacgtgctcgtgcctccccaacttgccctgccttctccttcacccagacaactcctactaaatctctcagactcctcagctgtgtcccttcctaggggaggactctcttccctccagtgagcccggtggtcctccctgggatcccctgctccttgtcttccctgccgtccttactgccatccttgttctctactcagaaggaggcagaggctggcctgcccccaatcccctgtagactgaccagatgaattgacctgggctgggcagggcaggcgtgtttgaccagttgtctgggcaccccatggctcagtcaagttgacacataaagttcaccgccccagggccccttcgttgtatttgtgtatgaataaaacacagcatccactccaggtatctgagggtcctggaggcaggttttgtgatccctttttacagatgaggatgcggaggtccagttgtcactcacccagatcacactctcatctgctgatgggaggagtatttgatgggatgtgtgagcccggccgtctcccttgggacacatcagctcattaaatttgccagcccctgcctgaaaaagtatttaatttgccttttacaatgcacccattgcaagttaattaactggcaattgaaagttataggtggcattagaatttattaataacattgggaataaatctccctggaattcaattaactgaaaa

SEQ ID NO: 2199 - DNA, 1339 bp, Homo sapiens
gctcctgcatgctggactcctgagccaggaggctctttcactccgtggcccttctgctcattcttcaagtccctgagtgaccagtggtcctcctttctgaaggctcttgctacaaaggaaagatgaggatattctatttcttgatccctctcagctactgggagctgctttgtgccttggaagcctcaagctgaaatggatgtcagcctcaagtttaactccaagagggttcaccttgtttctttgaacaaaatgtgctgcctgttgcttccctttgccaggagtggtgttcccttttccacaggtctggaccacagtgtctctagctcccgctcctggatacttggttactgtgtgtttcggtaaaaaagcatccacaacatgaatatccactaagctgtaacagggcctgctgcaactatagtatttcctgaaaaagtatcaactgccacaagggccacaaataaagtctgtgaacttgaaataaccatggagaatgaaatgttctgattcagatcatcggtgggatttcactgggaaatctcccactgggcaagagtagatgatggaggaggagaaacagtcactagaaaaaggtgatactttgtatcaagaaacaattaaaaattagatcacatcctgaaacattaagcatatgctcctttgtgaggcttgcctggctgaacttgaactggattgagtgaataatttcttaaaaacaatcaaaatcacagatttattctattttaaatacttatatttacttatatttcattcagaaattagttaacaaataatttttgagtatcctgggaactgttctaatcattaaacatgcaagtttgaagaaagtaaggatgaatctgcctgcgtggggctctcaatctagcgagaagcagataagaagacaaatgtcagggaagatcacacaaccttcaggtaatatttaagctgagacctcactagttgctaagactggatttcagaggtcaggtttggatatacaaaatttaggagctggtacatgacatttaaaaccatgggaatgaatgagatttcctagatagaaagaagaaaagaatattgacatttaatgttgaacggagtaggaggagctgaacagggagaccaggaaggagcagacagtgaacctggagcatgaataggagagtgggtgtcatggaagccaagagaaacaagaattcaagaaagaaagtttcttactgtagcaaatggcgctgagagggaaaaattcatgttgaaccataatccacaatgcaacagtatcaagaggtgtggcctttaggagctgattaggccacgaaggctctgcctcatg

SEQ ID NO: 2200 - DNA, 3488 bp, Homo sapiens
gagaagctgagcacccatgctggaactcaccatatagatgcctcactgcttttcatttctaagtttctcctccatgtctttttcctcttgccagtgtttagataaaattatttctatttgatacatttttcttcactcttgtccttaatgggtcaagtctcatgtggcttcatagccctgacagacagtagtattgctattttggagtcaaggtctcgttctgtcggccaagctggagtgcagtggcaccatcagggctcactgcagccttgacctccgaggctcaaggaatcctcccacctcagcctcagccttccggatagttggtactacagatgatccagctctgtcggaggcacgtaggcacagccaaatctcatgctgtacattgatcacctgtccaacctttgcctagagtgggagcccccagttccttcgagatccaacattacctgtctgtaaagaagaagaggaggagggagacagcggggaggatccggtggcagtttaacaccagagcagctattagaagggctgaataaagggaacatgcagctctgcagcaatattctgataatgtattgcagtgcggctcacatcactgtccaccaccacctggagcggctcatcagaactgaaggggagttttcacttaccttattgagcgtgattctgttctacttgatatttccttcaccacctcatgtcatttctcatggatttggttatgatggaaaggaagaatgcagaggaggagaaaagtgacagatcctccatttttgttgggatgcgggcattttgaatgtgatcatctttgctgaatgtcattatttgataacattttgtttatgttacttaaacatcattggataaatttgaactccatgggattttatctgtggattcagcttctgttggacaactagcctcatctccagtatcctgctggttcactctaattggtcattcctaatgcattagattatcaaaaagtataaattcgctgtgagtgagtggtgttggcagtgtttgtataccatgatgcatggagtgtttgacgaagaaacaaaaaacaccaaaaattgcgagcctttaccctcctctatttctttaatctgttgtttgaagaaccgcattttgagggtgtaaccagtagtcacctctgggccaggttggaaaagaaatcaattttttaaaccactaatgcttgccaagaaatcgccttatgagaacatggtgtgtgtctctgacaatgcgtggcacatctaaattgatcattcataattttatctacccagtcatgtactggagagtggcaaaagtctgaggcacctgcatatctctagtccctgtgttctgcacatccccacggtggggacgccaccaagcctcagactcttaccatcccggtgcatgcaggtctccatgaagaagctgggactcattcacatttcaagatccaaatgctgtgcaaacagtgtaagcttagattttctgtaaatgaagggtcatttctctttttttttttttttaaagaaaatgtgtctgcaacatggattccaaagcattttcagcatcaaacatgaaaacattgatgaatgaggaacaatcacaaaagctgtgtctctgtatatagctctacacaacatgtatgtggatacagtcattatttaaagcacatgccagggaaaaagaccaaattttgaggtcttttacatacagtgatatggtactaaggagaattaaactcctactgcttcctctgaatattaagaaacaatttaaattgttataacttcataaaactcatgactgagtctggcaaacatgtgcaactcttgtattgctccattttcttgtcaatggaagaaacccttccacgtgtatgcaagtgggagatgaaaacctgcatttttaaaggacaaacagtgaatttaagcatgagtggccttaataaatatagttgtctttctttgctgctgtggaaaggattctaaacagatgtccctgaagtcttgcattgaatttagtcattattattactttttaaaatgttggtgcaattaactctggacctctcttgtgagccatagagatatttaaaagacaaacaccttatttgtcggggaagatgaaaccgtccctgagttgcaccattctttcttggtgcattcgcggttaagatactcaagcaggtttcttgcttctggctttgttcttgtcatcagtaagtataacaaactatgtaatgcttatgtgttgcataaacaatccaaatgcattcatgttttaaaagtttgtcctttaactatcagagggatctaggtcttggttagagaagtaagcagagttctttgcaagcttatttagcacattttgacacaatgttgcactgaaaacccaggccacaaatgtgtcccagtgaacagtttggatgtcctcaaagaagtggttctcactgcctcctacaaccaggtcttgacctgaactctgcaactgaatacttgaagtaggaagtaggaaatccagtagggaaaatagggtccttgaaacagaaaaaaaaaaccaacccatgtatagctagctatttctatgtatgtgccaattttgtcacagctcttgtttggagggatcattttctgcccaactttcattggttaaaatattactgatcttacctttatgaggtcgtataatttagtcccttaaaaattaaattctctctaacataacaacctttcccatttcgtgtaatattctctgatgtttgggggttaccaaaaatatccctttttcacatattaagaatagtctctgggtttacaacaaacactgtgatgttgggaagctatttcctttgcgcaaactttaacaggttttcttctaatcataacatagttgaaaaaagaagtttgggctaacatttaggagaagttggtcttactttgtgcaaaagcaggcttgtgctttataccccatttgatttcgatgtacagtctcaattttgtatttaatgatttttgtgtatccagtatgcacgttaacagcgtgtcaactttcatttgaaagtgggtttcaatttactttttaaacagtgtttatgacgagacctcagatgtgttgacgtaagctctatctgcaatgtttttgtgtagagtggcgattgaatgctgcccagggtcagtgtatctaattccccgagaccctcgtttgatagtgcttcttgtaatatttcttcaagtgagtggcatgtgggttgtgatattgaccatgtgattatggacatcgatatgaaaaataaataaataaaactaaggaaccctggaaactaccagtgggcatgtattagccagtcattgtaacctcgtgtctagtagaacaatgtacaaggtatgtacagttcataaatttgttgtcatgtgtatgagaagtactttgtgctgatcgccttatttatattcatcaaataaaccttgtttctttctgaa

SEQ ID NO: 2201 - DNA, 3610 bp, Homo sapiens
ttttgcccccgccaccgaggatttttgtccccgccgccacggctctgagggcaggagcggcagactcggctgccagctctactggcgtcctggcaagggcagcgccgaggggtgctcctggtccagctctcctggctcagggattctttgcctaggcgccggcgccccgggctccttgcctaggcccctgtggcctgcatagagtggcgctgcctgtggaggcggtgggagagaagaaggagggcggtggtgggggtgatgcggcggccacggagggtggcacaggggctgcggccagccgggcgctgcagcagtgcgggcagctccagaagctcatcgtcatcttcattggcagcctgtgcgggctgtgcaccaagtgcgctgtgtctaacgacctcacccagcaggagatacagaccctggaggctaatacaaccagttggaaaaatgcgatggataatccattggtgagagaacatctgaagtggtactttgctatcttctaaagctaggtgatgatattctgatctatgagatgcaagaagatgtgatgtgtgggacatccatgaaaactgattaatgagacctgacacaaattagagatcaagcccactacgaccaccaccatttttctcttctatcctatttttttgtgacctctagcatgaccatgatgccaagatctctagcagccacatagtgacctgaggtaaatctgagtatgaaaatcatgtgccaggatggtgtagaaagagggttttggatcctattgacaatggaaagttggtcttcctacctctgaacctctttatgtaagagaagtaacctgagttttaaaagccattattatttccattttctctgctgatgcagacaaacacaagtcctaattttatagagacctaatacgttctggacctcagaaagagattcctggaggaaatgttgttttcaaccactaactctgctaatttcaggccaagtgaggcattatatagacagtctgaccactgccacagttgcatacgttctaaatttgaaataaatcccttactctgtatcacttatagtggatctgcttctctgataaaaccctcactaagacaattatcatccactgtttgtttttcctgtggtaagtatatcattgctgtataaaaataaccttttaattattaactcagttggcccagtttagcatcttttccatcttccattctcaatttgataattaccatctttcataataattatccttcaggtttcacaatacatgtatgttgaatgttaaggctattcttcattgatatttacactttgactccatggtgagagaagctgcagtatctgagaaataaataatttgtatgtgggaggtgtgattttacagctagattatagctcagtttctagttctttcttttagagagatttctcttggtcatctttatagaggtatgaagatatttagttttactgttattatattaacattttaaaaagcagctttctacaaggtatggcatcaggtggaattattcttgctgtgctctcaaataatctccatgctaagtttttgggcctcactgcagcccctgaacacgtatgtctctctgtacctcctctgtatgatgtagtgaattttttggacctttgaatcacacacaggctttcttggctgttttataccaaaggactttcactaaattcctaagaaaaatttagcacagccgatgctgttttccaatgccaaccttggagtttgcaatttgcccagacaaaaataccatagctgatggtgatgatgatgtcaatatttttttaaaatacaatttaaaaaatggttcaacataaattatctcatttagtcccctgaacaaccttgtgatgtgattttgaacaggaatatcaagacctcaggatctggcatcaaattctggggtttgaatattatttctatcacaaactatttatattactgcttatatgtaagtgacaacctttctattccttattttttccacttgtaaaatcagaaaaatgacaatgatgagagcaccaaacttatgagcttgcgaagattaaatgtgtgtatgggtttttatcagtttgagagacattatatttccatttgttgtcattctgtcccttccatcagggtaggacctttcttcagtgcattactttgtcccctgaacctagaatggtacctggaatatcattggtgcccaataagtacttgctgaataaatgactgaataaataaatgtaatctgtcaatattttcatctgaagatatgatatctgttttttaccttattttttcaatcatccgaaaggtagtatgcacatttgaaaggtagtcattgttattttcttacaccagtacttgcacttttacaatatgtagcaataatcataagcaaagtatcatgacagagtgagaataaacttaaatctgtaattgcaatttttcttcaccgtggcctccattgtttgtcatgtgtcttggctacgtcaggatggaaagcattgcttttttctatttacaggaccagaattaaatccatgtttcttggctgaccatttggttagtttttgtttgttcatttgttttttcatgaaatgttcatggtggttgggctggaataggtatagcattttatttatttatactcagctgaaactaagagaaatatttcagaccaagaagtggggacaagagcaatacttgtgtaataatacgatgtaccattttacattatttggaagtgctgatgcctgcatctatagcatcagtcaagaaagagaggtaatgaaagagatttcaaatgaatatcagataggctttagtattacataggataagacagacaggattggtcagggtatgctggaaaagattttttatcttattttattggctttatttaaatttttttttttttcccagctggaaatctatttatttatttttcttcagtgttacaatgaaacaacattgctttatttaaattttataaaaattcaaaccatacagtactttataataaaattgactgcctttggctactctatctctatttccagtgcaactgtggaagtggcactgacagatatggttttagctacttagaaatttttctagacacacacacacacacacacacacacacacacaatttatatgcaaaatgctcatatgcatgtcatattttttctttattcagcaagttatagtggatattcttttatagcatacgtagcaatggacttctctttttaaagactgcctagaattctgtagttataatacagtcattcatgtaactaattctctaaaaacaagccagatgatatttactaagaacttactatgggtcaggcacagctctaatagtctaatctcatctaatctcaatacgttcatgagttaggaatggttgttattcccatatgttcccaatgaggaaactgaagcagagagtttaaataatgtgccctaatttacagaattattaaactggtactggaattatgcaaagataatcaggcatcagagtttgtgatgtcaactgttatgtgatactgcaataaacgttgtataaac

SEQ ID NO: 2202 - DNA, 1728 bp, Homo sapiens
cacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaat

SEQ ID NO: 2203 - DNA, 910 bp, Homo sapiens
cttggaccatgtgtgtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaagggcgctacttttcttttctctttaatagaattacgttttataggtgtgtctaggcaacacaagggaatgtgaaagactttcagagggaatgtttgtgaatacatctggtgtgtactaaaaagctggaaaacccctaagtaaatgcaatatcgatagaaagcgagtttcttgaagagtcatctgctaaactccactagagtcatctctacaggtgtggttaagagaaaaaaaaattgccattaaggaatcagcaaataggatgtctgaagtgaggatatagcacctatctctgagattaaagtcatctgatcaaaaatgatgcctctgagactataacaaaggaatgaataatgaaatataagaatggggattctgcactaactctatggggaagaaaacaatggtaagagcaaaaggatcaacagcagcaactcctgtttccatcgatttgtttataagatgccgtctacattattccaaaatatcccagcctttttctcccctgtcaagcttccctgtctctaaaagagatcttgctcttcctgcacagaaagaaataataatatatcactgaaatattattattacatttaaagttacttacactctttcccattcctataatttcctagttggaagccctcgcacttgggaaattatttaatgtgattttttctccctg

SEQ ID NO: 2204 - DNA, 1593 bp, Homo sapiens
cttgctgcagaggcagaggctcatgggaaacctctactaggacagtgcatctctggctttgcagggtgttgcccccatggctgctctcatgggctgggttggtgtcgagtgcctgtagcttttccatactgagggtgtgagctgttggtgggcttatgaacctggagtctggaggaaggtggcctcctgtgtgggggctcaaagcctatattttccttctgcactgccatagtggatgtttcctaagaggttctgcttctgcaggaggcttctgcctggaaacagtgggcggtggtgtgggtggagaatccttcaccattggttagttttcttgatgccgatgtcctgatggtgagttcttatgtgatctggttgtctaacaggatgtcacacctctttcctctctctgtcttgctcctactcctgccatatgaaacatctcattgccgcttggccttctgatatggttaggaggggcctgatcagtgtaggcctgctcagtggacctagtcagttgggactttgtcagtgaggcctatttagtggggggtggtcagcaggtgtctgcctagagagggtctcattagagggatctagtagtgcagctcttggtgagtgggttcctagtggcagacaaatgtttggtgtctggtcaatgccaacctgggctgtgggacttggtcagtggagaccttgtcagctggggcttagttgtggccttgtctgattgggctgggttactggtgaccaggtcaaggggtgctattcagtggaggcctggtcacatgggacctagtcagcagaggcgcttgtcagtggggccctggtcagggcaggctggtcaatggaacctaatcagtgggggcctggtcagaaaggacttgatcagtggtggcttttgtagcactggtctacggggtgaccaggtcagcggggatctgagcagtgcgtgcctgttcagtggggcatactcattagagtcccagtcaggggcatctggtcacctcaggcgtggttagtaggagcctggtcactggcagcctattccctggaggcctgctcagtggggcttcatctgtgggaccaggcaatggggtcattatcggtggaacctgatcagcgaggccttgtcagtaaggacctggtcagtgaggccttacaagtgaggacttatcagtaaggtcctcatcagtggagtcctggtcattgtgggcctgtcagcgggaatctagttagtgaggcctggtgatgggggtctagtcagtgagggtgtggtcagggaggatctgatatgctggatctggtcagcagggacctgttcagtgggggctgctgagcactgcagggagatgtcaggagaaatgcatgttatcgaggaccctgtggacagctgggatggcccagtggtgttcaatggcccagtcaaaagtggacaaagcaggtgtttggatggacctgggagatcttgctcagggattctgacaggacaaaagtaaaggaagtaccagagtggccagagagatggtcacagtctatgggctgcacaggatggaggaggccagggaacaggcagggtgggcagctgagtttcag

SEQ ID NO: 2205 - DNA, 1930 bp, Homo sapiens
gatgacttgtctagatcttaggcaacaattctcttagcacatcagctcctggaaacaaatgcacttaaccagaaaaacagggacatcaaccagcaaagatgcatcctcatttaatagagcttgaaattactataatctgtaaagtacagcgagaagaagaagtttcacctgcctgcacatctgtcgttgactctccatctgacttggagggactctgagggaccaacctgagcctgagaagaggcaagattccccttcaaggacacactgggaacttacggacctctttctccatggtgcagagcgcagaggtgaacaaacagacgcataatagctcttgagcttgccattgggaagtgaaaatcaactgcttgaataaatgtaaggactcaggtagacatcaccttgtgactcaacagcagccaataagatggaaataaaggccatgaagttatcggatggcatctacaaggaatacttagatgaggaggtgactctggtagcaattgttcttttgtctttctcaccttccttcttgtcctgtctgggatgctgaagtgatggctggtatacagatgccctgttgtgatgttgagataaacatgagaataaaagtcggcgattacagatggcagagaagagagagaaagataggatgtaggtggatattgacggaactaagtttctattgcacaagttctaccaccaacctctggacttcatgatatgtgagggagaaataaactcctattttagaagagatctatgttacctgcaactgaacggaatgcttaattggcacatcctatgtgctccaaaccttccttaatttctgtgtgtaaggcatacttagtctttacccattattctgttcacattcattcacttgatcagcctcccaactctatggtaaagagtttactacagtttactctattagtaagggagattctggagcaagccccacaaatcatagattgaatacccattcattaagagagagatttaaagatacttctatccaaacacattttaaatttccagcacctttgaggtggtggaggttcatggtggttgatagggtttaaatgacttgtgattcaagctccatattacaatgtaacagtgcaaaagttcatttttttaaatttattttactttaagttctggtatacatgtgtagaacatgcgggtttgttacataggtatacatgtgccatggtggtttgctgcacctatcaaaccgtcacctaggttttaagaaccacatgcattaggtatttgacctaatgctctccctcatgttgccccccaactccctgacagggcccagtgtgtgatgttcccctccctgtgtccatgtgttctcattgttcaactcccacttatgagtgagaacatgtggtgtttgattttctgttcctgtgttagtttgctgagaatgatggcttccagcttcatccatgtccctgcaaaggacacgaactcattcttttttatggcttcataatattccatgagtctggatttggttacagatagagctggacaagccttagctatatctaatggcttttgacatgttatatcaatttcttactgcttttgtaaatgaatatattaagaagaaaaaattacaaatgaccctttcttcacaaacttttagggtaatcaagttcagttattaaaaaatggatgtttgcaacattcatagtaattattttcagaaaattaaaaatgattaaaaattatattttcatcccattcagatattatatatttaactgtgagataattctcagagataaatgtcaacttttaaaaaatgctaaataaattaaatcaaaatatcccctctaaaataaataaattagctccgattatttcttctttttaaatttttccttatagttgtaaaaataaagtgaac

SEQ ID NO: 2206 - DNA, 1711 bp, Homo sapiens
cttaagtacccagattttcttatgcaggaaagaaacatgaagtaagatttaagccttgaaagtatcataaatatatcattcttcaaattgattgtgatgaaaggaaataggattctttctccttagaattttcactgatctataatgggatcaaaaaagtagaaaaatcagtctgcagaatgaaaacagattaatgaaatagctagaaaggaggggagagcatttgtttagttaaatgttaaggtaacttgaaaattgtctatgaaatgctaaaactgtaccagagccttattgcacactcaacattttaagcctgggagcaggggaaggtgggaaaaggttggagtgatagaagtgtttgccttatgatctcttgactccttttacacaagaagcagattggtagagcttaagcaggtgtctgtgctgtggtgctggctctgccaaaaactctcatatgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagtaaaaaaaaaagtaatcttaccttttattttgaccttggctttaaattattatgatttatcatttcatctttgaatgctgagtgaattacctaaacagaatgtctgttccagttaatcttctctttaaatttttgtagtttaataaacatgtaacaaatcagaagcaagtatatcatgcttatcgatgaactgtagcagattgtaatggtgcatttttgtcacattaaaaagttaatgtccttttggtcccagaagcaattactataatttaaaataatattcacaaaattttgtgaatgtttttgaatacaaaggaggcctaatacagccatattgtagttcattttgctcaggagtgagaaacaaaattcagggataacccaaacatgtctgtttggcaatagtggatagttaggtaaagaagggttatagcttttgcacatcacagataagaggcgactatacctattgaaaaacagcagtatattctggttcttggttttatgatggaaagatattagaatgatactaaaatttggatgcttgggaaattgaataatacagaaatattttgtcatactgagattatttgtccagaagtttagtcttatatcccttccattcagaaaagggggcagtttttaaaggcctctgtcataaaaggaaatgtatattttgactagtggagcaattagttaaaacatttaatctgatcattttggttttatgaatctgaattttcactttaggtgtaattgagtcgcttatgtattactgtgatctttgtgagaagtgatttcgtccatttttttaaatctgatgaaacttgataaatggtgattctagcatattgtgttaatactgtatcttacaacaatttgtgaactgaccatcataaacgaatcatagtagtatctcttctggtaagttgtttctatatgtgatctcttaatgctgggtttgggggtggggatggggttaagtatttagtttacttta

SEQ ID NO: 2207 - DNA, 3448 bp, Homo sapiens
tgcttagagtcaggagaataaacggtcccatatagagataggtttatgaagcggagtctgaaggatgagcttcatcagcaatcctcagaatgtcagttctactagctaaggatgcaggtaagtatgttggacaccaagagaacaggaaggaagtgttttgaacactggaggtgggtcatgaggaagcttatacatattcacattgtgaatcaatttcaaggacagatgaacaaagactgggcgttaccaatagagcagggttttgttttgtttttcccctaaggcaaaaggcagaaatgagtgggtacaccatgattaagttgcattctgtagagataggatcatttaagtcaagtcagcaacaaaaattagagacattgaagatgatggggtagaaaaggggtatcaaataggttagaaagatggcttgaaaggaaatgagggaaatttcagtgagtttgaggaatggcagactgggtatgtgacaaatgagtgggtaaataaggaaatctcagactgagaatcctggcagatctttcaatgggttagactgcaggaatattgattttaaagccagactgaagcaaattctagtgataaaggaaggggaaagggtggctgaatcaaatgttctaccaatactgctttttttagtatttgagttaaaattcagattaaatgcttggcttagaagaatgcaaagcttcactgagcctaataatatggatcccagtgggtgagtggaggtgagttaaagtaaaaaactctgaggcaaatcttacttaactgaagttgtgtttttagtacagaatgccaagttaatatggttaatactgaacaaaaaataatggaagggcaactacagtagcttaagatggcactttaaggaagtgtaggcagaaagtcaagaaattaaaataattatgaatcattatatggcaggcaatatttccaatgaaaatcagagaaaataaactcacatacatgtactgttacagctgatcttagtatgaatattttctattaaagactgttttaaaataagttattaatatttgttgaaatggttccagataacaagaaatatgatgcaataaaacctgataaataaaagcaatataaagattagaatggttttgaataggtagtggaataaaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtgaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctagtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaactgatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacataaa

SEQ ID NO: 2208 - DNA, 972 bp, Homo sapiens
aattactatgggaaagaagaaaaagaaatgcctctctggatggtgactataacctatagccttgcccaatatgactcaggatttggtactggctgtgcctttcatgggatgcttacttatcctggtcgatggcctaaagcccaaccgtccagcttatatccagggtctcaagccacccaggctggagtgcagtggcacaattatggctcactgtagcctcaccttcctgggatcaagcaatcttctttcttcagcctccagaggagctgggaccacagatcctttggcatttgagagttgctttgtgtatacggtcctttaacggagcaaatggccagccaggaaaccaaagtatggacaaggggaaagaagcgtctgtggaggaagttttacaagcgccctcctcatccatttgggtggtgttgcccatatgctacatgtctgtggaccactatgtgtgtttaaagctttttagtaaaacgttactaaaaactatgactcactgtggtgaaaaaggtggcaaaacagtgacaacagtgagtttgctgctgttattatctatgtgagtggtcacgaaagcacaggtagcagctgaggcaaggggagggaagctaggaaaagaatcgcagtgagaaagggatgagaacttccatgtctgtgttaatgtctggttttatgataaacttgaaactcaagaggcacagttggaaattgtaccttgccactttgtgtggctgagagagagaaagctgtgccagctgaatgtgtggactgtctttgccagtgcaggctgggatgcaaatacctgtaattcttgggaaacaaccagtgagccagatgatgacatagagtttaactcagaggaggaagatcattatccttcccatttgagagtgaaactgttcatgcagtggaaagcaaaattccaacacacagaggcctgggtaggattactggatataataaaaactt

SEQ ID NO: 2209 - DNA, 2011 bp, Homo sapiens
atcttacgcccgtcgccctgagtacgttagcggaaatggctccgagaggctttgacgcatgtgtacctttttagtggcggtatctcggccggggattttcgggctccagtggaggtggctatgctcaccccatctcccttgagaggcacagaaggttagagatgtgtgcgaggaacggccaggtccagcgtctcctcgttgctgccccttgagcccgggaccggcgccaatgcgcgcccgggttcttgggttctttcgtcccgcagacctgccttggtgtggcgtccctgggccgtagcttccgaaggctgcagccgacctggtcggggtcctctagcccgccttccccttcccccattgacagatggagaaactgaggcccaggccaaaaaatatctcactagagggctcaccgccatttcctggaaaaattggggctgggactcaacggacgctcgtccagcagcagcgcggagctccgaagtaaaggcgcccgtgaccgagtgctttgtccttacaagcgtggtgttcttgaatgcttccaggcgccttatgaggcccccgatgtacaatctgtgcttaactaaaccccactgtcttccagggtcaggttggccatccgcaggcgtagttgctaggaaggtttgacagatgtccgcctgttgattcagacgttcccaggatttggagcaagaagagcaaggaaggccaggcgcggtggctcacgtttgtaatcccagcactttgggaggccgaggcgggcggatcacgaggtcaggagttcgagaccagcctggccagcatggtgaaaccccgtctctactaaaaatacaaaagaaaattagccgggtgtggtggcacatgcctgtagtcccacctacttgggaggctgaggcaggagaattgtttgacctggcaggcggaggttgcagtgagccgagattgcgccactgcactccagtctgggcgacagagcgagactctgtctcagaaaaaaaaaagagcaaggaggtgttgaaaatgggtttcctggctgggcgtggtggctcacgcttgtaatcccagcactttgggaagctgaggtgggcggatcacttgaggtcaggagtttgagaccagcctggccaacatggtgaaacaccgtctccactaaaaatagaaaaattaactgggtgtggtggagggcgcctgtaatcccagctaatcaggaagctgagacaggaggatcgcttgaacccaggaggcggaggttgcagtgagccgagattgctccattgcactccagcctgggcgatagagtgagactcagcctcaaaaaaaaaaaaaaaaaaaaattcgccaggtgtggtggtgtgcgcctataatcccagctactcaggaggcagaggcacaagaatggcttgaatcacttgaacctgggaggcagaggttacaatgagccgagatggcaccactgcactccagcctgggcgacagagcgagactccgacttcccatcttaaaaaaaaaaaaaaaaaaaaaaaagaagtgtaaagatgtgattatgtggcagggggtaagggttaaaaagaaaacaagaacaagttttcctctgcttagccagcttacttcaaggacagttataacactgaaaagtcgaggccaaaggaatgggctccagacagcctcctccggagcaaagttgaaaagaaaaattcctttactgtctctccttttctgaaccattaaatatgactgtttgccaatggttgtatttagtaagatttgtagactctgtttttcttttgacacagctgcaaggccaacagctgtgcaaagccacaagttatgctaagtcagcagttatgctatagattacatgacctgtgactgtatcattaactgcttttgttttgcttctgtaagtttgcctataaaaaccacactcagtctttgttcaatggtcagcttttcagatacaaatccactgagccggtgtacatctaaataaatcctcctgtttcccgtgtca

SEQ ID NO: 2210 - DNA, 2703 bp, Homo sapiens
acacgaagagcaccacacagagcggcaggtagaaggcgcctacggtggagaacacggcgtaggaaggctcgcggcttacctggcactcctcgctgccctcagagtacgtctctccccagccaaaaagcagcggggccagagagatgacagcggagagtgcccaggtgagcgcgatcatgacgttggagacgcacttgcgggtgcggagcgtgtattccatgtggcgcgtgatggaccagtagcggtccagggctatggccgtcacgttccagatgctggccgtgcagcaaagcacgtcgcacgcgatccaaagctggcacagcctccgacctagctgccagcggcgcccggacagctcgtgcaccaggctcagcggcatgaccagcgcggccaccaggacatccgagacggccatggatgccaccaggttgtggggcacgcggtggaaggtgcgtacacggaggatggtcgccagcaccagcaggttccaggcgaacgtcgccgccaccagaaagcccagcaagagtaaaacaagtatcaggagaatgcactgagaaaagagaaagtcctccactggaacctagaggacgggacaacatcattaaataccggattattcacagggctgtttcaaacaccacttaaaaacagctgatggtgactgcctgcatgcagagcaactgtgcatggccccaatctggaagcaagcttgtgcttctttaaggcaaatcaccttcttgaggtcatggaactaatgggaatgagatgtaaactatgaatcctcttctttggaaaaagttctgcatctagtctcagggcctgttatctggaggaatggatgaactgtgttgcccacaggcgggcctcaatggatctctatgaatcttgaaaggcattatgggcttgtgattatattccctactgattccccaggccacagctgtctgtattgatagctaagtgagcagcagaatagttaataaggacaaagccaaggatgactgaggataatttgtgaaaaatagagtgtcataaatttagggactgaatagaatattcccacaaaggagagatccaatggagcatttccagaagggacaaaccctgttcagaaagtctggcttatctcttaaaaatacacaaataaaaaatcataatatttcagcttcatcttaaagcatagccccaattttatcttgaaaaacactgaaaaggaaaagaatctgaaaaggtataaaactcccgtctgccatatggtacctctgaaatggcagtattgggaaatataccttcctgggttgtcacctcttatgggttaaactgtgtctctccttcccccctcccttaccccctgccagatttatatatggaagtcctaacccctagaacctcatagtgtgactatatttagaaataagatctttaaagggatgattaagttaaaatgaggccataggatagggcctcattcaatctgactgacatccttatgaaaagaggaaatttagacatgcaaagagacaccaaggatgtgtgtgtgcataggatagaccacgtgagaataaagcaagaaggtggccatctacaagccaaggagagagacattagaagataccagtattggaagattagaagatatcaagattggatttccagctgccagaactaggaaaaaataaatttctagtatgagccactcagtctgtggtattttgttatggcagccctagcaagctaatataccatccgacaaaagatactagcaaaagatacaaccacataactgaacgaggtgctatactggagaagagggaattatagacatataaacaaatcatgggacatctactaaaacctttccaaaaggtagtttgcagccatctagcaatcattcgagtgcagactcagttgtctattgaggttacttacggtttgtaatcaagtcatgtcactggcttatagaaaaatacttattttagatttttctataatgggaaggtatgaatctatttcattcaagtaggagctgattttttggtttgtttttgcttctgttttttgagacagagtctcactctgtcatccaggctggagtgcagtggcacaatcttggctcactgcaacttccatcttccgggttcaagcgattcccagctaagttttttgtatttgtagtagagatggggattttaccatgttgtccaggctggtctcgaactcctgacctcaattgatccatccccatcagcctcccaaattgttggaattacaggcctaagccaccacacccggccaagaccaacgaattttaatgtaacagcataataaacatgcatgatacaatttcagattccacatcacaacaaatctttaaggtgctaccactcattgagttttaatatagcatcacagaaaaaatatccataattatctgaaaatagtattaaagtactctattgtctgctgtatatctgtatgaaagtggatgttcttcacaatcttaaactaaaataacatatcccaacagatggaatgtagaaacatatgatgttctagctgtcttgaagagatttgcaaaaatgttaatgctattcagaaatattttatgaaaaataattatttttcataatgaggtatcacttatatagacatgtaatgggtttattttatttttaataaacaaatacacaaatatgttgaaaa

SEQ ID NO: 2211 - DNA, 3898 bp, Homo sapiens
cgggctgccggggctccggcccccggcctgagagctgtgcgaccgtcgctcttcttccggcggcaggtgtacgcgtcgctgcccggccgcgaagacgccttccaccgcggcatcttcctcttctgctgccacgagccgccgtgctgtgccgccctgcgagtttctaggaatcagctacccaggaaaaatgatttttactcatatgagccaccttctgagaatccttccccagaaacaggagaatcggtgtatctccaacttaagtctggtgctcatctctgcagtgtttgtggctgtttaggccccaaaacttgctccagatgccacaaagcgtattactgcagcaaggagcatcagaccctagactggagattgggacataagcaggcttgtgcacaaccagatcatttggaccttacaactccagaccacaacttcctttttccagaatttgaaattgtaatagaaacaagatgagattatgcctgaggttgcggaaaaggaagattattcagatattatagggagcatggttaagcagtttcaggacttcattcattaagtggttaaacttaatgcttggaagaaaggtctcaatgtgtctagaagagaggtactgagaggaagactcactttggaggctggagcctacaattttcaaggattgcctcaggtgaaaatatacttcctggactttgtttcctgacatatatcaggtgtgttctgctccctataaagacaagaggaggcgggtatccagatggtcccacgagtagggctacacaagatgctggaggcttggtccacctcccagtagtggcggccagaggtgaaaccaggggagcccaggacagcacctgcgaagttgaatctctcagcactgtttggccgattctgatggatcctcccacatcggacgctcctgaggtcttcagaaatgaggaggaggttgtgagccatgtcaacatccaaggtcacctccactgcgaaaacaaaaacaagtagctcagcaaatgcacagaagccaagcccatttcactcctctactgcaaagtcccaaatatctcattgactttggtttctgtcaatctgctttttttcctgaagtcagagcttttctcgaggcaacttctctgaatagttgaaattctcagatatacttgttgtaatatgtggctcttattcatagtagaagtttttattttacattatgtcatgtgtttgtttatgtcatgtatttcttctgcttaaaggggagggtctcaagacagacaccatgaccctctttctacaatactgatgagtgaaaaatgactgatagttaagacaatgcaagttagcaatattaaatgatatgtttcttttttcacattttattggtccaatttaaatagtgtctagggcatgaatccaggcttttgttctccgtatttgtaaccaattaattttgttcagttttgacaggagacgggatatctctgcagctgataatgtgatgacagaggtcccatgcctggacttaagagaatctaaggccaagaggaagataaggacctagacggaaggatgctcttcatcctatggggaagttgaggccttaagcaagacaatattaatgggcttaaatttaagagatgagataaaaggtatttaaaaattattagaatgagcattttacaacattgtgtatgcggttgaaaagcgaagtcaccaactttagtggaagaggaagaaaggaaggggtgggatctggcctaggaaaatttattgtctagaccattctggaaaaaaaaatctatagaacctgttatccttcaagtccaatgtacattatttgaatgatggataccttaaaagccctcacttgaccactgtgtaatcaatgcatgtaaccaaattgcacatgtatctcataaatgtgtacacatttcttttaagttttgagaatcccttgtctaagccacgacatagacacgggtatattttgctggagatcaaaaaataaaaccaggtgtttctacatgttgtcagggctgagaatcactgatgccagaggaacatttcagtttcaggtgccagacatcagctaattaccctatggtacggagagccaattgcacgaatactttttcctcttttggtagtgggaaggggcagggtatacagattccttaccttggaacttccgcatccttgggttcatcttcagaatctttttcagcttgggctccagttccttaatgtgcgaaaccagcctccccagctgccgattgagcctgatgttgtttttctgagaagcctccaggcagaagggacacaagacaccttccccttggggctccttctgcagtgaattggtgcagctgaggcagaagacacattcacactccaaggacattggcttttctaagtaaactgtgcagatgggacatctggttgcttcttttaagagttcatctgtggtcactgccaggcaaaaaaaaatacacagggaagtgaattttcatgaaatgacagcctcttagtgtgtgacaagtgacaacctttccatgcatagagttactctgctccagctttatagtccttagaacaagaccgtgagtacaaacactccagcacatgcccatgtcttcagagatttgaagttctattggggaagacaagtcccaaatggtccctgtgctttgagctgagttggaggaagagtcgattctcctggtgacccagcagctgtgccagcagatgagcctgagcccatgacacagcggcacccatgtgaggagcaacgagctggggtcatttcctctcctctgaggggagcccaagcaagagattcattaatgagaataagaactacatccttcctgcagccttgggactgaataccaaactgactgccaccactcctacagtgaggggatccagggtgactgatttcaactccgaggcagcactcagacagcctttgttgaaagcattaattactaatttctttcattcatccccctatgttataaccccaattctagacatctgagaaggaaaagcaaagcacacagatgtggactcacctcttccgctgaaatctttgtacgccatcctcttccaccaagagctcaggtatggtggggaaagggcataggagagccttttattggcaagattgcccaaccctccatgatcacacccttccactccctctaatcctccatgatcacaccctgccaccccctctaacctaatcaggcgtttatttaattatatcgggaatgaggtttttattggtgataaatctgcagtccacaatattcttagtaaaacccttcatcctgataatatttaccttgaaaaagaagataagattaaattgccatcactttagattagattagacctaacctactaatattataagcctattttagggattattccagcattttttagtagcaatggttttgctgatatatactatacacatcaagctttgcttagaatcctaaaatagattatcagtgtgattgcatttgcaattttacaaagttctataaatttatatacatcagactcaaaggtaataggtgcatgcatctcaatgagaaaattttagagagtttttatttacttccatctttggaagtaaattgttcatcttttatcctaaaaatttttgataaatagtaggaataatttaaattgtgaaaaatgaccattaaactctgggtattaggcacttcatagtgttaggatacaagccagagttgaagaacggggaatgttttctctgctgcttatgttttcaagtagaaatcattaacagtgaagtaaatcgtacttttctttcccttgaaccagccttgagtcttttctttttaatccccttctgtgtataaaaatc

SEQ ID NO: 2212 - DNA, 3481 bp, Homo sapiens
cttaagtacccagattttcttatgcaggaaagaaacatgaagtaagatttaagccttgaaagtatcataaatatatcattcttcaaattgattgtgatgaaaggaaataggattctttctccttagaattttcactgatctataatgggatcaaaaaagtagaaaaatcagtctgcagaatgaaaacagattaatgaaatagctagaaaggaggggagagcatttgtttagttaaatgttaaggtaacttgaaaattgtctatgaaatgctaaaactgtaccagagccttattgcacactcaacattttaagcctgggagcaggggaaggtgggaaaaggttggagtgatagaagtgtttgccttatgatctcttgactccttttacacaagaagcagattggtagagcttaagcaggtgtctgtgctgtggtgctggctctgccaaaaactctcatatgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagtaaaaaaaaaagtaatcttaccttttattttgaccttggctttaaattattatgatttatcatttcatctttgaatgctgagtgaattacctaaacagaatgtctgttccagttaatcttctctttaaatttttgtagtttaataaacatgtaacaaatcagaagcaagtatatcatgcttatcgatgaactgtagcagattgtaatggtgcatttttgtcacattaaaaagttaatgtccttttggtcccagaagcaattactataatttaaaataatattcacaaaattttgtgaatgtttttgaatacaaaggaggcctaatacagccatattgtagttcattttgctcaggagtgagaaacaaaattcagggataacccaaacatgtctgtttggcaatagtggatagttaggtaaagaagggttatagcttttgcacatcacagataagaggcgactatacctattgaaaaacagcagtatattctggttcttggttttatgatggaaagatattagaatgatactaaaatttggatgcttgggaaattgaataatacagaaatattttgtcatactgagattatttgtccagaagtttagtcttatatcccttccattcagaaaagggggcagtttttaaaggcctctgtcataaaaggaaatgtatattttgactagtggagcaattagttaaaacatttaatctgatcattttggttttatgaatctgaattttcactttaggtgtaattgagtcgcttatgtattactgtgatctttgtgagaagtgatttcgtccatttttttaaatctgatgaaacttgataaatggtgattctagcatattgtgttaatactgtatcttacaacaatttgtgaactgaccatcataaacgaatcatagtagtatctcttctggtaagttgtttctatatgtgatctcttaatgctgggtttgggggtggggatggggttaagtatttagtttactttaaactgtcaaagtgtttttcttaaatgccataaaattgtatgactataagccaaataagaatattctcttttttcacttttaagggcactgtatagaccatttttgaaactatcccacagaatggtataatttcagtttaaaagctcttacacacatacacacacacaaatataaatatatatatatacacattcaagggaaagcaaacagtgtatgtagtatttctaagtgacatgctacacgttataagaatctatttttgaaatcttatacagattatgcagaagtcagaataacaaatacaacacctcaatttttttatagagtctagcgttagtttactataagatttgcttacatcatacttgcaaagatcattcacataatttatttagcattgaaaatctttatatgaagtactaatgtcatctgaagtttagagattaaacaaccaaggtttagaaagatcaaatgactagtccaagataatatggccaataaatggctctaaacctcctatgttctttatactattcactttttgtcatgttatttttatcctgtcactgccattatctttaaaactttgacaaaaatttaattttaaaagttacattgggaattttcagattttagtgcaaagacattgttgctgttcttgtcagaccttttcagatacctccagactatagcccttccacagggtgatattcaaacattttccacctaaacatataagtttgcacaccctgaccacagacactgaattcacttgatgtcagaatgctagactaaaagttgatcttcttgactgacatttctaatctccctttttaaaaatccatcataaggactgacttctgaacagttgaataaagcagtaatcaatccaagaaactgcatccattctgattcagaggaaaaaaaaatccaacctagtgaccatttttcagcatactgtatttcatcacatttattctgtgattagtggaggacagagaagagggactggggagaaaaactgcctttattttaagaaagctcattttcctgtaactattcaaaaagaattgattatcaagtgttagataacaatattactaacatttatcatcattcaaatatttagtaaaatttctccatatatttaaaattttacttaagaattttcccagttaaaatatgactgcttagtttgaataaggaagacattcctttcaattcatgacacaatagtacatttttattcttttctcagacagcagagagacactgttactgctttcccttgtaagtcaacagtctgtgatacatgctgtacttttactgattagcaatgcaatgttactgtgaatatttaactagaacttattatattggaatttaaaattttctaacattgaatttagttctcttcatcaaataagcaagcattatttttatgaaatgaaataatcattcttaagcagtgatgataatggaattctgaatacgatgtaaaatcaaacattctattttttctgtttatcctttgacattgagttgttttaatttattacatattattaagttgaaataagctttataccatgttctctgatgttcttgtcataataattttgggtcttttgttaagtaaatatcagaaaatatctgtgagttttgattatgtgatattttcatctgattgattttttaaatttctcattggatttaaagtgttttctttgctaatgttatatacagaattcaataaaagaccaaaaaaaa

SEQ ID NO: 2213 - DNA, 610 bp, Homo sapiens
attcggaaagctttttttttttttgagacggagtcttgctctgtcgcccaggtggcactatctcggcttactgcaagctccgccttctgggttcacaccaatctcgtgcctcagcctccgcagtagctgggactacaggagcccgccaccacgcccggctaatttttttgtatttttagtagggacggggtttcactgtgttagccatgatggtctcgatctcctgacttcgtgatctgcccgcctcggcctcccaaagtgctgggattacaggcatgagccactgcgcctggccggaaagatttccttaaaacaaaagtgcatggaattgctgttcttacatttgtttattgtgatatttcactgttgcataccctgataccaaattagtgtaagtactgtgtaagaaaaaaacaaacaaacatgtaactaaatacttttccataccgttttccaagtcaagaatgaccagaaaaagtaggtagtctctcatatttgtttagcatgtccactttttacttattgttaaattactcagtctcaaattgtacaatgcttgaaaacagatatgacaatttctgagattaaactttattaaagttacttttcc

SEQ ID NO: 2214 - DNA, 5256 bp, Homo sapiens
ttttgcacatggcatttgcttttgaaatgcctttagtcaaatacaccagagcaactcccagctgagaccatttgagcacagttcctagtggggccacattcagagcaagcctctcgccggctcactcagttgagctgttgcttagacaccacaagtttctacaagggacttatggggaacggccctcaggggtcctggttcacatctcagctttattcatgtgctggaagcacaaacagcgagtccagggagggattctgctaatcagatgagtctgctcttgtgtctctttcttaggagacaaatacctgtatgtaattgcttcaagaactccatttggttctgatcattaccaatgaatataactgaaggagcaccaaagatcaggcataacctcgggccagttcattctgaaaatgatgtcgtaaaaagagtatgtgtgagagaaatctccttcccaagtttttaaccagatctcgtcacaatgaggagaatgctataatctatctcatggtacatttttggagcttaattctagcatactcctccaagtacactcacaattgtagctgagtcaagactgctaaatgaacagataggagaacttatattagactaatatccttgacacgaagcagggttcattgtaataaaaacggcaaacagataaatcttctaccaaaaccaaagatggaaagtcactgcaccagtctcctggaacttcataaaatcaatttcactggagcaaccagaagggtcatggagatgtataccactcgcttgggctcgtaggtttttgactggggatgcctctacactttgtaagtcatttctcccttcaaaaattgtattatatctttaatatatgtgtatttttcaatgcgagggaggaattactatgaaccaaagatatcttttggctccttctgaaagtgactcagtttgaattccattcagatttgtacagataaatagatggtcaccatttctgcatcaggttggaagagaccaatgataaaggaacccaacgtaaggaatagcagttctgaaaatagacaaagcctagaggaggtatctatttcactgagagattacacgaggggacttattttttatgttcccaattttttcttctgataatattaatcaatgtacacatgattgatgcatgatattacacttaaaatgcaggagagtacaaaacaaccttgatccaatagtttcctattctggggggtgggggcagaggcggaaaagaaaacacatctttcacttacttattgaacaaacaataagcactcagaactaatttatttatgcaggttgcaaatatgtatgaagcaataggttctggccactgccacaatttgaaatcaataaaataagaaatatatatttatatatgagggaagatgctgtttgatagagcatgtgaaatcaatggaaacatatttattaaaagtaaacctcacctttttcaccaaatagtaactagagaactagtcctagtatcttgcgtaattcttctctgtcttcattgggaaattatgtttgaaaatctttcatcacctataaaatggtgagcctcttgtactttctattcagtgtagaaagagtggactgataaataactttacattgttggtagtagtttctacagatccagtttattgcatgtcgtatctttattgtagatattaaaaacacatgataaaaattgatgtgtgcccctccttgtttggccagtatcacagaaaactttgtaaaaaagcatggggaccctactccctagattatttgagccatttactaaaattggccattagtgatacagtgaaaacaagctaaggaaatgatattctcctaaaaagttatattccagttttgattattataacacagcacaataaatgggcagtatacgtctaatggaactgagatttaaggctttaacaattcgtgttttaaaatattatattgaagactgcacaaagagaaaattatacatgtttctccaatcctgtgatcatgtctgtaaataccttgcaatttcaaattacttcatccgtcattaactatatgatctcccaaacacagccttctcaaaatcgataaaaatttgccactgaatatgcattaatagctataacaatgggtgacatgccacacaaatttagcttatgcaatttatggggtgtgtgtttgcagactatgaaatgtatgaagtgcagtctcccatggagagaatagagaggcaggatggcaactagtcatgaacgcaacaatttaggttaaatgataaagaatacaatgaaatgtccagagtaacacttggtctctacctttctaacattctaacccaaggccagtgtcatgggcttggctttcttccctgtcgcctcatactgagtatgcaatttacagaggacatctgttgctttatgtcttaaggccactagaggaagtcactacattcccaacaaagatgtgtctttcggcttagtgaaaaacatttaacaagaaacaatgtgtaaccaagtccccacagtaaaatgtgtcttcagaaacatgagaatcacttttatatagccaacctcatttgaattttatcatgaacataaattatcggtgagactggtgtgcggggctggatctgtgagacaagctcacactctcatgtgtgcattctctattaacatatttggaagattgcccacattttctctgcagacctgccacaaatccttaccttcttactgaagaatgtgactattgtagcattcgtgcaattatgccagcagaggaggcactagacagtttatagactcttatggaagttgggcacatttcccaggcaggtggaatgctagctagatctagaagcacccttaaaggtcatgtagaatcaaggtcccactttatgtttcccttgggagaaaactgaaacccatggatgctgtaatttgtttaacggcaaagaaagagccaagaattgtttctcgtagttccagggtcctgatctaggaatgtttccttggctccatggcatctcccagtttgacatagtgggagctgagaaatgccatatggcctcaaaataaataaacccttgtacatttaagtgttttcccagattttcagatgcctctactcttgctgaactcatcaccagctgtatcagtagagaggtgttatggggcaattcattagatttctggtaggtcatgaatggttggtataagctttatttactcatatattgtcatccagttctttgaaattcaatcttatcctaaagtggtagtcaaagtaaaacacattaagtaggtgtttgtgtttagcagtcctactaattcatcacaatcacatagtaattgtgattataatttttggaatctttatcactttctagcactttacggtgtcattatttatggcatttttaacaactttgttgcataattgataacatcagggctacatttttttcatgtgagcctcaagaagcttccattatcaacaagaattggggaaatgacttttttacattataataccttatatattaggtttttcctgataatcttcagtagacaatgatttaaattaactgaagtttaaataagaaatatgttaaaattactaaataatatgaaaaccacattatacttgtaattttcagacacttttctcctaccttaagattttaacatcttgtaaatattaatatttgaaggggagaggaaaaatacatttgtagtagaaatattccctctaacaattctgtttaactagtaagttttttttaagttatcttccatgcctgcttccctagtctgaactccacattccagttgtcagaagaatgaatggatttaaattttctaatcattattttgggcccatgttagcagttgaaacaattaagttcctcactctttcctgcttttaggatgattttagactgtgagcataaaatcaaccctttctgtcagcacagaattgaacatcgaatggagcaaggtctacactctcagcctgtagctgtgctaatgttaggattgaattgttctattaattccctcaagagacccacagcctcaaaagagttgcttattatcagatgtccgaaattcagaaacccaaagtcaggcaaagaaggaaactgagataatgatttaatttttttaagtcactgcaggatttctctcaaagaaaacatctgaaaatggttgagaaagtagttccagatcattaactattttacagagggactgaaagccagggaaaataaagaacagaatgatagtagtatcttgatattaaatttgcatcagaaatgagcaaaatatgtcaatatgaaataatttgaaatcaaattcagattcacatgtatagtgcatagttcaagaaataatgcttactcttgtaaaaaaaaaaaatatatatatatgtatcagcaggtagagtgtgggagctccaactttgttgtgaaagctgataacagagtatgattctttccagttacaaaatactgtattactttagttatagcaagcagtacataaatgacatcaacaactcaggctgctccctgacataaaagccagttccatctttactgcagatgacaggagactttccaagacctgcagaggccccctccaccccaaccttagtgcatgctcacacacacacacacacacacacacacacacacacatttttggcttttgacccactctgtgtgttccactgaagttatcttttccttaatagattcacacagaattaccccatcctgcaaaatccttatccctatgaatctctaaaatatattaaataatgtgttatatatttgctttttgtaaatctttatttaattaatttatatatactttgtgaagtcttatactgtacatcataaagcgatgtcatctgtagttggttcaatataatgtttatgatcattttgataagaaataactttggacattaggcccttgttaagaaataaaacacccattataaatttgcttctgttggaaaatacatgatttggcatacttcatttttagtaacaatctattctagataaatgataatttggggacatctgtacttaaaaactagctgaactacgttttgggatgagatgcaaagcaacagctgtccctggaactgaaatgtgaatttctagcagaacagaaaatattataataatgaggcaataataaaattaggaaattaaattat

SEQ ID NO: 2215 - DNA, 4989 bp, Homo sapiens
agcttcttctctagagggaccaggaggagtcattctataatgaagaggcacggggtggagcccggggacaccctcggtggcattgtcgggccacatacctttcccctcacatcctgcgacagctgaatccgagcccgaggaccacgtgcggggcggtctccagtgtggatggcagcccggctggaacgcactggcaggtggtccctgtgccccagaggccccgtttccttccggaagcgaggctgcaactgctccagatacccagcaggaaggccacgtgacaacgggaggggcactcctgtgtgtgtaggggcgagggggtggcggtgccagggtcctgcagttcaccaggtgcccacgtgcctgccacccgagcgccattcactcccgaccgcggggacctggggcacagccgggcccactgcggcgaggcgaggagatgtggggagaggaagagcggcgtccacgatgtgctcatttaggcttgattttcctcctgccctcctgtctccctccctggcttcacccacaaggctttcttctcgggctgatttctgtgggagctctctaggcagaaccctcagtctctgaaagtcgggttcgtcgtccgggtctgcgcagggcatggatcttgagcgcttggaatgtgacttaactgagaaacgctactttattttaataagtttacatctaaaagccgatcattgattccattatttggaaaacaacttctaagtgtgtttggagcaactcggatattggaatcttttaaactgtaaattttatgaaatctaaataacgaccaaatatctacaaggaaaatctagcatctgaatcgagtgtgctgtcagtgtaaaacacacaccagatttcaaagatttactgcagaaaaaaacacatgaaaatactggttacatgtggaaatgatagtattttagatctgttggattatctaaaattaaatttaaattaatgtcactggtttttttttttttacctttttctagtgtggctaccggaaagtttaaatttcatacgtgtctcatgttatattttattacatttctctcggcctgtgtgctctagatggttgatttggctggattgagatgaggtgatggccatcctaaaggagggcctgagttccctctgccgacctatggctctcactgctatgcctccctgatcattcagccagtggatgtggaattcagggagatgagagatgctcatttcctgctccaggagtgctctccccagtggggtgggagcaagtccaaggagtgagtgcttcgtgggaactctggcttcccggctgtcttcatgcctgtgcgtggccatgacacctggcaggatgccagagcagggagagcagaagcatcctgtgttctagcagagtacagaccatcagaaatgtttcaattccaaagctgggccaggtactgtcacccactggagccaaagtacccttgaacagttcacctctctcaggcttagggtgattatagtgaaaattggatgcttttctaaataaggcaaacaatgatggtacctattttataacctttactggactgcctctttttgccccagtcagaatgtgaagtctggatttagacaaaagattatttggacgggtgatagtatgttttgcaaaaagaattcaaaataaggtaacaggcaaccaagaggggctgcccacctactaggtttaatactctcaggagtaaagagacataggacctgttccctgtatcatgtccccttggttgggaacacctccctcttttccatccatctgttcaaatctgagctatttgttcaaggtgcagctccgatcccacctcctccagggtctttatttaattcctctaggcttcccagcaccattaagcagcttcgcgacctgcagccacacatgccataggcctccatcctcaggaaagtgattgagtctatcagcttattttcctttggagccaggttctaagaagtggatgcgagtgacattattattctgattagttacctatccccataacagggagctacagagtgctttgcaaatagtaatgctttaacctcgcctccaaaaaaaaaaaaagaacagcctgatgtgaaaaacatttataatttcttgtagttacagtgtgtatcttcattataatcattcttacaataaatacagaagtgctaaacagaccattatcacagtggcctgtgggctgaggcacaggaactgaggggtgctgcagacaccagtgcttctccagggctggccaggacaccttcagagaggctagtgaagaggagaggaatgtagggtgaatttgaaatgtgattaatagagtcaatgcagcacatgctagaaacagatacagagttttttgttgttttttaactattttaccagatgatactaactaaacaaacagaacaaagaaagagattcaagatctcacatgagtgagaatccagggccttcccctctggccctggccccagcctgggccttgtttttgctatttccacctaggcatctgccatgcagcagagttaggagcgtgtgggcggctgctgagactcacacaccacagtactggcatccttcaggggcagctggcatcagtggaatgagtgcggatccgaagaaaggtttcccagttccaaagctggacccacaggaatcctgtgaggatttgcaaagacattgatagtgttggttcttggagcatctttctgcctcccgggctttgtctggtctcagcctcggggctgcaatccagggctgtgctgagcagcaagaggagaggagaaatgccactgtcttgcacctcccagtaagtctcccttttcatgaacagcccttgtgccaggtacaatggtctctctgttctctcacaaaactcatccacaaaagatatacagagtcttttgacagacagtcccactgctctggagtcctttatgttcatttctgattgacaattttggaccaaggccaagaggccccctaattcatgttgcttcgtcatgagggttgtccttgtcatctgatgatgcatgaggcatgctaatggcaaggccgggatgccaccccaggcttcgaggctgttagaggtcttgagtgcacacacacacacaaacacacagagagacacacacacatttgagctcccattaggtcacttgtaactttgcctagcaaaacaggctcccaagacataaggcttgccatcgttgtgaaaagttgtgatggtacagaataatttttttttttttttttttgagatggagtctcgctctgtcacccaggctagagtgcagtggcatgaccttggcttactgcaacctccgcctcctgggttcaagcgattccagaagagagaattcttagagtcagagggaggagtagaaggaaaaagatatttaaaaagctatgcttcaagaggacatttcatgctgtcaaaatgagactgtgaatcagaaagttctcggggaactgcaaggtgctctcaactaggggtcggttccttctcagtcatggcactgactcatctccacagggttctcacctgcgggaggaaaatggaggagttgcgcctgtcagaaactgtctgtgtgattcggggaagaatatggagtatcttagtagcattccattattacttgcccctaaatacatgatgccagccccctgcacagataacctcctgcttttatagcttgaaatatatttgatctaaaccacgatttgacatcttcagagagagagaagtagataaaagtctccattccaggttggcagtagggatcctgcagaagtggctgaaatgaaatttggcctacagagaataagttctacagtcattttgtttctgcctatttcctccagattcaaaggcagattgggtcatctcggaactcatgtctcctccaggacacagcaacaacacattttcaaggaacagcctcattatttgtaaaatctgtagagtataaaacataactgctccactgacaggaggttggatttggacttaatattgtattattctgtccttacattatggcttgataaacagaatgtgattccaattctgattccaaagtgagactctcccagatcatccatgtcttctcattctctttgtccctctagctctctctcccttctcatccccaccaagaagtggaacttgaacctgccattccctaaggtctgtgcagtgtctgtgatccagaggacaggactgtgaaagtgtccctaatatatcacaatgtatatctcttgttttctttttctctctacaacttgatccttcctgtccccatttgtccccgagttgtaaggtgcagattaaaggttttgtcatagcagaaggaaatcagagggagatgccccgtctccagaggaaagaagttgagtttcccaagcaaaacctaagcagagagtgcacattcttgtctgaaagcttggagaagcagcagaatttccaggacacttgaaagcacgctctggcaaagccccggatgaaagtgttttccaaccattaatggcccaccagcatggcttggtttgtgattccagaattcagaccacttcacaatctcacacagttacagcaagcagctttgaattcctgctgcttggtctgagagtgcatcccatccatcgatcggatggctctggggtggccatggtcccaaggcaaggaggcacccagcagaggatccctgaggcctggcatgtttgcagattgagctacagagaacaccttgaggtgtcgcaagtgtccagagagccgaagtgtgtagggtccaaagcaaggtccttcctggatgtgcccgggagctccggggacctcaagcgtgggcctcagtctccatcttggtggctggcttgtaaatgactcccttgttatcaccttttttgatactagaacagaaagaacacataactcttgttagagaggagagcgagcgagc

SEQ ID NO: 2216 - DNA, 1200 bp, Homo sapiens
tatcagaccaggagcagagaatttataatatgtgctttatagcaaaatgtattaaattgtggttaaaatttatagctcatatgtagctgctgccaataagaaggctcagaattgttctgtggattaatttttacatcctgttttctgtcacttttaccaatcttcttggcctcatgtacaataatgtaaagccaatttgatgaaatggttcaggttgtagcagtctataaattgtcggtacattcagctcttctaggtgagcaatactgctgctatttttctagaaatagcaatcatttaaaaatgccaaatagctaactgctaccaactctttcttgtatcttgtctctttagagaaggaaatttttgtgtgccagtaatcatcaaagaggtgttttataagagtgttgatgttcagaagttcatgaaagtattttatccgtataatttgctagtgagctaaaacaatataatttatgtaaatctttatatgtacaaaatatatagtctgttgtacttgagtaatttggtctatggaattttaaatgccttcatttagcagtaatattcacatttttattttagacagttaagttcatgtgtttgattttgtcatgtcagcataaatgagaaaaagaagtggatcatgcagctaatgagtaaccaacattttgtaaagttttaaagttttagcaaacaacattattccatctcatttaaaggttaaaaaagaagagacaactctagccaaagtagaaatttatattctacacgtccaaactgtctcctagcagcttttggactatatatcacttgatgttaaagtatcttttatttgtaataaatattcaaatttctatttagaagctctaatgtatacctagattaaatcaaatcacagttttatgcttttaaaatatatgtatttcaaactgtatattttaatttctgagtgcatgttatatagtatttaatacttcagatgtcttggcaaattcaatataagtatttattcccacaagcgatatatgggatatctcttaaaaattatgaatatgtaccatttccttcaaagtcatcctagcctatgctgtatcaaaagtattgtatattttatggagatttagtgatatacatgtaaatgttttttaagttattttattgaagttcaatctttacataaaattaaaatcttttttt

SEQ ID NO: 2217 - DNA, 3996 bp, Homo sapiens
ctctcctctcagaagctgcagccgtgatggaagtttgaatgttgagccgctgtgaggcgaggccgggctcaggcgagggagatgagagacagagacggcggcggcggcggcggcccggcccggcccggcctgaagcccctctcagcaacccgtgagcatccgcgggggcggcgccggcagcggcggcgtttctcgcttcttcttcgtcttttctaactgtgcagcctcttcctcggcttctcctgaaagggaaggtggaagccgtgggcttgggcgggagccggctgaggcgcggcggcggcggcacctccccctcctggagcggggggagaagcggcggcggcggcgcccccggtggccccggcggctgcagctccagggagggggtctgagtcgcctgtcaccatttccagggctgggaacgccggagagttggtctctccccttctactgcctccaacacggcggcggcggcggcggcggcggcggcacatggagggacccgggccggttttaaacctctcgtccgccgccgccgcaccccccgtggcccgggctccggaggccgctggaggaggcagccgttcggaggattattcgtcttctccccattccgctgccgccgctgccaggcctctggctgctgaggagaagcaggcccagtagctgccaccatccagcagctgctgccgcagccattacccggctgcggtccagagccaagcagcggctgagcgaggggcatcagctaccgccaagtccagagccatttccatcctgcagagccccgccaccagcagcttctgccatctctctcctcctttttcttcagccacaggctcccagacaggacagccatcatcaaagagatcgttagcagaaacaaaaggagatatcaagaggatggattcgacttagacttgacctatatttatctaaacattattgctatgggatttcctgcagaaagacttgaaggcgtatacaggaacaatattgatgatgtagtaaggtttttggattcaaagcataaaaaccattacaagatacacaatctttgtgctgaaagacattatgacaccgccaaatctaattacagagttgcgcaatatccttttgaagaccataacccaccacagctagaacttatcaaacccttttgtgaagatcttgaccaatggctaagtgaagatgacaatcatgttgcagcaattcactgtaaagctggaaagggacgaactggtataatgatttatgcatatttattacatcggggcaaatttttaaaggcacaagaggccctagatttctatggggaagtaaggaccagagacaaaaagggagtaactattcccagtcagaggcgctatgtgtattactatagctacctggtaaagaatcatgtggattatagaccagtggcactgttgtttcacaagatgatgtttgaaactattccaatgttcagtggcggaacttgcaatcctcagtttgtggtctgccagctaaaggtgaagatgtattcctccaattcaggacccacacgatgggaggacaagttcatgtattttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaattgatagcatttgcagtatagagcgtgcagataatgacaaggagtatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaacaaacttgaataaactgaaaagggacctttttttttaatggcaataggacattgtgtcagattaccagttatagaaacaattctcttttcgtgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccattttattccagttttataaaaagtggagacagactggtgtgtatacgtaggaattttttccttttgtgttctgtcaccaactgaagtggctaaagagctttgtgatatactggttcacatcatacccctttgcacttgtggcaacagataagtttgcagttagctaagagaagtttctgaagggttttgctgcattcttgcatgtatttgggttaggggaatggagggaatgctcagaaaggaaataattttatgctggactctggaccatataccatctccagctatttacacacacctttctttagcatgctacagttattaatctggacattcgaggaattggctgctgtcactgcttgttgttttcgcatttttttaaaagcatattggtgctagaaaaggcagctaaaggaagtgaatctgtattggggtacaggaatgaaccttctgcaacatcttaagatccacaaatgaagggatataaaaataatgtcatagataagaaacacagcaacaatgacttaaccatataaatgtggaggctatcaacaaagaatgggcttgaaacattataaaaattgacaatgatttgttaaatatgttttcttaattgtaacgacttctccatctcctgtgtaatcaaggccagtgctgaaagtcagatgctattagtacctacatcagtcaacaacttacacttattttactagttttcaatcatatacctgctgtgaatgcttcatgtgctgcctgcaagcttcttttttctcattaaatataaaatattttgtaatgctaaaaaaaaaaaaaagaacatagaagacaaacatcagaaataaacccatccactatggttaactcatttttgaatatggtgtaaagtcagtttaatgatgaaataatattattttcaacaaatagtacagaaattaaactatgcaaaaatactattaataatgatgttggatcattacctcacaccatacccccaaattaactcagaacatggcatacaccaaatataagagcaaaaactatgaaatttctagaagaagacagaaaaaaaattatgactttggcttagttgtttcttagaagtaacaggaaaagcataattcataaaagataaattgaaaaatcggacgtcatcaaaataaaaaatggtttatcttcaaagtcacctgttaagaaaatgagaagacaaatcataaagcagggagaaatttttgaaagtcatgtatctgataagggacagttaaaactaaataaaaacacaaaccatccaattaaaatgaataaagggttcgaataggtatgtcatcagagatcatataggaataaccaataagcaaacaaaagatgttcaatatcattagttattagagaaacaaaatttaaaaaccacaatgagatgacactacacatttgccagaatgatgattattaaaaaagaccaagtattggagaggatgtgaaaaaactggaacctcacacattgacgatagaaatgtaaaatgaaatagccaattcagaaaacattttacaagttttctttgtttttgtttttaatttattatacccttaccctatgactcagtaattccacttctagatacctaccaaataaaattaaagtttataacttcacaaaga

SEQ ID NO: 2218 - DNA, 1721 bp, Homo sapiens
acacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggcactttcccacacaggatggagccgggccaccctcacagctcctgccctgcagacgctggccttgtggagggaggcaggcagcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccgtgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaat

SEQ ID NO: 2219 - DNA, 2116 bp, Homo sapiens
tttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaat

SEQ ID NO: 2220 - DNA, 6635 bp, Homo sapiens
gaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctggtgaa

SEQ ID NO: 2221 - DNA, 6636 bp, Homo sapiens
gaacagctgcgcgcccgcctagcgctgcgaacccggagtgagaggcgcttcagagactggagggacggacctgcaggagccagggctgcccgccgagctgcagttgccgctactgccgctgtcagcgcccgactgaagagtgacagccgcaaaagcaggagtgagcaccgaaccccgcgcttctacctaacaggtgcatgcgccgatctggtgagtggacccagctcacaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctggtgaaa

SEQ ID NO: 2222 - DNA, 3585 bp, Homo sapiens
ctacacactgtctgcgctgctcccagcacgttctgaaatgtcatatttatgagtgattatctgatcactgatttgggtatgaaaataagtaagagctcctgaatgctgcaaaaagagaagagtgcagaggagggtgtcaagaaatgattgggtcactgaatgtttcttgtgtacctgctattatttgcagggcaccagggagtgaggaatgcaaaggcgaataatctccaaagcgctttcagtgtagcccaataagcaaagggtcaggggtctgcgcagttatcacatcagtttgaagtatagaccacacatcaggataaatcaggcaagatctttgttcttgataaaatttatccttctgtgtaactacccagtgagcttcacagtctcctcacagataaatgtcatttttattttgaaatgtttatatctgctcaacaattaccgcgctcatgtcagtgtgctgaaatgagatcaacccccaaaccagttatcttaattgcaagtacagattttgatactgaatgtatttcaacattctttttttgttgttgttctgttctttgggataaataatagataacacaaaacttccaagtcccagtgcaggatttcgaggtggttgtgctactaggcgttatattagtgtcagagacctgacaaaaccagcctcttttctacaaatccaagaaaagccttctttgtatcagttctgcacatatttttgtataattaccattgctcattgcatcagcaaatcctgccagctctgtgttaaaaatctttctagactattaacgtatttcaccatctccctatcatcaccctggaccaagccaccatcatctcttgcctggattattgcactggtctcctaactgcttctacttctgctcctacagtcttgtatcaccagaacaaaaacagggaccctgcttataatccaaggctggtatgtcactctgctcagagcctgccagtggcttcctatctcagaaagagcaaaatccaaagtcctctcagtggcttacaagactctacatgtttggagttatcccaccagcacctctctgacacatctcctgccctgcccccaggagctggctggctttagccacatagcccctttcttgttttctcagggcctttgcacatccttgtaaaagtctcatttctcctccctcccgtgttcctcaccttgttcaggtccctcccttctcaccttcttcaggtctgcccagcaagacctttccttgattccacttcttaatgcagcacagcctcactgcagcttcctcttccttgccttatttgttgactcttttcctacatcagaatataaactccaagacttcagcagtttttgtctgcttggttcactgccacacccccactgcctagaacagagctggtatattacaggcatttgataaatatctgttgctcacgcaagcattcaaccactatttattcagggcctactactatattccaggctgcatgttaaaaaataatcactgcccactaggagcttatagtcttgcgagggagacaaataaatatagtataaagataagtaagcctatttcaggtggtgataaatgccacaaagaaaataaaattataagatgtgatagagggactgagtgtggaatactactttatacagagtgcctggggaaggcatctctgtgaatgtgacatttgagctgaataataagaaagagacagccatgggaagttttggaggaagagcattccaggcacagggtcaaacaagttaaaggggcctgagttatgagtgagctcacattgaaagtttatgtattgtgtcatctacttgtatcctgtgaatctccaaagtacccttgagatgatcagtacagagtcaaatgtgagtgataccgtgtgcttattcactacctgcagcctactatcatcattctctacatcttgacataaggtagtcatcaaccaccagctagtctactgcagaaaagccattggtatttccttatggaagccaggtaatgcatgagagatataataatgaatgaaacaggtgatttgaaacacaaggaatgtttttctagttaattttgtgtgttctgtttcttgcctattggttggtatcacagaattcaaaaggaaatactactggggaactctgatgctgggacttgagggcctgagtgtttataagaagagagtcataactctttagcatctccagtatgttaaatatgcttgattgcaagggattggggaggatttggaaacccactagccctgtgtttagtctcaaaccagtttctaatgatggtcattgctaattgatggtcattgctccttttcaagtaactctttgtattttcctgaataagatacagtgtgcctgcaagtaacctgtcctttgatcctaaagtggaggatactggaaacatctctggacctacattctcatctcatttgcatcttctcccccacctactgccttctcttcaaaccagcttcccctcccactccccacagtaatccttcttatccaaagtttccattaccatggtttcagttacccatggtcagctgtggtttgaaaatattacatggaaattccagaaatataactaattcataaattcaaaattgcacaccattcagagtagtgtgatgaaatctcccactgtcctgcttcgtcttgccctggacatgaatatccacacctctacactcccaacccatgagtcacttagtagccatctcagctgtcagatcaactgtcttagtatcaccctatcacagtgcttgtgttcaagtaacactcagtttacttaataaatggccacaaattacaagagtagtgatgctggcaattcagatatgccaaagagaagccataaaatgctgcctttaagtgaaaaggtgaaagttctcaatttaataagaaaaaaaaagttacatcccaaggttgctaagatctatgataagaatgtagacattgtgaaatttctgtgaaattatgaaggaaaaatttgtgctagttttgctgtcacacctccaaacacaaaacgtatggcacagagtgcatgataagtgtgtagtgaaaatggaaaaggcattaaacttgtggattgaagacatgaagagaaacatgttccaatggacagcaatcaggttcagtactacctacggtttcagtcacccactgagggtcttggaatgtataccctttgtatgaaaggagactactgtattctgcataccaaagatttaaggaaaggaatgaggaacatgaagagaaatataaagttaaaggggaggaagaactggtgaaatgaagtgagtgcctttgagaattgaatgaatttaatatatgtgaaaatgatctgtacattgtaaaacaccattcaagtgtcagaatcattattttccaccacttatcatggtgcttgacaagtcttcccaataaatactgaatgaacaaatgaatggcagaaacattaaaatgaacactatggggaaaggggaagagaggcagaatcagaaattatcctgaataaatatttattccatttgtcatcctcc

SEQ ID NO: 2223 - DNA, 2723 bp, Homo sapiens
agacggcggcccagcagaggagcggaaagcatggtccggggggcggcggacgcctggtaggcgctcgggccgttgttgtggggctgcgcgctggcgctgcagggcgggatgctgtacccaagagagaggccgtcgcgggagcggaagaagctggaccgcctctggagcttccgcgccgacttcttcgacaaactgtgccttggcttctaggagtagtggtatcggcgtctgctgcgagagtcgggctccaccatggacataccggttccctccagcttcaacgacgttggccaggactggcggctgcggcattttgtagaccagatgtggtacgaacgggaggtgaccttcctggagcaatggacccaggacctgcacacaagagtggtactgaggattgtcagtgcccactcctatgccatcgtgtgggtgaatggggtcgacgcgctagagcatgagggatctacctcccctttgacaccgacatcagtagcctgttccaggtggggcccctgccctcccgcctccgcatcactatcaccatcggcaacatgctcatctcctccaccctgccaccagggagcatcctcgacatggccgacacctccacgtgggtaccatcctgcttccaccgcagacacccaccttcctgtcccaccccgtggggcattacattagggtaattacattagtgtcaagatatgccataatactgagaatggaggagtctgaggccctggtccatcaactgacagcatgaacttcacgtcaagaagtgagattggtgaataagtgaagacagaaggaaaattggagatacagctggatgtatgaaccctgctctgaaaacactctttaacgagttggggtcttgctctgtcgctcaggctggagtgcagtggcatgatcatgggtcactgcagccttgaactcctgggcttaagggatcttctcatctcagtctcctaaatagctgggactacaggctcaggccaccatgcctgtccagtgattcaagtttgacacaccacaccacggtggatgtgccttgtcatgacacatctcagcagcactagaagatacatccaaagtcctgtgagcaaggtctgtggtatctgtttattatggcagcccagtaagactaagacaggccatcacaagacgtgaacgttttggaccttctcttgggccctagtaaacagaaatcaggctatttattaaactaatccacgttctgaacagttattgctactggaaaccagtcccgatccagaccacaaaagacgattcttggatcttgcacaagaaagaaagggaagatctggcaagagttagcgtgcagttctacattgtgacaattcatgagagctaaggactggctgtctcttgggacaaataggctttcttgagtctggtaagtgctccacttgatgcttgcttccatttcttagattaggttctactgtggtaaggcctcaaaatctcagtgtcttgcagcaacactggttcatttcctgctcacattacatttggtctatgacggtgacaagttccaggatccagactgaaggagccacccccatttggaatatgctgttcttgttgcaaactgggggaaaaaggccagataaggaatggcttttaatgcttcctctcagactgtgttatggtttttttctcacattctattagccaaagtaaatcagtggccaagctgacctcaatgggacaagtaaatataattcttccaaatggaagtcctgcaagtcataggtcaatggtgaggatatataaaacacttacaggaagggccctaataattgggagcaaaaacacaatccatcgcattcatttatactctttctaagcttttggcatttgggtttggaaatctaatttatttaggagtcttcttcaacaccttctagtgatgagatttctttaacccagttttcagtttcctttctttaaaattataatgagatgtgatgtgcgttgaagaaaccccagaagtgagaaactctcatcactacaatggtgatgtagacagtggaaaactgttcccagttgcctctaagtccatcgtgctatactgctggaatcaggtatcatacataatctttctgctgagaattgataggtccagcttgttctacatccaaataataattcaaccaatgatttgtgagcacctaccgggcactgtgccaagtgtggaagacacaaccttcagtaactcaagtttcccttcaggaactgacagcttaatttggaaacaaataaattaagaaggcaattgcattatggagtgtcaagtggatgatagtagtaagcaaagggtgttataagggtacataagaggggtacctaactcagggttgaggttctggaaaggttttccagagcaagcaatgagacctaaaggatgagtagacaagtcacgggagaagtaagaacattttaagcagagaaaacagcatgagcaatggtctgatatcaagaaaggcagagatagtgcaagaatacacaatgtagtagttttcaaaactgtttgaaattttaatctcacatttgttcttttcaatgtctaggatatcaattcattctgcgatttacctttgtaaagatgaatttagccctggttctctatatgaatactagaggaagtatattgataaaagaaaaggaacaaatatgtagtcatttctaagatttatttttat

SEQ ID NO: 2224 - DNA, 4196 bp, Homo sapiens
gtagggacctacagcgggcgcggcgccggcggtctgcggccggcggtgtagacgccccttcgccgggacctggcacccgaatccggcctgccgggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaagtaagaacagtgctcaagtggcagcagatactgactatggcttcatttcacagcttcacacagcagggtagcagaaaacaaagaatgtaagattggacccagttgcagctgttcaccaactctgtgatcttcaaaaagccatatagcttctccagacctgttaatcagggaagaagcagataactgaaggctggctttgagaagtttcgaggtaacataggaacctgctcatgcaggcactctttccatctgacttgggccaaggtgctccgtgattgacaagcagccagcctctgggagagcactctgatcagatcattgatagaacattcactactctacttatcatacccatttacttatctccatcttctgttagactccttaaaaacagcagcccacagcaggtgtggggataaaacagtcctgggcagtgctcattgtactcacactatgccaggcactgtgccaggaacattcaaatttctaagaatctacaaagtagatacctcattatacatcttacagagagcatcattggtgtttccaaggtcacagggctaggcaagggtggaaccctgagtctgcttgtctgtttgccccatgacagcccaggggtggtggcctcaccccacctccaggcacccacaagaatataaaatcttgtacaaggatgtcgatattactattgccattcccaagtgcacctgcacctgtagtatcaggtggtttgcagccttggctgcatagctgcatatgagaatcacctgggaagcttttaaagatcccagtatccccacctcttccccagttacagtggagtcttgcgggtggtgggggacatcattatttttgaagcttccaagtaattctggtgtgcagtggggtgaccagctgtcccagggacctcctttaaaaaataatatcccgggcacatgacaggccaattgccctaatgcaaccaaggttaagaactactggtttaatgggagatattttttctgtgcttgattatactgttttattaaactctgaatccatttctttctgcaaatttttaaggcaaaaaagaaatgtgaaaatatacgtctcatttttagcaccttcagagacccggagtcatttgatgtgcttcatgacataaaattttgtaatatgccgtgtgatactaccttatttttaccatatatgtatttttaatgcttaacaagagcatatttgctctttcacatttttttttcacatacaaagttttagacatcaagcactctaaattcttttttacaaatatttttttcttaaaatgttaagaaaaagcctataatatcacttcctttgtttcctgatgtagactcagttgatgtgcacagcagtgtcaagtcaatctccaaaatactccctgtagacagggtggggagaagaccctcacttcctgccgactaatgaactcatgttgatacagacctttgcctcatcagattcatttgttaagctaaccagtgtctgcttctctggacattactggactcttctacctgtgaagccatcttaaaaaaatatattgactgatttcttaacgaaacatctactctttgccaagcataaagttacctcccacttgcatacacccttttctcatttgtcctcacatcagctgtataaatgagaaatattcacattttataagtgagaacattcaggctcagataggttaacaagtttgaaatcatgtgctagtaaaccaaacacctaggttttgaaccttgttcttcttgtcccaaggtcattattctctactgtgttacactcagctgctttcacctggaaaagcagaggaatcaggctgtctcctgcagctgtcttggtccattctgctgcccaagcagtacacttggtttcagatggaaatctaggatcccaagcatgggtacatttgtcggcagcatttggaagtatttttcgtcatcaggatggcagtcaatttgcaattcagtcatctcagtgcaaggtagtttggcaaaaagattatgacacttaatggatttttttcctcttttaaatctgtttacccagcattttgtagtataatgcaatgtaataacattgcattattttgagcatagtttagaagccaagaagatgctttcaaacagctgacataattcagttatggcccagatgtcctgccttccccatcacacattcatattaatggtcttagaaagctgtttctgaggcaacagtttcttcctcaatatcatcctactggggaaattttggcagttgatgtctaatgttgatttttttttcctgattgattttaattgttcactgggcactttggggtagaattgttttaaaaatttggttactgggaaagctagacaagcctttgctatggtgaaagagacagaaggaatatagatataatttgtaagtggttatgccattgggcttaatgctttgcatacattatctagtttgcatctcctgatcgccctttaagtttgcttacggtaaagcattattccttgcttggcaatgcacagagaaaaattatttgctgaaggaccctgcaaatgagggacaggatcagagttggaactgtaaaccctgccactccatttcatgtgatcttcatgggtacagcagctataccctgccccagcaatgagtatggtagagccacattcaaaggcggactttggggtcagcattcctgaaaagagctgcttaagtttgcttctacatccaaaaacgatgcagtcacagtcaactaacactgagcttgctgggcatctcctgaacagaaatgtatgtggtggtccatgtagcatgtatgcgatataattggccacccacctttccttttcacattaacatttatcacagaaacacattcatttgctacagggatatttcacaatttggctgaactttgagagaagtgggtgaggaaaaggtagtttcgtaactagtttatatataaacctaaattgtagtgagtactcttgtaagtggagcatcttttctatggtaattataaatggctgttagcccctttgcactaaagctaggtgggtggttttgccacagaggtaaattatctttcgggcggtataaccaaacaaataaaatataaagtgagattcagggcatgttctgaatacagcagttaattaggcagctaagaaaactgtattttagcccctctgactatgtgattggtatttttttaaattaaaaaatggaaaataatatttttaacaggttatgatatgtcagtcatttaatcctcacagtaactctgtggggtaggtaggtactgtttctatctcattttacaggtaaggaatcaaaacagtgggtatacccaggttgtatatctagaaagtgatagagctgggattttaaactttataatctgattccagaatctctacctttaaacactatgttaccacttacttctcttcaaattttattgagcattagatgtttccagtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagtgagctcaaaatcaaaagaaaacccaccaacagtgaatgcattcagggctatttccaggtctttcttttgaagaaagataagactcagtccagagagcacatctgtgacacaccgtgcctcttgcctttggtgcgtggcagtcatctttggctcatgctgtaccttattctacattagaaaactcactgtatgttgctaaataattttttgaaaacaggcagattaataaatggacatcttatttattgcaccataaaa

SEQ ID NO: 2225 - DNA, 613 bp, Homo sapiens
tggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatgggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 2226 - DNA, 2656 bp, Homo sapiens
ccaatttggtttttgttttttattgagttgagtttcattcggcaaacactagccacatgagtgtcttactgggcctcaatgctcaccaccttccagaaccgcggccagccacccactgatgccattcaggaagtgtccattgtttggactgtttcttccagcacctcaatctccagaggagtgattttctcagtgaggactgcagtagtccctttctcacacctgtaccggccaagcctggtccccttcttgttgggcactgtgtatgggcggagaaaatccagcttgttcttgctgatgacgcagaggtcaatgttgcttccggagcccaggtcgttgaagatgccagctgcgatggcttcgctcaccagattcttggcttcctcctcctgagaaacagaacggcggcaataatgtccccggccaaactagggcctgctctgacatccgcaatgtacgtccactagcagtgcgcaagacctcccgcgagacaggtgttgtttttaatgcccatctcacagatgaggaaaagatctcaaagtaccttgattatttacccaaagttcccgacccaggcctttaaaactttttatgcatgcaccgcctcttgaccacatcagacaatcaccacaaaacgatgggctgacagttactagagggttagtaacttatctttaaaagggccaggtagtaaatattttaggctttgtggccaaaagtctctaccacacctactcaactctgtcacgctagcacaaaacagccacacacaaatacattaaaaaatgggtataactgtgttccaataaaactctattagcaacaggcagtgggccagatctggcccactgactgcagtttactaactatcccctgatcaagaatgtccaacaatagctgaaagttacttgagaaagtcagcactgtaggaggaagaaactaacaccaaaacacaagccggtagttctggggaaatgctggcagaccaagggcgggacctcttgcccagaataatctctctctcctactaaggaacctataggttcactgaagtaatccattactttgaatcactctctcctttgccccacctttaaacacaaatccccatccctaatagttactggtgaacagatggactcatccctttcttatccgagaagccccatcacatgctatgtcctatcacatgctataccagaagctagggctgcagaggtggatgacgcccccagatccctgccccctaggggcttaagagtctagcaggggcacctgacccaagtaagtacaatgcagggtaaggctggctaaagagcacgtgaaaaggagctgggaacacagctggtcagcagagcttcagggagggctgaaggacaggctgcacacgaggcactcagaaaacagcagtgaaacagaaggcaggcagcaacggcagtggtactggacctggggaacaccaagttcaagctctatatacaacgaggacaaaaatgaaccaggctccctgaaagcagggaatctaacctgtgctacggcgccttcccagtccacgagggcgtgagagtacatacacatgcaagtgcactccagcgctcacccaagcaacacccttggagaaacacggactccaggcccaaatccagcctgagaccctcaaagggcagatccgctaacctcaagttttcagaagatctgaacccactgggggctcctgctcctctgcctgccccatgccagactaggattccagtgacataagcgccctctacagactcagaaggacagagaaggttctgctggaagtgggctcctcagcaaaccagcagataggggttcctttgatatttataccccaggttttttcactctcacgtgacatctatgtggggccaatgaagccaattcttcttttgtacatatgcagtcctgtaagaatgcattcaaacgggatccgctaattaggaattttctcctggaattctcaacagtctatggggccagaagctttccacaaaccagtgaaggtggcagcaaagaaagcctcttagacgaggagctggcagcagctgctatctagatagacagcaaaaaccaaccactaattcagcaaacacaacctcatacctaaccgcttccctttaaatggccttcggtgtgtgcgcacatgggcacgtgcggggagaaccatacttattcccctgttcccggcctaccacctctgctcccccttctcttctctaccatttaactgtctcctctgctttgtttcttatcactgctgctggtgtctagagccagccagcagtacctggcagacatcgcgaccctgcgggcagcgcttaggactgcacatttacatttcccaaatgatctgggtagatggggacaggtgaagacttggggaaacggaaatatacgaatgacatgagacatgcatatctagtgtcaatccattcgactgggcacaggacagcagactgctgacagtgctatgtaagattatgagtgatcctccctctattttgcaaacagtctgtaagtaactgataaaactttaaaatatgcaaattttaaaattatatagtttgatttactcatcaaattatcatgtatgctgttatttaagtatgaataaaggcttttttaaattggg

SEQ ID NO: 2227 - DNA, 1595 bp, Homo sapiens
ggcttggaaggtgaggacattccatacagtgtgaatagaaatagcaagggcactgaggtaaaaggggcttttgagttttggagggatctggtatagcttagagtggtggttctccaattataacatggataagagttacgcagggagctcatttaaaatgcagattcatgggcacccatcttatcaatattttgatttggtagcctgaaacctgtaatttgaacaagttcatccagataacaaacacctttttatatagcagtagaggctgtgtgaggaacaatggcacaaaatcatgttgccacagtattggtgtgtacacgaactaatatttcagataggtgagcgtgtgagacaataagagattatgtcagaaaatgatgtcagctctttgaacttggttttgagagataatagcttgacaatggagctattattttcttccctaaaggccactacttcacaggaaatatttattgaatggctgaatgaatgaatgcgggcagaattctgagaaagcaaactgaaagtttccagaactgtgaggattgcttgcttgtttaacttgactgtaagggaaacagtttcagaatagccagctctgaaccactaattcaagccttccaaaagctgtcctggtgtatgcaatattgatatacgcatacattttcattcaagtctacaaacaaggtaaatgtaattatcttgtagatcatccgtgtaaacaatcatcacagttatgtagccactgccagatataagcccttggagctaagatctgggaacagagaacaggctcttacataatttcccagctagtcagtgttagggactctgattaatgctacatgacaggctttgaactttctattcagataggtttgcttgccttttggagttcctagcaagacgaaacgtgtgacctgcagatttcattctgaataaccatcatccagccaacaacactgacatggctctgtggccctgtgggtaaccgtttctgtgcctcactcctctgcccatagacaaattgcaataagagcgtcagggtggtttcacggaagtggaatacaacttcctaaagcccagtcgctgaagaaagccatggcaaacaggctggtgggctcttctgggtataatcagaaaagccctagaggagtggccagagaaaagaaactatagtagggaaggaaggagttctgctctctacccgccgccgtttataacagtctgtaatagcttcgcagcatctttccctccctgaagctcccgcggagcagttgaacacgcgcttccagcatcccagtcccgcagaggagctgtctcagttctgaccaactttctgagcttggccaagtcttcccggctcctccgctcaactatgggtccctccacccatcccctcatccccacgaaggtccaggtgaggggccagaacccagcggcagggtagatacaacaggggagggggaaacccatggagccaggggaaggctgtcattggccagccgcgctccagaggggagggcgaggaggtgggcgaggcagggcccacagacattggtgcaggctcagccgtgcgcccggtgccctct

SEQ ID NO: 2228 - DNA, 2249 bp, Homo sapiens
gatctgtatattatccataataagtggcctcatttagaaataaaggtttttataaggcttctgtaaattttacatcatggaaatttagtacaagtgaaactttttttttttccaaaggctttatactgttggtgtaatcttataaataggtcatagttaagcctttgaaaatgaagtatgtggtgttgacactatcctggtgttatataaactgactttcaagttaaccaattggattgtaatcatcatctatcccctttataaatgaactacactgttgtttttctgacttcgatgtgctttgaagtacagtgtagcatatcattctaccttgaatcctatgataatacagttgacatcttgctgtagtggacttgtgcatatagcacacatgatatagtatattgtattacagtaaactttagacaatgctacttaatcattttacttcatgaagataaactaacattttaaatatgaataatattaatggtctacaaaaaatttgagcacattttaaaatcatatttataaaaaactggccaaattggtcttatttaatgtataattcagaaccactgtgtagtatgtattcttttctctaaatgatgaaatgctaaagaatcatttcacgttgttgaagaaaataccgttgctacaacaacagcagcagctactactgctactactactactactactactactactactactactgacagaaagaattcatgaatgtaaactggaggatatcacagttttctttagtgaatataagtgaactacttgtgcgtgttaggtgtactatttgctatgtattttattttgctttattcagagagaaagttgattactgagtgctgaattatacaatttaggctaggaaactcgtaactttggtatttaataaaagaaactatacatattctgtttgtaatgtaaataatctataccccatgcacaaatatctgtttcctgggtgtgatatattaaagtatgtattcttattttgaggtatcttttggaaataattgaaagagattaaataacaatttatgccacatgaaaaataattacttagaagtagttaggtatcatgtcttatggctttttatgttccattttggctttttttctcatttgctttattactatatgtacttgcatgtaacagtttgtaagcatatattctgacttattttccttctgtcattatctagtgctgttatgccttcctatcagaatcgataagtcaaactcagaggtgtgattttggtgttgaagttttcaggacagagatactatttccatggatgcattttaagtaataaaattaggggaagtgaaatcagaaaatgaaaaatgattacaaaataactttcaggttttctataatcaatggctttaaaaagtagacagtcttaattaattttaaattagcttgctcagaaaggtcatgccatacagtcctatcataaaaggaacactataagaattaagcaatgaacagcatgatttctgatcacccagtgaggactgacagtgtataaaagatacaggtatgctactggatgtacccgataattgtttgagagttttctagtgaaaaactcaaatatgctagcttaaccacagtagtagggggcaaccttattatatgggagagcttcaaaacatactgtcattttgtagaaggagcccaggtaaggatgcctaatcctgtccagtttggctagaactccatagccaaaaatgcagatttggattgaacatttttttgatgggacttctatcaatgcttaactagtaaaaacacatcttttctataagactttagaatactgtggtttctaatgggttcttgaataatgattttgcattgtgtttttctagttaatggtttttggtagtatttaatgatagcacagtttggggttttattgttcttgaagggggaggatattgaatttgtttttcttagagaaaacatcaggtttgctcaaatagactaacaacctgttgtccttaagcacatactaccatgaataaactcaggaaacaattttcaagaaaattcgaatgcagtgctggtgatggggatttttgtgggaaaaaacaatggtttcaagtcctttcacaaagatcaaacttcagcctattttgttagactcagcaatgtctaaaacagtgttttttgtaatttattgtcattggtaattcaatataataaaacaattttgatagca

SEQ ID NO: 2229 - DNA, 5664 bp, Homo sapiens
tgtcccgccgagacctggcttctgtcccgagcgcccagtttagcgtaaaccgggaagcggatcgcgtggagtgaaagtcaccgcagcggagatggacaaaccatgtgggtgccctccaggtgtgtgcgaccatgaaatgggagactagcaggacccacgttggccaaccgtggacctggtccctccagtaggagtcgtgagccagctgaatttgaatgcaaagatggagcaagggccgactggagtcacactgacatccacccccataacatggggacagatcaagaaaacaaagcaggaagctgagaaaatgctggagcatccatgtgcttggccatgttagcagtagtgtcctgtgaggattgatttccaaaaactcctgttacatgaggaagacaccaagaagagcaaagaaaaggagccagggtggctcttcctcagctatctcttccaaatgcatgacaaggaagttctcatcaagaaggcaaggcaatacagaagtgttccacacagggacattgcaaagacaagcaagtcatcacactggagatttttccttccaggaaattgagaaagattttcaggactttgagtttcagtggcaagaagatgaaagaaatggccatgaagcactcatgacagagataaaaaagttgacaggtaatacagactgatatgatcaaaggcatgctggaaacaaacctattaaagatcagcttggatcaagctttcattcacatctgcctgaactgcatatattgcagagcaaagggaaaattgatagtcaagatgagaagtctgtcaatgatgcttcctcagtttcagcatcccaaagaatttcttgtattcctaaaacccatatttctaataagtatgggaataatttcctccaggaagcacacatgagagaaaaatctttccaatgtaatgagagtggcaaagcctttaattgtagctcactgttaaaaaaatgtcagataatccatttaggagagaaaaaatataaatgtgatatatgtggcaaggtctttaatcagaagcgataccttgcataccatcatagatgtcacactggtgagaaaccttacaagtgtaatcagtgtggcaagaccttcagttacaagtcatcccttgtaattcacaaggcaattcatactggagagaaacctcacaagtgtaatgaatgtggcaaggtttttaatcaaaaagcatatcttgcaagtcatcatagacttcatactggagagaaaccttacaaatgtgaagaatgtgacaaagtttttagtcgctaatcacaccttgaaagacataggagaattcatactggagagaaaccgtacaaatgtaaggtttgtgacaaggctttcagacgtgattcacacctggcacaacatattgtaattcacactggagagaaaccttacaagtgtaatgagtgtggcaagacctttgttcaaaattcatctcttgtaatgcataaggtcattcatactggagagaaatgttacaagtgtaatgaatgtggcaaggtttttaatcacaaatcaaaccttgcatgtcatcatagacttcatactggagagaaaccttacaagtgtaatgaatgtggcaaggtttttaattgaaaatcaaaccttgaacatcatcatagagttcatatcggagaaaaaccttacaaatgtgaagaatgtgacaaagttttcaatttcaattcacgccttgaaatacataggagagttcatactggagagaaaccatagaaatgtaaggtttgtgacaaggcattcgggtgtgattcacacctggcacaacatactagaattcacactggagagaaaccgtgcaagtgtgatgagtgtgacagagccttcagtggtcagtcaacacttattcaccatcaagcaatccatgtcatagggaaactttactaatgtaatgattgtcacaaagtcctcagtaatgctacaaccattgcaaattattggagaatgcataatgaagtgagaacttacaagtgttataaatgtggcaaatttttcagacttcgttcataccttgcagtttatcagcgaactcatactggagagaaaccttacaaatgtgatgattgtggcaaggtcttcagtcaagcttcatcttatgcaaaacacaggtgaattcatacaagaaagaaacctcacaagggtgatgattgtgtcaaagcctttatttcaggttcatgcctcattacacatcagagaatccatactagacagagatcttacaaaagtcatatgtgtggcaagatctttagtctgaggtcactccttgcaggacatcaggaaattcatttttgaggtaataatttcaaatgcaatgagtatagcaaaccatcaagcacaattgatgttagattcaaatcagcattgagttcagtttgagttgacttaacattgagttcaagtatttgttgagattaaagtgtttatgttaagaggattaggccaggtgcggtggctcacacctgtaatcccagcactttgggaggccaagacaggtagatcacttgagatcaggagtttgagagcagcctggccaacagaggtgagcacctttcccagtctgttttttgtttcttcaacaaaaactgatagagatttttatgggtattgtgttgaatcaaaatcacattgggttatgtaatcatttaacagtattaatttttccaaaacatcaatatgggttatatctttatatatgtttttaatcattttgatcaatgtttgtagatttcaatgtatgaatttctcacttctttccatttattcctatttcttactttaagttctctagcaaatggaagtgtttttaaattttcatttaaaattgtttattgttaatgtatgaaaattcaacgaatttttggtgctgatattgtattgtgcaaatctactgatgtgtttattagtcacagtagtattttggttgactctttgtgattttctacacagaagatcatgtcatctacaaaaaatataattttactttttctgattttgaggcatttcatttcttttgctagttcattgctctggctaggacttccagtatttattgaatagaaaaagtgagaacgttcttgcatcatgtgagatcctacgggaaaaggattctattttccctgcttggttatctccacattggtcatttcatcaatggtctttctattggtgaggtaaatttccttctccatctattttgtttaagatttctatgatgatcagatgctgaattttgtgaaatgatttttctccatctgttgagatgatgtggttttcatctttcattctgttcaagtggtatatcacattgatttgcttgaatatgttgaaccatccttgcatgccagaagtaaatggcacttgcatatctacaatccttttatatatcctcttgaatacagttttctagtacaagtggtcttcaagaagctcatggaaaaatacatattatggaaaaattgtgcatgaatttcacagtttttgcaccaaaataaactgatacaaatctgttataacatgtctgaacaggctctagtttgaggcactgagaaggataagacatgagtttgaaaagagactgtatcaaaggaatacaaattctgctaaaattgaaacaagaagaaacataaaatttatgatgagaacagttgcagtgtctcaggtctgtaattccagtaatttcagaggccaagacaggtgggtcacgtgagcccaggcattcaggaccagcctgggcaacatggtgaaaaccccttctatacaaaaaatacagaaattcactgggcagggtggcacctgactgcagggccagctactgtggagtctgtagcatgaggatggcatgagcctgggaggtcgaggctgcagtgagctgtgatcttgccactgcactccagcatgtctcaaaaaaagaatacttatggtaaagtttgggtagatgaattatgatatcattgatgctttatgaaaaggttatggggacgatgcccaaaagaaatcaacagtttgtaaatggataactaattttgagttgggagaagacaatgttgaaggttacacgtggagcagcaggcagaccatccacatcagtttcagagaaaaacaataatcttgtttgtgccgtgatgaagaggactgacagctaacagcagaaacaatagtcaggaggttgagaacaggctggttaacatggtgaaatgccatctctattaaaaatacaaaaattagctaggtatggtcgcagacacctgtaatcccagctccttgggaggctgaggtgggagaatcgcttgaacccaggaggtggaagttgcagtgaaccgatagtgccattgcactccagcctgggcaacaagagtgaaactttctctcaaaaaaaaaaaaaaaaaaaaaaaaaaaaagatgtcaagccccttctcttcctttctccaccatcatggtgtgtacttgactctgcttctcaccagatcttctcataagactatcaggattaagcaattcctggccaagaaaaaaagcaaaattgttccattccccagtggattcagatgaaaactggtaataaaatcaggtacaactttaaaaggagacattggagaagaaccaatccgtgtctataaggaattgtacatgagatggcacacatttttatgctgtctgagcattacaatcacgttaccatatcaagcagaaaatgtcaccattatctggagagttggacatgttttattgggaatatattttttctctctgaatctgttatgaacatgttggttggctgggttcagtaataaatatgtgaggcttttcatttcaaaaaaaagtcaaatgatgtaattccatagagtaccttaattcccgtattgctttttggttttttttgagatggagactccactgggttcagtggatcacacttgtggtcctcacacattcggaggctgaggtgggaggattgcttgagatcaggagtcttctgggaatcttctcgcctccgctaacccagttcaggatagacccttggactttactgttttggaaaatctatataaaccaatatcagtgtgtcaaagcattatgtctgtcagaaggttgtgaaagaagcttaaaaattactaagccaaagagaaaagtcaggctgggaactgtgtcagacaaacctgcctcccattttattcctaaaagagacagctacaaggattttttacaaagctacatagaggctgggtatggtggctcaggcctctaatcccagcactttgggaggctgcggtgggtggatcgcctgaggtcgggagttcgagaccagcctgactaacatggaggtaccccgtctctagtaaaaatagaaaattagtcaggcatggtggcatatgcctgtaatacctgctactcgggaggctgaggcaggagagtcacgtgaacccaggagacagaggttgtagtgagccgagaccacaccatttcactccagcctaagcaatgagaatgaaactccatctcaaagatgaataaatgaatacatagatacataaatatttaaaatataaagatgaggtttcaccatgtgcctgggctggtctccaacttttggccactagctatctttctgcttcggtctccc

SEQ ID NO: 2230 - DNA, 3179 bp, Homo sapiens
agagctacggtgacacttcgcgtgcggtgtaggcgcatcttcgctctgttggccgtggctttagtaagcacacacctgcctgctactctggttatcgtggcgacggcaggtctggattgccagacaggtttttctttttacctcgaggctttctctgaagggagtcggagcatttaaaaggcggcctcaaggtggattgagtcgggggaggattagcagtatttgcttaggttgtaaaaccgcgactttatctaataaatcgccattcaaggtgcaaatacaaacttggaacagagataatctgcctctgaaaccttccgtgggcacagaaatttctgcaaggaaagcatcagcaaccagaataatttggtgaggaagatttggcacagaataccctgactgaggtattgctccaaaaggagcaatcctctggggttaggagtcaattattaggtgcctacaaaacactctgttatttcgactaaacatgccttgctgtcaaggagaagaaagaactgtgcactgaaaaccagaacagccaaaaaagaatgtggctgtggtcatgggaaaggtctttgaataacagggaaaaggagacagggcagttgaaggaaggataagaaaaggctacttcctagcaggaattaataaactaatgtttttattatttaatagaaacccattcctttctttcaaataaggcagagataagttaggattggatgtagctatatagatccctatttctggcacaggctgatagcaataaaggaagtcagaacacaaccccactctcacccacatcccactttgcaaaaaccatgacccaaatgcctctgtagatactgggctgtggactgctggcaaagcctcaggagcctttgctctactgagtgatctacctttagattgacagcagcggctgtggagtaacatctgaatgttgattgacagtgcagtttgtgggaataaagcagggagggaaaccctttaaccagtttccatttcttggtgtcttaaagttttcatcttactaaagaatcaaaccgttgtgtaatccagaggaagagcatccctcatcctggcagccctgctctaccacatctgcctatccatagtgaaagacaccatatttttaagaaaatatgaaatgcagagatgaaaactattttggagcaaatgattttaaataaaaaggttgcatactcattttaaatgattttaattttctgaatattatgttccaactcaagatattgcacaatgctttaatattacacttgttatttttctcacactagtgagattttgataaacatagttgactttggaagtaacagagaatgttttcattggttaaataatttcaatgacctgtgaggaactgaaagcaagctattacattcatataaaagataagtacatatccataaattcacttggattcaatgaaaaataataaacttctcgtgtacttaataaaacttaaaaggaaacaaaattttaaatggtgcaaaaatagaatgtatttcttaaagttttgaaaacacttagacctaaaagaattctaagaatatctggccacattataagcctcttatttgtaaaagctaacacttgataattttaaaacaaaatctagattaaataaatatagttctgcattattaaagtaacaaaatctgtgatggtaaggtaaaatttccctaaataatataaacaaaaaacaacaccggaaagcaaatgtatcacgttatggcatcgataaacatttctgttcaaatgtgtggatctacagcattttctctaggtaacacacacagttgttatcacattagtatggaataaatgctgaaaaattaagaaatactaatggttactaggccaaagtcaattccaaaaaactcaattcttataaacttttattatagtgatttttactgtattacaacactttttttctctttttcctttgctttgtgattcatatttttagcagaggcatagcactggagataaagaaggggaaatatgcttcaggtgccagttgcgttttttaacttccattttgcacttttgctatttttagacttgttgctcatcagattcattaacacaccctacttttgctatgtttttttccttcatttccaggaaaactcaaccacagcattaggagaaaaggcaaaaacttcacattgcctgatacaccacttattcttgctctgccactgatttgtagtagctgtgtattactgcagtagcgctgttgtctctattaatgcttagagattccacaccatgaatttttttatggtcatcctaagatacaatgaattcttcacattttgtgaaaattataggcatctgacagctggtgtatttatctaccatcttcatcaaactcgaatattttataaaatacttgagaaaagatctctaccaaagataccctcatgaaacactctcttatcaaaaagaaaagggtaaaattatggattagttcaattgtaccttgaactagaaacactgattatgattatatttcagaaaacagttataattatttcattaaaaatgattcccatttagaatgatgactggagacttatttacaagaaaagatagagaaattttatgagcctaggattgtgccaggattgcctgtgagggcagttttttcaattgcatatgcatgttgagatgggactatttatgatcttatttccttattcattagagaaggagatgaccagtgttttctgggggttttttggttaattttgcatattctcttatttcaaaattaatctaattaattttattcatgtgtcactcagattgcatttgggtttaaacagaggacttaatcatagcatggacagaaaaggctcaccatctatctaaatgactctgattgcaccatcatcctcattgttcttgtggagtctcgctctgtcgcccaggctggggtggagtgacgcgatctcggctcaccgcaagctccgcctcccgggttcacgccattctcctgtctcagcctccccagtagctgggactacaggcgtccaccaccacgcccggctaattttttgtacttttagtagagacgggtttcaccgtgtcagccaggatggtctcgatctcctgacctcgtgatctgcccgcctcagcctccc

SEQ ID NO: 2231 - DNA, 1848 bp, Homo sapiens
cgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtagatctgtccccaggtctgtggaactgtcagttgtgaagttttgtaaaatggtcacccaacttaaaactaggaaattacgaagaagagaaaattgccctgtatctgttaaggtctgcctgtagatctgctgtagggcttgtcaccattggaagcaaggtcctacttcagtggcagatctggtggccttggagtggctgaagaccaccaccctccacagggctgggcccatgcacagccatccttccctaccttgaaactcctgtagcctgtaataccagctgtgggtactactctcagtgttggagatcatcaaaatacaattggaccagaccctttggaaataattctgtgtctcaaatgccctgtggagcacacacttaatcagttgatggctatggaattttccaacatcagctaaagagaagggatagagtggtgacttccaagcttcatgcagaaccggacaacagaaattgagagggaaatttctatgacagaagagagaaagaagaaaattgctggaataatgaccttgaatagaggaaatgggatatcatctggtaagcaaatagagaagctggctttagataagagcctggacaattcattcatagaatagcagaaaaggcagaatttatgtccatagatgcaagtggtatagtagatatagtgatgggagtttgtaaaagttaccttctaattgctattttttttaatgaaataagaaacaaagtcatcaactcaaagtgagtaatatgtaggaggtgattattgtttgaggagagaggagaatgtgtgatatcttttgttaattatggtaaaatataacacaaaatttgccattttaaccattttaagtggacaattaagtgtcattaattacattcacactgttgtacatctgccaccactatcttcttctaaaactttttatcacctcttatagtttaaattgtgcccccacagaagatatgttggagtcctatcccttaatattaatgtgaccttatttggagataggatctttataaaggtattcaaattaacatgagatcattagggtggaatcctaatccaatatgattagtgtccttataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttagaatacatcattctaaatagaaattttttaataattaagtattttcctctccttggagcacttggtaacttctaattctactttctatctctattaatttgcctattctagatatatcaaatgagtgaaataatacaatagttgtctttt

SEQ ID NO: 2232 - DNA, 737 bp, Homo sapiens
cagaagggtcccgactgcgctcgcctaagttggggccggcagagtgggttgggaggctggggctgggcgagactcgcgggcccggtttaaatcaacaaataattgccaagtcccctcctcctctgggactacctcaagatataacagatgttggaagacacgaaagaaaggtcaaggtaatccaagatcacaggattccttgatggcataactggaattagaaaacaggcatgactgtaaggaggaactacggaatgctaactacatgcccggctctatgctaggcacattacatctgtgatttcactgatatcttttaagacacctaatgaggtggaatgccacatccaaagacattacaaattcttcttatgttagggaaggcaagacacccccacctccaacagttatgcagcatcagcaaaaacagagtccaaaacaactgtgcatcacactgggagccagtgaaggagagggaacggagagcaggtgttcggctgcctggtgaatggtccatttaaaaattcaacaatagtcagaggggagtagagagtacaacagccaccaccgtaattggtgaaatcaggatttctcaattcagtgtaaactcacaccctaaaagaaggcacactataaagcagatttccataaacccagcgcatcatttactcttaacgatattattttaaaagcatgctcttcaggcaaaatcgctgaaagacctactcaagcaacaa

SEQ ID NO: 2233 - DNA, 5115 bp, Homo sapiens
tgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactcggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgtgtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggagtttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaaaaacacacacacaggcatgggctcacctcttctgctggaagctcctctgtcctccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgtgaa

SEQ ID NO: 2234 - DNA, 534 bp, Homo sapiens
ttttttgcaccaccgcgaccagccttagagcgcggcggcggcggccacggcaacatcagcccagccatcagccgagcagacgcccagcacccgggagcgcggcgagcttcggctcagcccggagttcacctccgagtgccccgggggctgagctcaccccttctgctctctcacacacgaacactctctttcactcacacacacacacgtattcacactctctcgcacacacataggaccctgggcgcaagcacccttctggcagcggtcgtccgctggtgcaatagtagctaggttcggttcctgcctccggcggccgccggtttagagcaccgctgccagcagccggaggagagcaatgcgggggcccgagcggcagctcgaacagtaatgtggatttacagtcgtttcccgcaggagtcggccgagacgccctaagtcccgggcactggcagcgcccggcggagccgagcacctggcgagggggcgggggaacagcacctggggacgccgccgaaacttgcgcttggaata

SEQ ID NO: 2235 - DNA, 3810 bp, Homo sapiens
gaggttcagtcattcttgattttccatcttcagagtcccttataatctgctcccccatttctttgaactagctcaagtgagtctcatgccatgttcccagagtccttgctagaacaaggaccttggcccttcactgagtgagcctccccaggcctcttctgtccctttctccccaccccaatcctgtcccagtgtagggaagagcaggagccctcagcacagttgcaccttttattcactgtcagtggggaaagaaacacaccacacagcacagggttgagcagtgagggcagtcactgagtgcacagccagaagcagcacatctggaggggatagggggctacactggaactggcctccttcccctgctacccagaccccccacttccccaagcctcctttctactgctgcttagaaggccctgggcctgactggcctccaccaagcaggaagggctatacaccctggcaggcccagtcctgcccccacactctggcaaaggtaaaaagaaaacctcgaaaattccagaaagaaaatcccatatttttctgactttttaattccaaggtttgaattatttcttttttcaagaatgatgaataaaacatgtaagacattcttgaccccacagtgatctctaaagtcagctcaaagcctcacccagggtggatcttcaggaaatatttgttgcttcaatacatttttgtgtaaaaaatatttagtgtcagcttactaccctgcctggagaccccagcttcttctctttcttttctttcccccatcccacgccattccttctctctctgcagcaaggcaaatttctacctctagagactctgccattgtcaggaaaggatttagtgcctttacttatgaactaactttttcttcacttttgatatacaggtaagttaaataatcctgactacagctgaaaggactaaagtggccatctgaagtagcctttgctgataatttttagagataagaaataagatgctcatcaattagcccaaaaggatgaatgagggtagagtatgtgagaaggcagattctgggaccttgcaattcacagagttgttgcaataagattggaatttaaaggagagtttgaatatatcaatgttttgattgtctgtatatttttgtgtctgtgcaagtcatacataaatctctgccagccttgtgctttgcggcaagtctctctcagctggtgcagggacgggagacctgtgtctcttctcaaggcagggccagtgctctaccacagtgctcctgagcacacagtccctgggacacccaggagtatgcaggagcatgtcctgggccacctgttgttccttccatcagcaagatggtggtcccagttcctggcctggcattgtgtgttcacactgctgggctgtctgagaatattgggcctgaggagcaaaaatcacccatgggtatgtgtgtccagaagcctggagtaatcaaacacgccttcatgggtaggcatgtttctcttagtgaagatgatggtgggtaaagacaatgcaggatgcttcgagggttctgagtcagaggactcccaggacagcactgagctgttagcacagctgccagaggcagaacactgagtgcttgaaaatgtggggacttcaaccaagctcctattttttttggaagaccacaatctcagaagctttttagcaggaagcctataaaggatgaatatcaatgtaacttgccctgctgtcaacctctgcacagcttagtcacagaaatggacagggaagagactctgaaaagaagaaatcctcttagagccttggttcaagtcttagccctgtgtcacctcctgactatgtgatcttgcacaagggatgcttcctctctgaatctcagcttccaagtctagagaaaagaagtgaaaatcctcacctccatgggatgtgagtatagaatgagatggggcacatggcaagcctttgaaagccatgaaattctgtgtggttgcgaattaggctagattcagcatttgcagggaaggaacctcacttagtgaaaagcttttcaccagaagatttaggtcccagctaagccaggctggtgagcatctatgtgtctgtgatgctgactgaccgcacaagacatacctaatagccagttcctgggagcaatgcaacatccttgaggcattgctggataaacaactgctagttcctgcctgaggatgtgaactccccagcctcaccatatggctggtcatgagcaagaggatagcaaaaggatagcaacccagtggttgcaaaccagtggttgctatccccagcaagaggatagcaacccagtggccttgctacctccaagggcccagtagagcttgggaccaagctctattgatcagcatcccccagagttttcacctgcagagaagcaggacaggtgggcactcaggagtgaggagcatgctgcatctctttcctgcagatgcaattcccctgccccgggctcagcaatcatttcctgctcccaccctgggctgacagcacctgtgtactagactgttttcaccggcagttcaagaggaaatcaactgtcactgcacgtcaaaggtaatttctgatcacaagtacaggagaaagacctgatgaagaagcaagattaatttttccggcagtcaaagcatgcagctgtatagctcatggatccaaaattgggaagcaggcattggaaagcagaaccagcacacttggaagatgttgaactacctggcagatctaagatttggggttagaaaaagcctctcaaacagagcatgcctggcacatttttaggcatttcgtccataaattatgtctgggtgcctaaacagtggccaggtgagccttttcttctagctctttctgattctgtggcagtgaaggaacaagtccagttctgaaactaaacccaatccagaaacgaactaccaagatacggaatatacactagtttcactctttgcaaaccttgctttttcctgtccctgaagtcagcacccaaccggagtaagtatgtagcagaaagttgcttgttgaattgaaaaaggtaataaaaaggaagagctgaagcagcaaaaactgctgagagtggcagctcaggacttagtcttaaaaagtgttatctggtaaatttcatggtcttttctccctttcttctcaggttttttccccttgaaaattaatattttctctattcatttaatcattttataagaaaccaagtaatatagagtatattttaacctcctgaaataataaaatgactgtagctcctttaaagggtactaaaaaaataagtatgacataaatttcatttttcttaaaactttcactcacgtggctcctaaacttccaaatgcttttcatttcgtccttctgcagctttgtgtggagctgagctggaagatgaaatagctcctcccagactaaccagccttccagcaccttctgcttagctgagaccctgacggctggaagtttgcctcacaaccctatgagcttccagagggcacaagatgtgtcttgtaaatgaccatatccttagcaccaaacaggtgctcagtaatcattagctgaagaaaggactgaatgaacgctccaaaggctggggctggaagggccagcagcaacacaatggatgggtcactcttggctgcctccttgaactcctccaatgtaatctggtcgtccttatcctggtccatcttcttgaagatcttgtccacacgctgctggggcgtgagcccgtcctggttcatgcgcatcatgatcacggtgcccacc

SEQ ID NO: 2236 - DNA, 5141 bp, Homo sapiens
gcaaacggtattctgggatactgccatatgagtgtgtgcaggatggtgtgagctctacatttcttaatatgaagagggaggtcgactcggtcatatgataatgaactgttacatatcttttctgtgggagtggaatgccacgggaagctgtgcctattcgtggcaagttcaagataaaatgcatatgtccttgcaatgaaggcacacttatttatcccggattattttgaatccagaagatattaaaatgtaaatattttactagtttatgggtgacatctgaaataatacacattatacgtatataaattacagaaatatcaagagtttactatatgatataatttcagtattaactggtttgttatctcttttatatgtaatcccttgatgccttttattattaatttttgcatttaaaatgttttttttcccttgcccacatttggtttctgtacaagagctcacaactataaatcatgttcaatcacgtaatatatgatctggtgctagtaacgtagaagttgaatatcatatttgttaagagcatctgtgctttttaagtttcaagggtttgacaggaaatgaatgcaaatgtgatgcttaatttggacgtccaagttacattgacaacaatatttttgctacattggctttataagaatttctctttagcatcctctggcaatggttaggctaaccattagtctgacttagtaataactaagcaatggttagtcagactccagagaaagttactaggatatattggacatcccagcagaaaacatttccttcagaaatgactttagggacatgtgtccttgcatcattgatctgattggaggagaccagggttcactgtgacaatggaaggaacaaggaattaatagctcaagagcatgactgctttcaagaaagtgggaccagtggcattgtagccaccataatcactatatttaagtaacttttcatgtgtatgcttgtttccccaagaaaatgagaaataaacattcaactagaccagtttacatattttaatacactaaatgccaatctttctaaaagtttagatctattaataaaatatgtatttcttgttaattttttcaaactggttatcaccacatttctgggtcataatcttctgtatgtgatcatcacacccattcttactgattatgacaccatgaccaaagaattatgatcatgtttcatttcattttgtttcaagaaagagacaggaaatgcaggggatgagggatggggtggattcaattttatgtagtggtgaaatttaagttaaaaaaatcatatatatcttttaagaagaacttgttagttgaatataaatattgccacgaatgaataaaaaagaaactatcgcatatattttgtatatttaaattactatttatgcctcctaaaattgatagtatgtggttctttgttaacaatcaatttagtattatatttctgagagaaaagatgtgtttttgaagttattgttatagcagtttttcttgtaagggtattgacagcaatagttcagtgctgctcaataaaaccaaatataacaggagttagagaatctttgtaatctatattgctacaaacctagtaatgctttatcagtaatagtttctttcaaaagccttttcaatgttataacatgattttctaatgttttataattaatgtgtattttgatgtccaattcaaattctgaaaaaataaggaaaaaggtaagtgggagcagtgtatggttggtgtgtctgtgagcgtgcgtgcatgtgtgtgtgtgtgagtgtgtgtgtacatgaacgaatactcagtgggagaactgtatacataaaacgcttactgaagttgcaggttctgcttgtataattgaggtggtagaaaaccgggatcacaaatgcaggaaattaggaagggatcttaagtagcttaaataaaacccgccagcatgtttcaccagctatagattatgtttcaaaccaaataatctatgaagcacaaatctaagggtgatgaaaatgtgtttagataaaatcagaatggaaataaaatgtgtttatgacccaagttgttatcctgatttaagttattatgaccacatatactcaagcctatcagtcagacacaagatactaattctcagcatgtctatgattacgtatatattcaggctcagtatggtgatgattaaccctcccttaaaatttatatttagggaacatctttctgtggggagatgcaagtgtgtttttcagatgcgtatctttcccatatcactctgatttaggcagaaagtttatttaatgttggccatttgtcaagaaggaaacaaaagtactaaaatgatctgtgttggattaaaccattcctgtttgttctatcaaacttatgctagggccaggtttcatgcactcctttttcaaatgcattattttctgaggcggtaacttgtttgaaaatttgaccttaggcaaccattttcatttatttccgcaaatctctacttaagtggaaagtgactgaaagatctggaaaagtggcttcactgagatttgactcaagaactgttattctgtgcctatacgattgtccactgtggcaataatcattccatgatcaatttcctttttgtgtagtgtttctctaaatggagaaaaggagatcattagtatgtagagaaaaataagctgactctctgaaagtaatcaactgggatacttcaatatattaatttggtcagaatatagcctacagatagccagaacactatgccatgataaagctcatatttctagcagtgccaaagaacaaatcatatcatggcctggttatcaggttgaaagagctcatacttatgaaaaatggtcctttcacagcaaatttcatagaaacagaattttattggatgtcacaagatgcttttatatgtgaaacactccttagcagagaagatataaatttctttagaattgatgaaaagaaaatataaaaatctgcatttatttcaatcgcagaagccagcatcctctgaggtataagagtagtctattacataaacaccgctcacatctctcccatgtttatgctactgaagcaagcttggcgccaaatgtgatggatttatgtaaatgaaggttaatactcacccatgtaaaataattagaaaagtaaaacaaaacgtccggagatttaaatttgtagttttaaagtattatatattcaaatacatgccaattgtctggagacaactagatacaactttactttccaaagtagtgacaaaattttctttgaatgcttctagagaataaaagaatgtttttattactacattttgttggtaggtcttgcctatacatggaatttagtttgattcttttgagcaaatctagtgactacgtcaataaaactaaagccattgggttattattttaactaataaaataagacatcaacacaatgcacgtacaaatgcaattttaatatcacttccatgttaagacaagtagaaaagagcttgtaaaataactacactcacatgtgaaattaagaaacaattcctacgatttaagcagtaagttatccgagatgagagggaattcacacttgcaaagaaatagaagtagaatagatagcaattcacaattcattgtgtcccaaacttaagtggaaataaaagaaaaatggtacctatagcatttaacattatgtcactacatcttccatgtatacaaaatagacagctaattgtagaatgtggaccattttttactaatctgttatttaacagttgattattgagcaaacttatgtatcaggcatttaaaaattctaaagcacttggtgttaaacattgaaaaagatgttgtcccatccttcaaggagcttaattatgcaatcatcaatattttcaaaataaagccaattgtttttaagaagatatacaattgtgtttacatatggcattctcttttttttcagatcaagtgtatagtcaaggtaaaattctaaacatactaaacttaatgtctaagtatagaatatgtttatgtgtaagcctcgatgtgtgcatatataatatgtactgctgtctatgtaaatcattaaaagggtaacacattttgccatgttggacttgaacattgtgacttggggtttggatgatttaaaactctttgatatttgggtcaattacattgcagcaaaatgtgtgtaatatggaaaaaatgtcttattatatttccctttaaatattatgaagtttcaaatttaaggggaatttttttaaagaaatgctgttggatttgtctcaaccaaacatgaaaattcttttgaagtgttcaattgttcccaaatataactgggtttgcccaccctaaaagcatctacatttacacatgtatacacccacgtacagtatacatactgtatataatatatatgaaaatgtttagtatgcacttcttttgattggaactccttaagttaacatttatagtgtagcaacttgtgtaaagtgcactgtgattataaaaaacaaagcacagtaaagtcacaggtcttgttatcttgcactaaaaatgtgtttacgtatttagcagttgtatgtttactttcttgctctttcagacaattgaaacaaatagctatgagaagatgatataaaaataatatgttttttagtggataacggcactacatttttaaaagacagggtttttaaagaaaaccatttaacatccattccaatataacatgtttaccatatctaaaaatttgaatgtcatattgcatttttcataattcattagaaatgtcaggtatgtgcctgaaaatttgtgcaaataagcattagataacagatttctctactcatgtgttattagccatttctatatatataataatataaacactgatgttttaatgtctcttaatttttgtacttgatttttttaggtaacatgtaattataaatgtactttgatactactaaagtaaccagatgttgtttgaaaataaattgttttctttagtgcattgacaatattttacaatactttttgtgattatttatttgtgctcccgtgtaattataataaaagcaatagtttaaatta

SEQ ID NO: 2237 - DNA, 4981 bp, Homo sapiens
ggttctgacactgagggctccggggcaggggcagggcccgctggcttggcgtgcgcgtgcgtgcacaggtgtgtgggtgtctgcctggtgggcgggcggcgtgtgcgtgtgcgcatgtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggccacagggacaggccaggcctcacagccaagagccccgggaagagctgcatgcacacggctggagagaggctctgcacccgagcacagcctgctgcgactcctcatagacccggaaaactgattagaaggcagagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcaggccgtgcgccgtttctcctggaataactggaggtgatttcatggaacctggaggctgggcttcaggctggggggagaggctccagactgggtcttctccgtggctctgccccccgctctccttgcttgagtggtgggggccctgcatcctctcatgcccacccccacctttctcgccaaattgtcggaggcttttgtcacctggagacactgttcctgccagctccggtcttggaaaacatggcctctcctctcctgccctggccccggcccctcctgccagctggacgtgggcatttctgcacccagtagaaccccacagccaggaaagatgcctggaaggctagagaagaggcgtgatggggggaccccatgtgtggcgacagagcagcacacccagctattctcagccaccatgtgggagagaaatgacgcctctgtcgagctccccatggccggagctgctccatacagcatcctaaccttcacccccaactactcagttgccatggcaaagggaatattttgactccctttttttaaaatttccaggtgattattgctagaggagtgggaagttactaatttttgtatatttatcttgtattaaaatgtttttactgatttttaattttaattttaatattttttgagatggagtttcactcttctggcctaggctggagtgcagtggtgtgatttcggctcgctgcaacctccacccatgggttcaagcgattctcgtgcctcagacccccgagtagctgggattacaggcatgcaccaccacgcccggctaattttgtgtttttagtagagacaggatttcactatgttggtcaggctggtctcgaactcctgatctcaggtgatctgcccaccttggcctcccaaagtgctgggattacaggcgtgagccaccgcacctggcctgatttttaatttttaaatgagggagcagaggcataactaggtttacaatcatgtcatcaacaaaataaattgtcttatttttctgatatttgtgccatttatttggtttttctattaagtttgccagaacctccgagaaaatgctggacaattatgacagcagcaggccccacgagtcgaccctggatttgtgacatttgtgttttccacgtagaacgatcttggccactattgtggacagagacttttgcacttttttctattttactagaaatagtgcttttattcataaagattgctgaatttggtcagttttcttttcagtacctgtcggtgaggttctctgaattttctgtgctaattggctaatgaaatgacgtctctgatgactgcgctgccctcgtaagcctggccttcatctgcttggccataacacgatgctgccgacgctgtgttgggtcctatttgctgttctcttgtgtagaatccgccgacgctgcgttggttcctatttgctgttctcttgtgtagaatccgctgatgctgcattgagtcctatttgctgttctcttacttagatttttttgcatctgcgaaaagtgatatttgtctatggttttctctttttgttccacatcaggtttttgaattagattatcctggtttcatgagatgaattacagagttttccatcctttcatgtcttgggaaggttaaagtaaccctgggatgactttccttccatggaaggtgaggtcatcgtcagctgcggacatctgctcctggtgcctcctttcctggctcagctctcgccctctccagcacctcgtgctcatctctgcgtggtgccgctcatccagagtcattctggactttacacccacgacaacatggctgctgcaggtttcgaagcagctgccccggccgagcgggctgtctcatcattcctccagcctcttccatactggggtctctttcttcctaatcatgtgtgggtttttttatttcaatgtacaaaaattctaaatagaggtagtcatttatttgttttagtttttttttttttttgaaacagagtctcactttatcacccaggctggagtgcagtgggacgatctcagttcactgcagcctccacctcccggattcaagcaattgttctgtcttagcctcccaagtagctgggactacgggcacgcaccaccatgcccggctaatttgtgtatttttgcaaagacacggtttcactatattggccaggatggtctcaaactccaggcctcaagtgatctgcacacctcagcctcccaaagtgtaagcattacaggcgtgagccaccacgcccagcctaggcagtcatttcttgatgcagcttttgggctgggcaaggggattttattttatttctttcagaaaacaatcatttctcctttttacttatttgttttctactcattaatttctggctttatcttcataattctccctactttttaaaatgcactttattgttctcattctagtttcttagggtggcacaaagtccctctcgtttattttttcctctaaaaaataagagctgtgctgggggctctgggcgctgcattagctgagtcctcgatatttatggattgatatttatggcttctcggcttttcagagagtgcacgttcagatttaatatcctgttttacccaagggctacctgggagtgtgttggtttctaagtttctgggggaagaggtggcactttccgttatttattttacaattttttggataacaggatcattttaattattctactttttagttccttgaggttttctttgcagccaatacacaacagacatggacttatcggaagtcggaacgtttggaagctctgtttcccgtgaggaatcttcggaagcgctgtttcccatgaggaacgtgagcatgaccatccatattgatctgtctgcatttttctgttgccactagacctaattatggagagagagacacggagggagctcctgtgaccctcaagtcccctcatcatgtccccgtcctgttggctttccgagtttagctcccatgtttggaccatggaggtttatgtcttctatctcagtcatcgtccctgccacatgcccaaccagacatgctgacatcacaggccctacttagccctgtttcctctccccttggcctcaccttgatgtcaggggggtgtcctctggtctgactcagaggcagtgactggcttccttctagtaccttctctggataatgagtatggatgacataccttctagtgtctgctgtcgcgcttaccggtgacacttctgggctggtttgtgatgcctgggatggagccgtctccctagtggtcatggatgatgtttcactgtcccctgcttctggtggcacagatgagaactccaggcctcgtgctctctctgctggcacacacatcttccctccatgctggctgcacacctgcccatggggtttctgcaggagaggagacagccagaggcccaagtggggtgtgtggcaggcaggcagcaaccctggtcactgcagtggcctctgctctgagtctcgggagtaaccctggtcaccgcagtggcctctgctctgcttctcagctatgcctggtgtgacccccagggtcttggtcggcatgaggccacagagctcacgtgcacttcccgcagctgcttccacggtatagatgagaggttcccatggagctcacatgacctctagagacttgcagacccctatgctgtcagacagaggaggctgaggctcagagaggcacagtcaccttcttgaagatgcacagccgtgagtgaagaagctgggatttctcctggtctctctgaccctggaacacgtggcctctgggtgtgcccagtaagagacgttaaagaagggcctcccccatgagccctgactgaggcggggcgctaggcaccccatcgatgtgcttcgtggttcacaggggagaggcagagggcctgtcggggggcagcgatggggcagccagagggggcggtcctggcctgtgtgagcctccttgaggggagggtgccaggaactaccccatgatcttctattctcatgtaagccacaagaccccaacccagatccccacagcaaaggcgaagtcaccaactcaacaaggcgcgtggccaggcgtggggctcacgcctgcaatcccagcaccatgggaggctgagcaggaggatggctcgaagccaggagttcgaaaccagcctgtgcaacacagcgagaccgctctacaaaaataaaaaaaaatcagctgggtgtggtagtgca

SEQ ID NO: 2238 - DNA, 2269 bp, Homo sapiens
ttaacacctatagttctctcaggctttttttgaaaagttccttcgtttctatttctattccactctatttagctattattgtgcggcacccccaatggttcctttcctctcagcatcgctgtagcttgcctgtacccaggacatgcccttgactggcacaaaccgtgacagacatgcccttgactggcacaaaccatgacagacaaggccacctcctcagaagcggaacaacctattatcttttggcaatgggagctaacttcactgttttcttacaatacctggtttttcctatctttggtttccttttgattatctctcatccatctcagccactattctcctcccctcccttgtgtctacaacaccccattttaccaagtctcccatttaacctccccatccttttctttcccttaaagtctcatatgatactgcagtcctcatttgtcttcccaaaaaaaaaaaagaatttttttttttttaaggaatccttccttgactcctaaagactcctaaggatgctgaggcctcctcagcatgatttccatatacttactttctctgttggactgcagacaacttgaaagcaggaactttggcagtgtttccccagcaccagcatcatgcctggtccatagtagctaccaataaaaaagtaagcatcatgaacccaaaagtatctgagaaaggtctcaattaatttaaaaagtttttattttgctaaggttaaggacacacatgacccaccctcagaaggtccggaggacatgtgcccaaagtggttaaggcacagcttggttttatacattttagggagatataagacatcaatcaacatatgtaagatgtacattggttgggtctggaaaggcaggataactcaaagtgggggcttccaggtcataggtaaataagagacaaaagattgcattcttttggggttttgatcagccttttactaaatacacaatttacatgtgagaaggaggtagctcaggtgaacagagggatgactttgagttctgtgtatcctttgtcccacacttgtgaagatcagcaccattgtgatgcatggaggggtgtttctcattttaaagacgtatttgagcatgtctttggcagctcactctgccagataaggtgtcctctttccatgaatgacagaagatgggtaactctgttctgccattgccccaagcggttttcacaatctgcccttctcccctctgccccccaccactagtaaaaaccccaaaccaagttgctaggttcaccagatctaggtgatactcaccaacatacagctaggctttcattcctcaggaaaattgcaattttgtggtcttataatgatatatattggtttccatccatggttgcgggctcctgatgtcagaggtgtttgaaccaaagcaactccatcttgaatagaggctgggtaacataaggctgagacctactgggctgcattctcaggaggttaggcattcttagtcacaggatgagataggttggcacaagatgtcacaaagaccctgctgataaaagaggttgtggtaaagaagccaaacaaaacccaccaaaaccaagatggtgacgaaagtgacctctggtcatcctcacgcttattatatgctaattataatgcatataattagcatataatatgcatatgttaacatgctaacagacactccctccatgacagtttacaaatgccaaggcaacgtcagaaagttaccctatagggtttaaaagggggagaaactcacagctctgggaattgcctactcctttcctggaaaactcatgaataattcacctcttgtttagcatataatcaagaaataactcaggccaggcatggtgactcacgcctgtaatccgagcactttgggaggctgaggtgggtggatcacctgaggtgtcaggagttccagaccagactggccaacatggtgaaaccccatctgtactaaaaatacaaaattagtcaggcatagtggcatgcgcctataatcccagctactcaggtggctgagacgagaatcgctttgaacccgggaggtggaggttgcagtgagccgagattgcaccattgcactccagcctgggcaacacagcgagactgtcacaaacaaacaaacaaacaaacaacaacaacaacaaaactgtaagtatactcaattgagcagcccacgctgttgctctatggagtagccattctttcattcctttactttcttaataaacttactttcgcttt

SEQ ID NO: 2239 - DNA, 7022 bp, Homo sapiens
actcactgtcagacactgcagagtgagaaacagatgatggttctgtggcaaacgtccttttgctgaatattctacctacggaagaagcaaagaagtctaagttctttggagtaagatgctctcaaatgcctaggaacactgatctcctaacttgtcttcctgctttgagtgtccctctgaggttaaagttcctgcctcagtctccaacaatgggacagggtctcaccacgtttaccatgttgcccaggctggtttcgaactcatgggctcaagcaattcacatgccttggcctcccaaagtgctgggattataggcatgagccactgcgcccagtctgatggctttatttttgatacaggtatattaagttatccactatgattgtgaatttgtctgtatctttttataattgttagtttttctttatatgtattaaagccatgttgttaatgcatacaaattcacaattgttatatcttctaggaaaaactcctctcataatgcagtgtgcttctttatcactagtgatgattttgcttttaattctactttatatgatattaatattgctgcaccaaattctctatttgttagtagttgcctgttatatctttttcagttgctccaggtatttttgctttcggtatgtctttgataaacagcatttgtttgtttgttttaaccaaatatgatcatcttctttagatagcctgaggttgacccatatacaattattatgataattgatatagctgggttaatttatacacttttgtgctgtgttttcattgtataatcttcccgtcaccacctcccccaactttgtttttgcttctttttttctcccttatattctttctctaggattgatgaaattatctttattctttttatttctcttctaatggtttggaagctatagattgcgtttctatcatcttggtgattactttcaacatacatataaaatgttatatttcctgacaaagtctaaagaaatttaatatcctcatctttttaaacaaagtgatgatcttagttgacattggcccattgaattccacctcttctatcctccttgtatttactgtctacattttattcccaactcttttaagcaaacaaaaatgttaatcttgaattgtcagtaattaatttaacaacatctttttatctattactttgttcattaatgcttcttacatcccatatcattccaggttttcttttttttgaaagaactactaaagaacgttctgagttctttagtagtgctttcaatagaagtttgtgggtgggttgaattttggaggtgggaggaacaatattgagtctctcaatccaactgttatttcacttaacatcttcttaatatttttccctctttatttctttgtgcttctttcttggtaaattcttcaatactattttcaaattcagtaattctctttgatttttccagtcagattttatcccatttattgagttttcgtctcgattattacacacattttttagtttcacgtttttttttagtagagacggggtttcaccgtgttaaccaggatggtctcgatgtcctgacctcgtgatctgcctgccttggcctcccaaagtgctgggattacaggcatgagccaccgtgcccggcctagtttcaggttttaaaattggttctttatatccatttatctttgatttctacccacttttaaatttcacaaaacattttatggttattattttttcttttatttctgaataagttacacatacttattttaaattcattttgagaatgtttaatttttattttttcaagaattaattctccacactttattgacttgctttcttaaagtggtttttctttatgtgctttattatttcccctctctcatcatgcactcttttctcgtggttttgcagcacctccacccaactcttggcactccgatgatagaacaggccttatgtcaacagccaagggcttccattcttggggcaatttcacacatttagctattgaatcagcaggtgccctgacataggttctgtctccacggccttctctgctccttctggccacactggctacacagctacttagcttttcttgcattaactcttttaaacaaacaaacaaaaagctttcttttaattgccagtattaaattagatatatacaagctatagcccagtcatgtcttcttctcagtttcttttcatggtaagaaaccccacctctttgctgctgtcactcttactatccagtagggctcaatgtgctgtaggtcctttctaccccacagaaatccaagttctggccaactctgagcatttctagattcaaaatccagtgggttggtggcctcagcctgcacttatggctagaagcttctattttgacctttgtctacatagatgtttgtttttgagcatggctatctttggagtatgtgcatgtgtgtgtgcgcatgcatgtgcgctgtatttggagcaatttaaaacttgaactcatattaccatcttgaaaagaagcaaagagcagagtctctcaattaaagtggcttcattctgttttgacatttataaaagtcttaggtatctcgtttttgtacataaatccttttatactatttgcaatttcaaaatactataaatgaaattatgactgccttgacagggaggttaaattctttccacagacttttaaaaaattgcacatgctacccccacccctactcttcccaattcctaggtatcctactttcccaggttcaaaaccactgtcctaagaggaaatgtgctgctctaatcagatcagcttgagaaaactcactcagagagtaggagagctaacaatcagggaacctgtgtgactagaggaagacagggatgcctggagaaaacaacctgacctgcccgcacagagggacccttgttccagaaaccaggagaggcagctgatgggcccacacagtcagcacttactctggtcaatttgttctcaaattctaaccatgggaataaacactactttcggtgaaaacattccttgtatttcacaaacaacttcctgacaacatttacagaaatcaaaataaaagaacatcaaaactcatttatttacccagtaggtaaatagatgaagaataagaacaggtggttctcataagaggaaataaaaagtgatctaacatacacacctgttatcctttattgtaatcaaataaataaaaattaatgaaacattttatatctaggaagaattttttaaaataatactcaagtataaggttgctattaaactagtatattcatacttactgctacattggaaattggcacaactgtttggaaaaataacatagcaatatgtattgggagctataaaaatggtttttatcttttagccagtaatccaaactcctaggaatttatcttaagaaaacatcaaaaggaaaaagtgttcacacagcattatttacaaaagtgtaactaaatgttgaagtggacaaacaggcagtaagtttcccccaacagttttaacagctttattaaagcataattgatgggcaataaggtacacataaagtgtttaatttgttaagttttgacctatgtgtacatccaagaaaccgtcaccacaatcaaatgaacataatcatcctccaacatttttaattgagcagaaaacagttagggccagatacttgctaaatgaggctaccccagccatcacccacacccactcccaggcaccagcagaccacccagggacaggaattggaatcattgggagtacagtgttcctgctgaggaggtttgccctcccctctttcttatggtgttcaagaaactgggactccaaaaaatagagactaaaggtgacttttaggcaagaggagcccagcagccaccagctgactgggtaggtaccaggcttcagtctctgcaggcccactttgaagatggctacctggctgaagatttctgagggtgggaatttgccagggcagctcacaccagcagcaagaagggatcatggtgtagctgttcttgagtaaaagatggcactccaccctccagtcccctgtggcccttgcagggtatggaggagaaaccagtagctttcctggctcacatgagggagctgaggagtaaagagggaggcagaaactacggtgccctggccaagggaagtaatgtcctaccgagatagggggttgagggtgtgcgtcaacggcatggcttaaaagggatgccgctgttactttctgagagggtcctcagtgacaaagggaccagaaacacatgcccagaaaatcacatgagacaaagacaatgtcagcagaacacaccaacagccaaccagagtgaccagtagaaagctcagggccactgcccaccactgacgggtgacagtaggtagctcaaccttccccattcctttatttctttatttttttattttaagacacagagtcttgcccaggctggagcacagtggtgtgatcatagtccactgcagcctcaaactcctgggctcaagtgatccttccacctcggccttctaagtggctgggactacaggtgtgtgccaccatatctggctaatttttatttttttattttttagagataggggtctcactatgttgcccaggctggtctataatctctgctctcaagcagtccttctgccttggcttcctaaagcattgggattacaggcatgaaccaccgaacccgacagcttccctttttactccaatttctcctcctccccacccaaccctctggtgatagaggagtaaaagccaaaacatattccctcccaactacaggtttcaaagaccatgatacagccagagagagaagggaaaagagaaaatgagattagattttaaactggaccagatagaacttttaataatgagatatgactttaaagctatgggatcagcccaagatgtcactgaaggacaggcaagggaggtggtagttggaagaaaatagattgcttatgcctgtacttcactgagtttaggaaattcactataccagagataatcacaaaattaaaaggaaagtgtagcatatcaactcaatccattacacaacatgtaaaaatataattattaagcactatgcagaaaaatggagtgtgtttacacactatcatcctaaataataacgattacttcaaaacagataaaaatgcataacaatgcacaactattaaaacaggtatgtatggacaaaatcttagagtaagaaaaataaaagtcattttgttaatgtggtatgattattgtttttaaattacttttaagttttcacatttcttttataatatagaaaagtggaaaaatctaaaaccctcctgtcttactattaagaaaagtatttgtatttcccatgttcttttctttttttgtttgttttgatccagtactatttatggaaacatcgccctttccccactgcactgtaaactttatcataaattaagtgactgtgtaagtgctgggtttgtttctggacttgccaacagattccactggacaatttctcatttcttgtgagaatagcaagctgttttaaattattatatccggccgggcacggtggctcacgcctgtaatcccagcactttgggaggccaaggcgggtggatcacgagttcaggagatcgagaccatcctggctaacacagtgaaaccccgtctctattaaaaaatccaaaaaaaattattatatccttataataattcttgacattaggggcttaagctttattgtgattatttcttttcttcctcttctttctcctccttttccttcttcttcagctcccaaatctgttttgttatttagatttgatatcatttctagaatcagcttgtgaattgcaacaaacaactactattattttgtttggagttccatgaatctatacatcaatttggagagaattgacatctttccaataccaagtcttctaatatatgatttcccttgttcttttctctttgatgccctgacaaataattttgagcacttatctgccaagttgaggctgtgccagatgttgtggacacagcccagagcagagctggtggcctcactgccctaacatgtacaaacctgcagggatgcaaggtgcccagactgtgcaaagcaatggcagctgcatggagtccagagagagcacctggaggcctggaaggcttccaaaagaaagtgagtttgcactcctctgagatacaagacaagtatttggaagatgcaggattttactgaagttctcatggaaggctttgggcccactgatcccatccatgggcattttgtcccctccacaatccagctgagggctggacttccctgggaccattctcaggggtcacaggcataacctgtccatgcattaaaggttggcgcagaaacttggggcacctccagccattaattcagattcatctgtttcaacgtattcccatccacccacagactactgggggccacccagaggcctgagtttccaccagtttctcacatgagagaaagctgaaggaaaaggtatgaaggcggatttcactgttgacaggttgtctttcaagtgtgggtcctggcgtttatgaggcaatgatgagacacctagaaagaagcacatctctgagacatgacagttcagtcccaaaggccattaatagagggccagctcatcaacacagctgcagaaacagagcacagccagcctcgcagccccacacgctgaagcccccgctgcagcattccatctactctagcgcccatgcaaattgaaaacctaaaatagttcactccccatagccactggctttgaagaatctcttttgtctccatgaaatagctccaggagacagaacccagagaaaaactttttgaagtgaactttttccttataattttatttaaatttgaatatttttgtagaaataataaagttatccactaattatctgtgtgacac

SEQ ID NO: 2240 - DNA, 1369 bp, Homo sapiens
tcaatttccatatagttgtgtggttttaagtgaatttcttaatcttgagttctaatttgattttgctgtggtctgagagactctttgttatgatttcagttatttttcatttgctgaggagtgtttttcttcctaatttatgattagttttagggtaagtgtcatgtggctatgagaagaatgtatattcgcttgttttttgttggagagttctgtagatatctatcatgtctacttgatccacagctgagttcaggtcctgaatatctttgttaattttctgtctccatgatgtgtctaatattgtcattgtggtgttaaagtctcccactattattgtgtgggagtctaagtctctttgaaggtctccaataacttgctttatgaacctgggtgctcttgtatagggtgcatatatatttaggatagttagctcttctggttgaattgaaccctttaccaacaggtagtgctcttctttgtcttttttgatctttgttaatttaaagtctgttttgttaggaactaggattgcaagctctgtttttttctgctttctgtttgcttggtaaattttcctccatccctttatttttagcctatgtgtttctttgtgtgtgagatgggtctcttgaatacagcatactgatgggtcttggttctttatctagcttgccattctgtgtctttcattggaaaacacattgagatttaagaaagatcatcttcaagctctgagattcttttcttggcctattctgctgttaataattgtgatttcattgtgaagttcactcagctctaacagtgctgggattacaagcgtgagctaccacacccagcgaggaagccaagtttaacgtgtgtgctccactcctccaacctggccaaagggcagtcatcatcactggccactgctgaccacagcctttagaaactccccttgaacgtgctgggctgaccttcctctgatcacaggcaaggtgaacaaatagaagctgagggtgaaggacctacagctgtcaccttcatctcttctcaacactgccagctgtccccttggatctcccagacagacaacagggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgag

SEQ ID NO: 2241 - DNA, 1900 bp, Homo sapiens
tttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctacaggtgagaccagacacaaagtaaatgacctaactcaattacaaataacaaggacccctctgcaatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgtt

SEQ ID NO: 2242 - DNA, 528 bp, Homo sapiens
gtctttgccacttctcaccgtggccactagagagcgacagtgctccatcttctagaaagaaaccgtccaatccccgcgccttctgccgaggagcctggcgagccacctccctgaacttcaggactttcagtttcactcccttatggacctgagggtgatcaccaaccggcggggcctctgggggttctacttaacgccgttttggcagcagctcactgactgcaatgtgcccagcatttccaatgaagaggaggttctgtgaagcgcacagcaggttctggtcaagaaggcagcctttgggcacccacctcaacagacccaaggcagcggatggccaagagagcccagtggattctgccccaaatatctcatttccctcttagtgtcacctctgccagcatcacagctggggcacagtcctctctgctctatcctcacagcacctcacacgtactaggtactcagcaaatgtttctggagtatctttgtgtgcgttatgtggtgctgttttatcaaacccctgaacac

SEQ ID NO: 2243 - DNA, 668 bp, Homo sapiens
aactgatcataatgtgtaaaaaggtgtaacgtataattagaaagacataagtaaaactcaattattgagccacaattctcatgaattaaactttaccatccacagttaagtccttattgcttgttaatcttgggtgcctgcactacacttgattttaaaattgttggtcttctataaattttcaagattttcctgagcagatacaaattcaggttttgatgtgcttcaaactaaggaacatcacctttcatgaaatgtttccagtagatgtgatgtgagtgaaaactttaaaaaatgtcatacttattgctacatttgaatagaaaataaaaggaataaagtatttttcctttgctacaaattaataatacgatcacatgcagagagaatgtgaggaaccttcaacactaaactttgatagtcacattatgtgaaatttgaaattttctgggtgacagtatacttattggtaggttttctggttcatgaaaataactcaagaactaatatttgtaattgtgaccttgttgtaattgggaaaggccactagttgatcatatgacctttattgaatatgtcatgcttgctgtttaaaaaattcctaactaatcacatgcaaattaatgctaaacaacttttttgtatttattaaaaatgatttaaatata

SEQ ID NO: 2244 - DNA, 3705 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcatta

SEQ ID NO: 2245 - DNA, 5337 bp, Homo sapiens
acatggggaggcccagccagtcaaacccagaacagcccggctgagctcagcctaattctgtgactttcaggatgagtaacaaaataaatgattcttattttaagtcaaaattttggagagcaatcttcctcttgtcaatgtctatctcagtgctatttcagactcctttcgtactgtcaaatctcactcaacttttagcatctatttcaattggcatctcttccaagaagatttttctaatttcctcaagtgatgtgttatctcccctataattgaaccccattttgatatttgtgtccctttttagctttttttttaacttgttttctattagaggtgttagtgtcctactcatcttgcttttcctacagctagtaagtggacatccaggaggtacaaggatatatcccagacctggccagtcatgctaccatttcccataataatctccttaagaagtgagcaccagacccaagtcattcagatactacctgtaagatataggcactgagggaaagagtctggtttttcttttagatgaagagctataagaatggaatcgagactaggagaggaacatccaaaggagagaaaatgactgcagtgggagagaacaagagctacgatcaaaaagaggagagacaagcagcactgaggaagacagaagggtaagaagagatgatgtcagaagtgggatccaaagaaaagcttccagtgacccccaggagcactgagtgaccaagcaaggatctaagccctcaatagaatgacaccactgtgtggtcaagaatggagaaacccaagaaacttagcatcccaatattgaggtgtcttcagtatctaaaaattcttttacatccatgctttaaaagaacttaaagtcatttgataatgaaaacaatacttccagtttggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcagaaattttctggtctgtacctttaaccatgttcctggcttcacatattcttcttaagagtaagctataacataagattgagttcccaccctgtgtttgctactgatgtgatttgtttaccatgaataatactttgttaatatcttttgtatattactttacaatttccaagtattttatatacagtgactcacttagtgactcattcattttaatgtaatggtgtcccccaaaccacagataatgattagacacatgaactcttgtgtcagattgcatgggttcaaatcccagttccacctgctagctgtgtgaccttggacaagtcacataatatatctgtgcttcagtttttgtatctataaaatggaacctactgaatagagttgttgaagggatttggtgagatagtccataaaagcactcagcacagtggctagaaaatagagctgcataaatgttagttatgaataaattacttacctacctcactggggtataaccgtggtttatagataaactaagcagcatttttgagcagtggttttagaaaagcaagctcacacaaatctgtgcagggagtatttcatgacttccatggggtgaggaattttattttttctatcaggtgtgaagaggacccaatggacagtaaactctctagttattgctagagtaaatgttggagagtttctcacagtaacctccaagagggattgtgtctgtcttgtttgctgttgcatttccagaacctagcatgcactaggtacacaataagtatttgttaaatgaataaacacatggaaacatctgagtaagtatgtgattaaacttcagcttagtgtattccaggaatcaaatatgaaaggataaatgatcttttgaaaataggaagagatttagggatggtgtctccaattattatgaatttcttagagaatggttgttaataaatatcaaaggggataatatgcctgatgatctttttatataaaaatgaaaatatcttttataaaatttaaaaatggggttttatgtttgaatcattcctgccagataattcaggaagcttgtataaagaactagaaaggttgagttcaactcagcataaaaactctgtatccccaaacattgttccttatccactgttcaaatgtcctcaaatctttgaagcctttaaagtaattaatgaaatttcaaattcatacatctaaaaagtttttatatagactcaaaatatggttctaaccatgaaacttagaaatcatagtgacaatcagtataatataagctggtaaaatttgtgagattttcagaaggcaaaatccatgttttttgtctattcactgattcagccacttattcatccaacaaataccgagtgcctacattgtgccaggcagtggtcaaggcagtcacagccctttctctatagttttccagctagagagggatgagatgggttggaccaccccatattttggaagatctttttctatgttggcctccctgaatcttcagagcattgagttctaagttgtctaaagctggtcttatgaacaggctgtgtctgtatgataaaaacaaactagttaaaagatgagaaatttaggcattattcacacatccacacatatctatagatgtttaaaataatgtagacaaaatattccacctcttggggtcctacgggcacagttgagtaacatgaaatgagataagatcagtttgatgtcacagttgaaaactgcatttgtaaatctgtgtaatccatctcgagccaagttctttggagacagtctaaaatccttaaaaagcctctgcatgctagattttgcatttagatctaagtattgtcttaaaagactgtgattgttcacataactggagaattccctattgactacatgattgaggaaacacaaaagtctgttattctttccaaagtcaattgtaacttaagctcattatctccctgcagatgttctatttcaaatgacaacagaatcaaaatgtaaatgctccagtgaaaaggcttggaaactcttttactgaactgtgctctatgtatttgccttcaaaatcatagcaggaaaaagtttagaaaaatctatcccaccggccactgacctaaaaaagggaaaaaattaaatttcaccaggatttctggtgatatcgtagaagttttttaaattataacgtttaatacctaatttgtttattacattgaattgagcttcatgtcagagcaatgcaggtttttattttaatataatttgggacatgtcagtggctctaatatgatcgttaataatgaagataattagtataatacaagttgtggtaatttccttcttctggcttcagtgaaacttaagagaaccacaggtggcttaagtcttagtgatggctacctctgattaaaactttaggaaaagacttacatttcaaccaacaagattttactgaaggaaaatggtcatttgtatatgagaccactctgacgtataatccatccttagatgtcctaggtgtgatggattgcttctttactttgacaaacaatctggtatgcctttatcagcacttaacattaaccaaatgaagcataaatacaaaggtttctagaaaacacaaatgtaaactatcttaccatttgatagttgtttctgtaacactgtgacaatatttgtattgatgtgaaaccatatgataactttaattttgaccaaacatttatgactaagtgaaaacatactcactcaccttaagctccaaatttatacaatgtattgaaatgtgttgaaatgaccattttctcatgacaagggttcagtgatttcccttcatgagaatcctgtggcattgcctgaatagctttaatatatctttgttaaatgataactaaaatatatgttttattaaatttttcttataaaaatgtgaactatctctttcaaactgaataatacatcgtctccattcattcccttttatcatgcttgtcctttttgtaaatctattttacataacatacagggtcctaactgcccccacctcaccacccccgttctctctagtaaaaaatgatatgtattcaaggatgggaatctgttatcacaggggtgtattgttgaaattagcaaatgtcctagttttcttgctgtttttcctctggtgagggatgcattgtgaagagcagggaaaacctggtattgacaatactatcacccaacagggcataataaaatgtgctgggtagttttgattggttttgttttattttcaagaagacagtctaaactgagcttcatacatttctattttgggggattatctgaagtgtcaaattgtattgtatcttggggaatcaatttctgtatttgagaaaagggaacattcaaatatttgcctgtggtttactgatctattttgaatacttcaactaagcaattattcttttcttaggttcatttatgtgcttaaggtattcaaatgcccaaacaattattgcttcctatttatttcataaagtaaaatcagacttaggtgcctagatttaccataaaccaaaaattatgacctgtaaatgtagttataacagattattttccagtgaatgatattttctgaaaaatgatatctcattgtctatttacctatgggaatatattaaagttggtgattttattttatttttctagaggaagcagcatctgccattcacaatattgatatcactggtttccacctgcccaattataagagaaataatacttgtttatctgagagtgccaaaaatatctggtttatatttggggaaattgacctaaactttgtgtgacacaaatatttgaatatatatgcacatataatttagttttgctaagctttaaaatatgaaataggcttctatgacagcacatcagtgtgagtagagtttagatttcttcagtgtttatcaatcaaaaagtataaaactcaaaaaatattgagagtgggtttatgtatataacatacgagaatctgttcacagggctaggtcctttgctagtattctcttactagattcttaatacttggtaagaaaagaacctaagttgtaa

SEQ ID NO: 2246 - DNA, 7565 bp, Homo sapiens
gcagctgcgcggcgtccttggaggcaggtgctggcggcaagacgagctctcggaggatgctgcggcgcggggcgcgtcgcccccctcagtccaccagagcccggatacctcagaaattcggctctgggtctgtggggagcgaaatgcaacccaaaccccgtttttcgaaccccgcgcaaataaacacgcacaagcacgcacacagacgtcgcgcggcggcgctcgcgcgcaggtccagccgcggctgggtcgggcgcggcggccgggcgcgagggaagagcccaggcccgagaggggtcgccgcttacgtctcgcagcccgaggggaggccgctcggcctcggccgctcacaggcgcgacgtaaaggcccggcgtcaccggcccggcttaacggtgcaacggctggcctgggcctgcaactctggggtcccggccgggctggagcggccgccggagagacctgttcactgcattcggttcttgcggtcctttcttaagcggctcgcagggtcccgagcccctcagctccccgggcctcggtggcccagggcccagctcagccgactgggcagtcgatgtaggtcctgagaagagcggcggcggcggcggcggcggcggcgaaggaaaagcgacactgaagcgaaggctcgcggtttcggcctaaaggaaagtgcaggggaggcccgggtctcgggtgacacccccacgccttgagcgggactgtggttgcgagggagggacgagaaaacacgcctacgccctgcgtgcgctgtgctgactacctctccagcatggaggcttccagatgagcagacacccgaatcccagcgggagcccgtcaaaaatggagatttctgccgtcactctgggactcttaattcggtccgtctggggtggggcccaggaatctgcatttctgataaggtcacccgctcccctcccccattattccagtgcaaagaggtcctaggcccagtgcccatcagctcctcaagacaggaattactatatctttttctgacaactgttaactttgtacaaggttagcaaataaatccaggaatgaatggaatcttaaaactcgtaaaacaacaatgaaaggtaattcacacaaaagatacaaaatccaaaattgtcaaaaaagatacagggaaaagtaaacatccatgttattcctatagtccagccttgcaattctctccacaagccattagtggtaatggtttcttggaaatattttcagatttattttatgcccatatcagcatttttaacatcttttgtcataaatatgtcgtaaataacaatgttattgatacatatccttttaaaaacacaatggtagtatgctatactggcttgttttacttatgaatatatgtagagctgcctcgttccattgtacgtatgtatggtaatgatttaacagtccctaatagctggacatttagattgccagtattttcctattacaaacaatgcatcagtgaacatccttgttcttttattattgtacacaagtacaggtacatctatctgtaggatagattcctagaaagttgaattgctggttcaaaggtttgtgcgttcttaatctgtacattttttaatatatattggcaaattgccccatagagattgtatccatttttctctccttagcaatgtgtgagagtgcctgtttccccacaactcacaaaaggtggtttctagctgtgattttaattcgtctcttatattgattttttaaaatttgtatttatattattattattattatttgagacagggtcttgttctgttgcccagactggagtgcagtggcactatcacagctcattgcaccctcaacgtcctgggctcaagcagtgcttccacctcagcctcccaaatagttggaagtacaggcacatgccaacacacccggctaattttaaaattttttgtagagatgggggtcactctatgttgtctaggctggtcttgaactcctggactcaagaaatcctcccatcttggcctccctaagtgctgggatgacagacaggagctactacgcctggactgtgtcttttattatgaatcaagatgagtacctttccatacagagaataatttgtaatttttttcctgtgatttatctgttcttgagttgtgttcatttttctgtggtatgatggaaaacagccctttgtgatatatgttacacttattctttttcagtctttttgtcgtttgactttgtttatggtattttgttttgtttttctgtcttacagaaattcatgattcatgtatttggatttatcagtcttttatggcttctaggtttggggccataatacactcagattattaagttatttctttaatggctttatttttatggttttgtttatctttgcttcatctggaatgtgtttttgtataaggagtgaagtggaagttttgtcccaaaatcacttttaatgaacactccttcttttctacacgatgtcatttgaaatgccacatttataatttttttttttgagacagagtcttgctctgttgcccaggctggagtgcagcggcacaaatctcagttcactgcaacctccacctcccaggttcaagcaattctcttgcctcagcctcctgagtagctgggattacaggtgcatgccactacgcccggctaatttttgtatttttagtagagacggggtttcgctatgttggccaggctggtctggaactcctgagctcaggcgatccatctgcctctgcctcctaaagtgctgggattacaggcaagagccaccacatccggcccacatttataattttctaaattcccacatgcatatgggtttctggattctctgctgcatatgggtttctggattctctgctctattccactgacttttctgttaattttgattcaccagaactgtgctgttttaccatttagtagggtcagtccttgtagggtccagccccacagggtcagtgggttttcgccccatgtgtggagacgagagattgtagaaataaagacacaagacaaagagataaaagacagctgggcctgcgggaccactaccaccaagatgcggagaccagtagtggcccgaaatgccaggctgcgctgatatttattggatacaagacaaagggacagggtaaggagtgtgagccatctccaatgataggtaaggtcacatgggtcacgtgtccactggacagggggcccttccctgcctggaagccgaggcagagagagagggagagaggagacagcttgtgccattatttctgcatatcagagacttttagtactctcagtaatttgctactgctatctaaaaggcagagtcaggtgtacaggatggaacatgaaagcagactaggagcgtgaccagtgaagcacagcatcacagggagatggttaggcctagtcaggccctccacaagaggtaaaggagtagagttgtctctaaactcccctggggaaagggagactccctttcccagtctgctaagtagcaggtgtttttcctggacagcgacgctaccgctagaccatggtctgcttggcaacgggcgtcttccgagacgctggtgttaccgctagaccaaggagccctctggtggccctgtctgggcataacagaaggcttgcactcttgtcttctggtcacttctcactatgtcccctcagctcctatctctgtatggcctggtttttcctaggttatgattatagagtaaggattattataatattggaataaagactaattgctacaaactaatgattaatgatattcatatataatatctatgatctatagtataactattcttattttatatattttattatactggaacagctcatgccctcggtctcttgcctcagcacctaggtggcttgccacccacaagtcctctcttgttactcttttgtttttttaaacatttttctactcattcttgaattattatttttcctcagtgaataataatagcacttatttggcatttgttatatgacaggtactattctcagtgctctatgtatcttcatttaatcctcctgacagccctaccaggcagatactattatcccctttcatggaagaggcatctgagacagagaggttaagtaacttgtgcaaggatacacagctaataagcaacaagcctggatgagaacccagaaaggctgggtctatgggtaaaaccacaattccttatcatcttttcacatgagctttagctacagctagtctggctctaattttaggaggtatttttgttggagtcatgttatatttatagattaaaatagaattgggccaggtgctgtggctcatgtctgtaataccagcactttgggaggccaaggcaggtggattacttgaggccaggagtttgagatgagtttggccaacgtggcgaaaccccgtctctacaaaaaatataaaaattaggtgggcatgttggcacatgcctgtaatcccagctgcttgggaggctgaggcacgagaatcgcttgaacctgggaggtggaggttgcagtgagctgagatcgcaccactgcactctagcctgggtgacagagccagatgagagagagagagagagggagggagggagggaggagagggagggagggaggagggggagggagagagggagggagggagggaagagaggagagagagagagaaaatgagaattgaactaattaggatgttgagtcttcctgtgtaagagcagcaggaggaaataaagaacagctatgccttttcattttcagtcctgtgctcttctggagtgtgttaaatataaatcttgatttttttaactttatttccagatagtttatcttttttgttggaatcctttcctccactatattttgtaactggttattatttatatataagaaggcttttgatattttaaataattttatatctcattaaattatcttactatttaaaatagtttttcagttctaaatcacaatgagataccacttcacacccagtaggaaggctgtaataaaaaagacgacaatacaagcattggcaaggattggaaccctcattcattgccagtggggatgtaaaatgtgtggcctctttggaaaacagtttggcaattcctcaaaaaattaaatattagagttaccataggacccagcaattccactcctaggcatatccccaagagaactaaaaacatgtccacacaaaaatgtgtataggaatatccataacaacattatttttgttgcggtggttgagacagggtctcgctgtgttgtccacgctggagtgcagtggagtgcagtggcatgatcacagctcactgcagcctcgacctcctgagctgaagggagcctcccatctcagcctcccaagtagctgggactacaggcgtgcaccaccatgcttggctaatttttgtattttttgtagagaatgggtttcaccgtgttaccccaggctggtctcgaacttctgggctcgagtgattcgcctgcctcaaccttccaaagtgctgggattacaggtgtgaaccaccatgcccggctagcattgtttttaataaccagaaagtaaaaataatccaaatgtccatcaaatgatgattggatacacaagatctggtatacctatttgatgaaatattattcagcaaaaaaaggaatgaagtagtgattcatgttacaatattaataagccttgaaaacatgctaaatgaaagaagccaatcacaaaagaccacatattgtatgattccatttatatgaaatgtctaaaataggcaaatccatagagacagaaagtaaattagcggttgccaggaattgggaatggggagaatgtgaagtgactgactgctaatgggtatggggtttctttctgggatgatgaaaatgttctggaagtagtggtgatagttgcacaactgtgaatatacaaaaatccattgtattatacacttttcaaatgggtgaattttatgataagtgagttatatctcaatttaaaaaaggaaaaatagtttttcagttgactaagttgtgttatctagaaatagcctcaaattataagtttactttttcctttctaatttttatgcttactattatttttcttgtaatagcattagctagtacagtaatccagaaaatgttaaataatttttcatgataatggtgatagtggacttctttgacttgttcctggtcattatagaaatagaaatgcttcttcactaagcatgatgctggcttttggggttggtgtggcatgagcacacacatgttttatcacattaagaaaatacctatccctatttctttataatctatggagatttttctttgatctcatattgcgtgatatattaacagattttgtaatatttaactcattttacattcttgaaatgatcctacctggttgtggtgtatacttattttaatattctaacattttacaatttttgcatagttagaaaaattgacatttatttatcataaaatgaatagcatgtacagcattgtttgtaatggctcccaaattggaaataatctagatgttcatcaataatagtctgtttaaagaaagtgtggtagagacatagaattaaatacaacgcagacattttaaaaatgagaaatatctatatatattgctatatccaagaatatccaagattatgtgaaaaaagaagatatgcagatgaatattttaaatgagattccatttgtgttaaataatgcccatagtaacagtagaaattatgtatgtttactcctatcactgtgcatgcatagatgatttcccgaaagatattcaaacaattaacagtggttactttagggtaatgctggtttgggggaagcagtggtatgaagggagggagcattcctttttactgtatacctgtatgtaatgtttcaggttttttcttaataagccatcttacctttataataaaaagttaatttttaaaaagttaaaggtcggccagttgcggtggctcatgcctgtaatcccggcactttgggaggccgaggcgggtgggatcacctaaggtcgggagtttgagaccagcctgaccaacatggagaaaccccgtctctactaaaaatacaaaattagctgggcgtggtggcgcatacctgtaatcccagctactcgggacactgagacaggagaatcgtttgaacccaggaagtggaggttgcagtgagccaagaatgcaccactgcactccagcctgggcaacaagagcaaaactctgtctcaaaaaaaaaaaaaatttttttttaatgctaaagaggaaggaaaaaagagtacctacgtgttcctggatcaccttcacacaggtagctctaatactgcttatccattaaagatttctcaaacttggtttttaaaaaacatttattgaccccttatgctctactatatgcctgatttcagtgattaataagcccattaggagcccatctgttaagcatctctaggaactcctcctgatactattggaga

SEQ ID NO: 2247 - DNA, 3108 bp, Homo sapiens
ggcgcggagccgcgcggagtgacaaagccgccgctgccgccgccgggggtgggagccgcgctcgcccgcccgcccctcgactcgcgagggcgtaaaagtttgtctcagctcgagcattcctagcgccaacacgccctcaggtaaaggtggaagtaaatggccacgctgtattgacagaggtagggtttgttttttaatactcgttctcactttaagtctcaccagggaggggtttgggaagcactgcgtgtttgggggacgttttgcgcttcctggtctctccagcctacaagtcgggagtcggcgaccgcttagtgacgagcgatgattttaaagagcagaataaaaggttttcccgtgcctgccccacagcccctccagctcgaataatggagaactgtcaatgcactccgcgagcggtggcccattgtacgcagctgatggcgaggaggcgactgggggtagcaggggctccttgccctcgtccctatgcccaaataaacgcgcaaacgcgctcccgtcttctggtcagttaaaaggtgaaacgaacacgattaaaatagaccaaaagaaaagaaagaaaagaaaacctttctatgtacagattctaaatcgtactccccatacagtcagaggcagggagtcgagggcagaggcagcaggcggagagagggagatagggcgagggaaggagaacgcggagagagacgaagggagtgggagaccagcgacagcgagcgccagggcaccgcaggcacactggatgcccagtccgccggcccagccgccctcggaccctggaccgtgcgtcgtgggcaccagaaacgagactcggccaaatcctgcctcaccagcaggtagatgaaactcaagagaaaaggtgtggataaatgaaactagcccatgatgaacctgttttctccgtgaccacaatattaaccaggatgaatggcgatacactgcctctaggactgggacagatagccactgagtacctgcttcaaatcaccctgcacgttttctctttggaaagataagcactggagaaccatctcgttaccttcagcagaaatggaaacaaatcaagacattaagaatgccgcagtggacagcagttatgcaaggttcagcagaggaagttttcaagatggtgtgcctcactagccagaaatcagaaaagatcgaagctagccttttcatctcagctgctccttaaatcagtgcaacccctccaaattaatgtgaattgaaacttgcattgcttttcaacttaattgaatacttactatatgtgaaccactgcacaaaataggggaagaagatgtgggagacaaagatgtggagcctgtcttcaataaatttacagttagtttcagggtacattgtttttcttctgctgttaattaggtgtatccccaagacaataaatacatgaatggaaaagtatattctgtgttttaagtctctttaataaaaaacaaaacaaaatccaaaaaaactcctaacatggcaactcaggacattttaatccttttttttgttgttgggcttctgataggatccattttattgattccataaatatttagtagactttagacatattaatacattgtagtttgagttaatttgcattaaattctgtttttttccccttaggtatagattgtctgttggaaaaatatattgcttgtggatttcttggggagtgggaaggtgaattatacctgttgtctctacagtccactaccttccacaccctagggcagtggtccccaaccttcttggcaccagggatcagtttcctggaagacaatttttctgtggatggtgtggggatggttttgggatggaactgttccacctcagatcatcaggcattagttaggctctcataacgagtgcgcagcctagatccctcacatgcacagttcacagtagggtttgcgctgctatgagaatctaaggctgccactgatctgacaggaggcagaactcaggtggcaatgcttactggcccactgctcacctcttgctgtgcggcctggttcctaataggccatggacccccacagacgggtactagtctgcagcctgtggaccccagccctaggggcctgccattctgagtgagttattagcatgaagaagaggaagatctggatcaaacgtgggtgatggtactcagagacccaagataggatagggatggaacaaaatccatctgggcaacggctctatgaaaatttggctaagtaattatttcagtattcattgtattcattgtccttcgtgttccataagttaaatgactgtctaatttttccaaaaatttatttctgacttgagaataagtgtgtcatgattttcccagtgtaaagacactgatataactgtagataccagacattttatgtagtgtctatgacacattttagtatgtatgagccaacaatagacatgtctttgtcttgaggagtgtccatctgaattgaaaatgtgtcagcttttttttaacatcatcaacagacttcttaattaagctgccaatacatactgccaatagcactgtgtgctgtctgagaaatgcattgtgtaagtgctatttccatcttattaaataaacaatgttgctctgtataaactggatttaaagtgttctttgaatgaggcattatattgctccataaataatgtgatgtgaattctcatatgatcccttttaacttaatttctaaaaaaatattatttgctcctcagtaaggaatagctctaattggactggtaactttagtgatatgatttgtctgtaacaggctgaatcgccccactcccaaactcctggtcgtgatactggatatttgttatgccacttttagtttgcatgaggtatcttccaggaagtattagttattaacttgtgttctactaaactgtagatatttatttcctgttctggaagatttcttggagtgtccatctgtgcattcctggtgcctagtgtagtcttgctaatggaatagcacctttattggtgctacttaggggttggtagcttacaatcaatctacttggaacgtatccaaataaactggatatttttataca

SEQ ID NO: 2248 - DNA, 5113 bp, Homo sapiens
tgggggcttatttggcctccccaggatggactggagcatcagtagtgcccgggtttatcacaggacagatactcaagacactcttatcaccattaggtggacttggaggagcaaaaaacaagtgcagtggctcctcagcagagacactcctgaatgtatagacatgggaaccaccttcagcatcaaaaaaggaaacgttctgcatgcccatatccagaaaaatccccactcgctgtaacttgcggtctacgaagaggaaagtcagcggcaccgtgctggcagagaggcggcttccatccctcaaactcacagtccagaatccacgctctgtggtcagatggatcctccctttgcggtgaacagattctctgcagactcccaggtcccattctgtgcttgttcccacgtccacctcccagtagtggcggccacaggtaaagcgaggggagcccaggatgcaaatggacacgtcaaatctctcggcaaggtcttgccgattctgtgtgatgcacccacttcggacgctcctgaggtcgtcagaaatgaggaggaagttgttggctgtgtcggcatccaaggtcatatccactgtgaaaaggaaaaaaagttgatcagaaaatggacagaagccaaccccatgcctctcctctacttcaaaggcccaaatatctcttgactttggtttctttaattctcttcttcccccaaaatcaaaacttttcatgaggcaacttccctgactagttcaaattctcataggtatgctttgtggcaatacccaactcttattcacagtagcaattattttactttatgtcacgtgtttgcttcattggacttttcttcatttagagtggagggtctctgaaggcagacaccatgaccccctttctaccaccttgatgcatgaaaaaatgaatgataattaagacaatgcaaatggtcgatgttaaatatgtttctgcttccatcttgtattgctcaactcagtatatagagcatgattccaggcctttgttttccatgtttgtaagcaaattaattgtgcatggttctgacagcaggtagggtatctctgcagctgacaatgtgatgacagaggtgccggtcctggacattaggaggctccaaggccaggaggaagaggggggccttagatgaaagaatgttttccatcctacatgggaggtgaaaccttaagcaaaacaatggtaaattttggagtgaagagaaaggtatttgaaagttgtttgttggctgagcgcggtggctcacacctgtaatcccagcactttgggaggccgagacgggtggatcacgaggtcaggagatcgagaccatcctggctaacacgtgaaaccctgtctctactaaaaaacatacaaaaaaattagccggacatggtggcgggtgcctgtagtcctagctactcggtagactgaggcaggagaatggcatgaacccaggaggcggagcttgcaatgagcagagatcatgccactgcacctccagcctaggcggcagagcgagactccatctcaaaaaataaaaaaaaaaagaaagttgttcgtcataactgactgatcgtagagaataagggcagtaaatacaaaggtcaataatttaatgcattgggtatgtggttgataggtgaagctgccaattctcatggaggaggcagtgtgatctggcctaaagaaaattaattgtccagagcattctgaaaaaaaaatctacagaacatatgatccttcaagtcaaaaaactgatgatcaccaatatagattttatagattacagtaagacttgaggagactgattgctgtttgatggtgaattagggaatgaaatgagatgagtggacatggacaaggaaggaggaagagggttccaaacatgacttaggcagggtgaatctgtcctccatatttcagcagagacacagtcaggtatgggtaggtggatgagtagagatcatgggtgtcagggcagaagccaccaccatttataggtgtaattctttgcccaggctgaccataacctcttcatttaaatgtccctattccccagagttatggagagtgatagtattttctgtagccaggacccctgttgaagtccatggcacaccgatgaggagaccagcgtctgcaactcgccccactcacagaaacaaacaccataggtgctccattccaaactcttcccaaccctggggtgaggttgtttggtacagtgggtgccaatactcactgtgcattagaattaccaggcccatttaaatgtcagagtcctgggaacctttgctagagagaaattcaaattaagttgctctgtgtttttgctactcagcaaagtccccaagccagcgggatcaatcctgagacttcccagttcagcatctgcattttaacaagatccccaggtaatctgagcacactaagtttagagaatcccttgtctaacccatgacatagacatcaggtttttttttttgagacggagtctcactctgtcacccaggctggagtgcagtggtgcaatcttggctcactgcaagctccgccccccccaggttaacgccattctcctgcctcaacccccaagtagctgggactacaggcacccaccaccaagcctggctaattttttgtatttttagtagagacagggtttcaccgtgttatccaggatggtcccgatctcctgacctcgtgatccacccgcctcggcctcccaaagtgctgacattacaggcatgagccaccatgcccagccagccttttttttggagatcaccaggtgattctgtatgttgtcagggctgagaatctgatgatgaagaagcatctcaattttaggtgccagacagcagctaatccccatatggaatgaggggccagttgcacagatgatttttcctggtctggtcgtaggaagggggcagtgtatacagatccctcaccttggaacttccgcatccttgggttcatctgcagaatcttcttcagcttgggctccagttccttgatgtgggaagccagcctctctagctgccaactgggcctgattttgttcttctgagagaccatggaacagcaacagcaaagtagatcctccccatggggctccttctgcagtgaattgatgcacttgaagcagacagcgcatccacactccagggacattggtttctctagatagtctgagcagacgggacagctgcttgcttcttggaagagtgcagccatgtccactgccaggggaaaagtgcacaagggaagaaaatttccgtgaggtgaaagcctgttagttgtgacaagtgacaaccttttcatgcataaaggtattgtgtcccagctttgtcacttctagaacaagaccatgagtacaaacactcaagcacatccccccaccccccgtcttcagagatttgaagttctattgggaaagaaagtcacgaatcatcactgtgctctgaactgaggtggaggaagggtccattctactggtgacccagcaactgagcctgagccagtgacacggcagcacccatgtgaggaacagcgagctggggtcatttcacctcctcctaggggaaccccagcaagagattgattgatgaacataagaattaggggctgggaggccgggcgtggtggctcaggcctataatcccagcactttgggaggctgacgtgagtggatcatctgaggtcgtcaaaagttcgagaccagcctgatgggtgaaaccccatctctactgaaaatacaaaagaattagccaggcgtggtggcacacgcctgtaatcccagatacttgggaggctgaggcaggagaattgcttgaacctgggaggcaaaggttgcagtgagccaagatccagccattgcactccggcctggacaacagagtgagacaccatctcaaaaaaaaaaaaaaaaaaaaagagagggactggatgcagtagctcacatctgtaatcccagcactttgcgaggccaaggctggaagatcccttgagccaaggagtttgagatcagcctgggcaacacaggaagaccccctctctacaaataatagaaaaattagcagtgagcagagatcacaccaggtcactccaacctggacaacagagttaagaccctgtctcaccaaaaaaaaaaaaaaaaaaatcacatccttctccagccttggaaatgaataccaaattgactgccaccactcctagactggagatctggggatccagggtgactggttttcaactctgaggcagcactcagacagcctttgttgaattcattaattacgaatttctctcattcatcccccaaggcataacccccatttctaggcatctaaggaggaaaaacacacacacaggcatgggctcacctcttctgctggaagctcctctgtcctccagctgcttccactgggcgctcaggtcttgtgcggaaggggcacatgagggcgttttattggtgagattcccacctcccactgggtcatgcccttccacaccctctaacctaatgaggctttgatttaattataacagggaattaggtttttactggtgatatatctccagttaattgtaactttagtaaatccttcatcctgacagtgtatttttctttcatatgaagataagattaaattgcctttatattaaattaggcttaatgtactaacttcaaaagcttattttagagatgtttccatcagttgtcagtaaagataattcctgtaatatgttgtaggcttcaagctttgcttggaaacctgaagtattaagtatgattggatttgcaattttacaaaatggtttaaattcatatacatcagactcaaaggtaataggggcatgcattccattgaggaaattctagggaatttttatttattttcattggtttatttctggttttgaaaaaatttcataattcataggaaaaaattggataattactattttgacaaatgaccattaagcttcttggaccttgagtacttcacacagtgttaagataaaagtcacaatttaaaaaaaaaagatgattttcttgtgaaacttgtgttctcaaataaaaattgttacccgtg

SEQ ID NO: 2249 - DNA, 553 bp, Homo sapiens
aatgtaagcagtaagagagtattatgcaaaaatatcctaaggtaatttcagtataaattataggaccacatttattaataatatacgttatgagaacaatcatttgcagtctcactgtgaaggcaaaaaaaaaaaaaacaaaaaccaaaacccaaaggataaacagaaatagcacagtccaccgaatacactgcatggtgtttataactgtataaccaaactaagtaatctttcccctctctttaacttttatgcaccacctgccattctagatactatcaatcacactaaataataataaaaaccaaccaccttcaatctgatcattctgggcaggaaactgaatacagttttgaccagatcttcgagaaagattcatatacacgaaattaactagttctgttaaaaggctgctataaaaataccatcattacgagctatacagaactttagaatccagctaagagtgcagaaatactgaatttcttaatttatgtggagggggctgtaaacccaaaggtaagtccgctcccggccgccgctcctttgtttt

SEQ ID NO: 2250 - DNA, 1799 bp, Homo sapiens
attttgcctttctacttttatcagtcatggagaagtcattgttcatgtgggtatagttctgtgaaaaaagtattatgcttttacaaattgatattgatggctagcctatattttacaatgacatttttaggtaaggagaaagcgccatttaaataatggtgaaatttatgaatttacagatagaaaataaaaagacacacattaaaatagtagtgtctgagcaaatccagtcaccatctttgagatacgtaaaaaaccaataataggaatgtgctatataaaaagtgaaggcagtagacagaaattctcaacagcttgtgcaaacaaattggttacttacattaaaaacagatttttaattatcctttatgtagtactaaagtagatttttgtaactggcttttgaagcattgtgaatataagcatcatttctaaagacctgaaaatatttaaatatattttattgtaaaattactaataccaaacttaaaactgtgagactataaaagttcttaatatcatagaatgatttactttttaaaccagtgaactaggaaatgatggtcagcttccactaaggtagctatctgtcgtagcaagtgagcatagatgacatacgtagatgtgttattaaactgaggattctgaaaaagatattaaagataattgtgttaaaattctgttaacacgtaaaaggaaagacactaagcttaataagtacgtggtaaattcaggaaacaaaatttgagattataaaataacaataacctatttgttatttaattaacagagactttcatttacactgcggctatacagtgaaaagagcatgggctttggagttaagacagatctgggtctgagggctaattctaccacttactagctatatgcccttaggcatgttccttacactttgattctcaatgtccttatctgtaaaatgggaatgatattctctatcttaagggttgttttgagtatcgaaaaagaaaatgtatataaagcaccttcataaaaagtgccttcataaatggtaccaatcactatcatccaattaaaagcaaaaaacctgggtgttccttgattaaaagctagaaaaacgaagtaaaagctggttgtgaaacttttgccattgtaaaatgagttagcctcatatatcacaaagaacaaggggagaaacacatacagcttctgacaacttttaaatgataaagggacgctgaaggaatacttgtaaactaagaaaagcctttagttaatgtttccaaaatataaaattctagcacaatgtacatttcagcacatcatggaaaaaataaatattattgaaaaaaacctcctgaaattgtgaaaaataagagagcaccatgtgtttttcaaaactgacttattgacagaacaactcaaaatctgggactgacctcagctgataacttcatctggtaatggctcttgagaagaacaaaatatgagcagagcttatggctgaccaatatactcacctaaaatctgagcttcgtgtcatctttctagcttttactatctctacatatgtttattcttgagttttggctctttctcctcttacttctctattttccctccttacatttctcttcttaactacctcttggtcattttccccccttttccactttttcctctttcctcactttctctatccctaccctgtatatgttctttcattagacatattgatattataatatcataatattgtactaaacactatacttatttaatatagttttccttacttttaaatgagataatat

SEQ ID NO: 2251 - DNA, 997 bp, Homo sapiens
cttaattattcggttatttggatctaattcacacaaagtagtccagttctctagccaccacctgtaatgggtgtgtcatccagagactgtgtccccacgatgacatccacaggaagtaacagagggctcaacctaggacttcttttggtacaaagccccaaatcaatttttttaaaaaatagacaatttttataagtagacatacttcctagtactccatgatttgatcctccaagcaagatttccactaaaaaatactaatcttttgttgggatgtggaaagattacctagtcaccagtaaaggcccaggaaaaggctcttcttgtcagcacatggtgaaaacattccatccccactggagaaggaaaaaacgattttggcaaattcttcacttttgtgcagaaccttgagttattagcttcattgtttccaagacaacttttaactgatgatctttggaaattgagtttctcagttgaactgtacctttgattctatgagtaaatcacagattacagtctaatagagtcaatcaatcaacacaaacccaacaggccccatcatgcttcaatcataaacatcttggagcttgtcaagctttactggaggtgatttgcagttaattaattcaacagacactttaatcttgcaaattcttgacttgtaatattgtaaccaagctcctgcaagggaacattaatcagttagtgaaaaaggagcacttccgttcagccgtagtaccatgacgtgcacaggcctgaagagaaatacctctgtgaagtggagcgctagtgaattcctgctacctgcttcttatggctcacgctatgaatattcacctgcttcatttgttttttccagtaaacgctgttttgaaaaaaaagaaaaatattcccgggggcttgcatagctcagagaacggagtactgggtcgtggagacttgctttaaatggattcaaatccacatgtttggaaatgaaaataatgcactgtca

SEQ ID NO: 2252 - DNA, 743 bp, Homo sapiens
agagaagcctgtgtttgctccctgatatccagacattacctgttgattcttgggcaaggcccagaatttggtggacatacttaaagaagaaaggaatcttcagctaaagtgtctacgatcaattcagatttggagggcatggatcttctgacagtaggggccattctaggattttttggttgaagagatgaacttcaacttggttccagatgggtggtccagctattctgctgacaacatttttcagggcaaggcttttgctactggaatgatttaaggaagatccctcagtgtttcagagtaaagatatttctaaagaagtacctgtgtcattgcccatcttgaagattgacttttatggattgctcaaatactgatatcagctcaatgtcaatatatactcctacatataaaatccatcttctaatcataatcactaggtaagatgctagtgcaagttgaagttcttaaaggagatgacctgaacagccttcttagtgtaccagggagaccagattgagtttaaactatgtttaccctgcactcagacacgcctaggtgtgtctgggagattagtagatggtgttcaacaaggatctatttaaacaagggagacattaatttggattcctttggttgtaaatttccaaaaaaaaaaaaaaggtctaagttaaaatgtttaaggaggatgggggaagaatgtgatgactgttatagttaatgtgagctttaggcttggccgg

SEQ ID NO: 2253 - DNA, 729 bp, Homo sapiens
ggcattttattttattatttttattttttttgagacggtgtttcatttttgtcgataagaaaaaaaaaaacctgaaaacagaaaagagggcttttacaatgttgatgaactcatcttagagtgcatgatttataaatacataaatatccatgcatacttttacagtgataactcctgggaaaatgagaatgttaaaaaagccaatctagacagagtccttctcattccacctgcctctttatgttggtaataccaggagtcttaagagagctgctgtggtctatgtcacattcatcccagcctcctttctaatcctgtagctgatgatgaaaatgtgataaatcttctggcttagctttgatgctttttcattaattcacttctggtagtaaattgtggcaggtcttccacttcaatcccatcggccatttccatcaccttgtctaaaaggtctttattgtaactgcagcctaggaagagatggttggcccagaccatggagagggagagcagctggtccaggcggccactgccgtcgggcgggtcgcggtagtcgggcaggtggcgcaggatgaattccatgcgggccttccattgcttctcgctctctgagtaggagcggaactgctccgcgaagtcggccgcctgccgcacccccgaaaccagctcctccactgcggcagccgcctcgccaccgaccatggtgcccgccgcagccgaggaccggat

SEQ ID NO: 2254 - DNA, 5183 bp, Homo sapiens
tcattgctcttctgctgttcatatcatcttagttattcacaaagtctacttgataaaatggctcaagggaaatacaagtttcttaagtttttattcttcaaatagaagttttaattttaagcattccttatgatattttttaagcctaaaaaccattcaaattgcttgacaaaattatttcatggtgaattttataaggttgatagaagtaaaagctatttttcccaaaacaaacaaaataccatacatagttttttgggtttggtttgttgatgtcatgccaatttccaagcaccaactggttaccacaaacatgggaatatttagtgatatctttgtagtcatcgttaaaattcctgggaaaaaaagaaaaagtttacgtcaaaggaaaattcacctcccacaaggaaagtctgagatgttcatcctgacatttgcgttcctgattatttgtggacatttcttcattgtgactgtaggaagctgagcttgtttctcctaatttgacactgggttggtgagcattgtctcaaattttgtgcttgcctcatttatggtcctgaagcttagcagaaaaacagacaagctattcagaccagttttctttaagagcacttatgttgcagaacatgatacaaatgattcaccgtgagcaggcacacagagtacggaaaggtattcaactatgcaaagatattgaggggatttccagagaaaacttaaatgttttgaagatttgtaggtagggttttgattgtgtcacattctacactcagtgccaagttagaatgtctttatggggaaggcaataaagttacttgttgggtccttccttcccttacaaacagaatgtttttatgaaatcaaatggatcctccactttgtgtagtaaggaccccccaggccccacaacatcatcactgtgagtcctatcgcagatgtgtgtaccagcccaattcagttttgcttttctttttccctaagatttttacttcaccaaatcccatttcaaatctttttaccttcatgttaccaacaggatgtttagttgaatcagcaacaaagacgtgacaacctattgtcctccacaaaagcatgagtcattttattcagtgatctttggtagtacgataatcaatggaatttatggtgtcgtagaaaaccaaaaatccatgttgaatatagtgactgtcttaaatatacttaaatatgttattctacaaaacaatatccttttacactatgggatggattcctttctggatgcagggatgggagggtctatgggtcagtgactgggacaaaggaactgggaatctctgcacaactgagccctaatccctggtccatctctccagcctcagaaactcaccctcagcctcattttccccatatgcaaaagagagatatttatttacctacctcataggggtgttgtggagattagctagatttgctaaagtgcttgtaggttagaaagtgctgtcattcctgagaactggcattaacagaagagagctgtgtgcagcacggaggaagtggagtctgaggaatacaacagcaacaactcaccaagcagagaatacaatggttcttcatcactatataaaactaacacttttccttcaaaggtctatgtataattttcttcaatgattagctttttaatgagacaactcctttcatccagacattcagatgctttatataagttggcaattttcctgttaaccaaactgaattttattaaatgtttattaaaatgcacccagaaaacttgtctcctcctgatgcctgaggggtttgcatgcctgatcccaagctgcattttttcagaatgcgtgcatgatgccccagttctgtactcatgatcaccaggtggcgttctgaaatccactactggggaaagatttttaacagatattagtgagattagagttggtgtcatttccattgagtatcctcttcacccctaagatgacacatctttacaacacaataaaagaacgtaaagccttatttccacctgtaactcctgaattgattcattttcacgttataactacatttcaaatatttcggagaagtttttacacagggcttcagctatatactgatatacatatgcttacatgtgcttaggtgggaattctactaaaggataaaggacacagtgtgaaaacaacatcagagaatatcctgtacaacttccccaaaagtgacaagttttcttgtacttaaaaatttaatcctgataagaactaatgtgaaataacatcattttggtttataaatatttgtaatttttgagacatagaggcaatatcatgatataggaatacattcataaaactagactagcaaagcagataatgttttcatgatatggcttcatgaggcaaagttgttgtacatcaatattatcattgtgcccttatttaaggattatattccattgtgaaaaaaatgtgcacactcttaaaaacacaaaatgggtttcagaaagtttaccttgagaagtgggtttgaaatcatcttgtgcttggagctgacataagatacgcactcaatataatctcttctggattctaaaatctaattggcagtgatatttcaaagccttaacatttcaaggtggttaattaatatctaatgcatggtattaaactttctgaagcatgaatttaacctaggcaattatctgattcattttttttaaagtttgtgctgccaaaccagactgaagtattgtttttctggactaatactatgagaatagtaagtgagtcaaaaaataattgggactgtcctttttcccctgcccacttcctagtatcaatactcccccaaccagaaatgcagcagaatatcctttttgctataaaggaaaatactgtgtttttatttgtttttgcagaagaaaactggtgttgcctatttggactagatgtaggggcctggaagaaggaagtggcagattcacaggtggggtgaccaggatgggaggaaaatagtggggcgagtatgtcatggggagattttgccacaaagatacaaaacagaattgaagtgtgttagagctggacaaccctttgaaatgacagagtctagattcttcaccaaacagatgaaaagacaagtagagacaacatgtacttgagatataagctatacatctcatcactggaagaaaggagacttcagcctcttttcaaggctttccagaccacatggaactctccagagccctccttgaaagtttttagaaaaactaccattttcagcaaagattcatgtgattatgctgctgaggaccagtcattctgtaaacatcacatatgtgatgctttgtaaatgtattaattgtggtcaattttcatggatatttcccattaacattgtattccatgaacaagtgatagaaaacatatggaaattctcttttgatcaaaaggagtgtctcccaattagtttacgtgtgttagtattgctgacatattattatcatcacaaaattccttttatatctagatggtatcaaataagaaaaaaatgcatcatttggtcaattgcttattgaagatcccagctgaagcctttctttggtaaagagcgcagaaagagaccatagctattcttggatgagaaccttgcctctactaaatagtttctgcttttcctctctgtagccagacagctcaatagcctagggagagtcgatgaaggatatgcaaattacatttttcccattctcagaacaaagacagcaaccaatgagccagaggtttcttctctctttgaaaccaaatagcacgctgaatttagggctatgacaaaaatgttgttaaagcaagagcaaaatcatccttcctatggattcttttctcagtgtttacttaattctttttgcagtttggattggagtttctagtaatgataattaatgccattttacatgatagcttcaatgcagaaatggtgtgagcctgagttacaaatgacatgactagggatacaaacttcgtctgtactaacatcctaccaagcagattggaaacaaatactactaccactaatattctgatgtaattaataacatctaatagaaaaatagaaacatcgtgcttagcatgaaaccattgcacaatataaacctgctcccaaatggcaaggatttttgctaccaatatttgttcttaattctccagttattttaagtaaataagtttcacatctaactacctcagctactgttgttttatttagaaacatgaaaccatgcactttgtaatcaataagtcttttgtttaacatttcaaaaggatatttggtgcaaagcaattttcaaaaatttgtacatgatatacaccacccaacctcaggaggttgtacttaattttgtttgtttgtttctaaggttggttttgggtaaaatcctcatttccactcaacatcaagataagctgctctatatttgcttaatttgccttaaacattttgtgctcctttccctgttcaatttttttgttttgttttaaatctatctctgaaaaaaaaatggaacaggtggcaggtgaacagcaaatggaagagaatggaccagtaatttctcagtcccctgttgtcaactatctgcatgacattctgattgtgcaaaaatgccattcctgtgcttccccctccattacagaataaggtccgagagaccccacgagtgtgcgtagggaacggtgtagacatttcccccagtatgagcacagtgcctggacctgaatgatcatcttggcagttcttgtgcttttactttgtaaacattgtacaaatgtatttggaattttatttgaaatggagacttaaactagttattaaatttgtttccttcctgtaaatatatatattcaaattccatgtatccaaacatccctttagcgttcagattgtaagtgtgtctttattcgcgggaggccactgtcagcaggcagtgacccccagtgccctagtttgaagcacagtgtgtggagtatttgatgtactacagtaccatagttattttggtctgttaagtaagttgcaatttgtgatgaaatgaagtggaaagtagtacttcataatgaacaaatttccttggttacatggtttttcttgtaaaacttaaagaaaaaaaaagaaaacttgaaatttta

SEQ ID NO: 2255 - DNA, 1061 bp, Homo sapiens
tttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctaggaagctgagctgaacacattacgatggatgatggaaacataaggtacatttcttttttgatatttctgagttaatctgaaacgccttagcggcaggacgttggaaagctaaagttggcccgttttgctggcttttgtagtttgagttaacaaccaactgaattagctgataagatctcaaaacagtgaggtaagtacacagctcggagttttataatgctttttttctcttgcagactatcaagaaatccaagtggtaatgggcgaagtttattcagcatccggcaatggacttatcgtagttggggaaacgggtgttccgaataatatcctggaagttatcaggacacctattttaaatataggcctgaattttgtaaagtaatatttaaggtggtccgtgataattaaataaaatgcttaattcatgtg

SEQ ID NO: 2256 - DNA, 545 bp, Homo sapiens
attttcccaaacccggggatgcggtgaagtgcttcttctgcatgattttggctgaagaatgctctgcatttccttgatttctatggagacctcagagctggttttgcttctgctgacacctcatctagcaccttctctacctcccagggtctttgcctctatctgtggtttggcattgtacctgggtacaggaagcctttgatgaacttaaaaggagagcctggagaatcatcctgatagactttgagtagaaatggctggacatacttcaaaccacatcttaacatggttcgagccatcactagaaggcaagtgctaacagtaaaggcttatttgcattttatttacatttaatggactgagcattggccaatttccatggcagaaaaatatatttcattttctaggcacaacttctggctgtcagacacttgctgcctttgaatcttgcagcaacatcactaaccacatcccagacatatttccaaatttcaacatctacccccaaaacataggtgtctgagagactccagcattttcggact

SEQ ID NO: 2257 - DNA, 888 bp, Homo sapiens
cctggcttggactgtgtgcccatcattgccaaggagagggggaatggattttcttctgtgtattgctgacacgaacaggagacggaaatactgagtagaagagggcggttccctggctaaggccccaccctcaagcctggatacccgcggccctaaatgagaagaggcgtttctgtttggggcccaaaaagttgctttttgacccaccacgccccctatcctgcccccatataaaccccaaaccccaacctccagagcataccagcaggtgaggagatacgaggcaagccgactgacggcaaaacgacgtagcagagaaagagagaagaggagggacgtctggacaccgagagatgtttggctcggggcagtcagagcggagtccagcccctgggcggcccaactccaggggaagatcaccttcccacttcatccatccccacccttccagctccccatccatcctgctgaaagccatttccaccactcaataaaacctcgcattcatccttcaagtccgtgtgtgacccgatttttcctggattctggaaaagagctcggaatacagaaagctgtcccctggtcctttgcccttgtgaaaaagcagaaggtccattgagctggttaacactccagctgtctgtggtggccaagctgaaagagctttgtaacactggggttgcaggcacccacctctagacgctaccgcagagccagagcccaaagccctcaccccggcctctgcacttgcccatctgcgtgctccccctctcgcaaggggtttctgcagagggggctactgaacaggtgagccacacccctgtcgcacgccctgcaaggggaatcagggaactcttccgtttcattgctttgaccacatcctataaa

SEQ ID NO: 2258 - DNA, 1380 bp, Homo sapiens
gctcccttcgccgcgcctcgcgtgctagcggtgcccttgtgagccactgcgttctccaaggccagaacgggacagatggagaaattgagatgagagctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagataagactctgagaatttatagaaacaaacattagaaggcaggaatgtggagagaagaaagctacctgacaagggaatctcaggatacaaggaaaacaccaaggaatgtaaatctctgtttaccacaagccctctgtctccacaagttctgtgtccagaactgaaggcagatccaaatacaatattcatgggatgcaaattcccatgtatgccaagagataactgctttattggaggcctagtggggaactgaaactcccactcctgcttagcaggaatgagaagccccctttcagaggtcaacagaagctgagttaagaaacctgaacttttaccctacctggcagtaatgaagcgacacccaccttcgtctgtgaggatggtgtgagatgaaggtagctaaaacaaaaggtttaaataagattcagagtctcatcatattgaaatgtccatatttcagtggaaaattactcatcatacaaaaacaagaaagaactaaaactaagtgagaaaagataataaatatatgccaacatcaagatgacacaaatgttagaattatctggcaaagcttgtaaagcagccatcataaaaatactccaatgaacaattaaaacattcttgtagctaatgaaaatttatttggaaagcttcaacaaagaaataggaagtcataaccaaaaatagaagataaaagagtcaaatggaaaattttgaactgaagaatacaataaccaatataaaaaactcaatgcatgggcagaatggaggagacagaggaaatattggtgaactggaggaaacaatataaattgaccatctatacaacagagagaagatagagtgaaaaaaagatgaaaggaacctcaaagaccttcgagattatagcaaaaaaaaccaaaataaaacaaaaccaaaaaccaacaaacagacagacaaaaaattaacctttgcattccctgagtcctagaagaccggaagatggcagacctgaaaaacattctaagaaataatggctgaaatgtgtttaaatttagccaaagacataaatatacagatttaagaaactgagtgaatcccaaataggataaactcacagaaattcatagcaagacactcatagtcaaacttttgagaa

SEQ ID NO: 2259 - DNA, 2239 bp, Homo sapiens
caaatcaaaaccacagtgagatatcatcacaccccagttagaatggctattgtcaaaaagacaaaaaaaaataacaaatggtggtacggatgcagagaaaatggaactcttatacattgtaggtgggaatgtaaattagtacagccattatgaaaaacagcatggagatttctcaataaactaaaaatagaactaccatatgatccagcaatcttactgctgggtatgtatcaaaaagaaaggatatcagtatatcaaagagatatctgcactctcatgtttatcacagcactattcacaacagccaagatatggaatcaatataagtacccataaacagatgcaaggataaaaaaatgtggtatatatacacaacagaccactattcagccataacaatgaaagaaatcctgtcattggtggaaacatggatgaacctggaggacattatatgaaataagccaggcacagaaagataaataccacatattatcattcacatgtggaagctataaaagctcatctcatagaagtagagtgtagaatagtggttactattaggatggtgcaaaagttattgtggtttttttttttcaattaaaagttaagagaatatagggaaaggaatggggtgggaaaggttggttaacagatacaaaattacagcaagataggaggaataagttctaatgatctatatagcaatgtagggtgactacagttaacaataaataattatatattttcaaatagcaagaaaagatttcgaatgttcccaaaacaaagaaatgataaatgtttgaggtgatagaaacactaattactctgatgtttaaaactatacaacttttagaagaaaacatatgggtatctttgtgaccttgaatttggtgatgaattcttagatatgacaccaaaagcaccagcaacaaaagaaaaaaatagataaattgggcttcattgaaattaaaaacttttgcacatcaaatgacatcatcaaaagtgaaaaaacctacagaacaggagaaaatatttgcaaatcacatagctaataaggggcatgtatccagaatatatatattttaaaactcctacaatgcaacaataaccaaaaacacaattaaaaatgagcaaagaacgtaaacatacattctctaaaaaatatactcaaatggccaataagcacatgaaaagatgctcaacatcataagactttcgggaaatgcaaattaaaaccacaatgatatactacttcacacctcctaagatggctatttaaataataatggaaaataacaagtgtcaccaagaatgtggataaattggaacccttgcatattgctgacgggaatgtaaaatggtacaggcactgtggaaaacagctggtaattcctcaaaaagctaaacaaatcatacaacccagcaattccacgtctaggtatatacccaaaagaatttaaatcagggactcaaacagatacttgtactccaatgttcactgcagcaatattcataagagccaaaagatggaaacaacctaagtgtccatcaacagatgacacctcatgaacaatctaggagatgacttcgcatcccacaattcccatccaaggagagaccatcaactttgtgctttgacacaaatacgtacacaccccacactcacccttctctttagctgatgttggaaaattccatagccatcaactgattaagtgtgtgctccacagggcatttgagacacagaattatttccaaagggtctggtccaattgtattttgatgatctccaacactgagagtagtacccacagctggtattacaggctacaggagttctgtggattaaaaaatgttataaagaacttcaaaaatcatctaaattgaagtttcacattgcaaaaaaactaccttgcttgtttcccttaatgcacaagtgtagctaactgtgcttcatttaaacttttagatgtaccacaatagattcacaactgatcctagtagaaattaaactacagatagctattaaaagtagggatccattacaccatattgagattttccactttagaccttcccctaaatgtataaaaagttaggagaggaaggtcaacagaaagaccatttgtatactgatcctaatatttatatttcccaattctgggcagtaaattaacagtaaaagaggcagggggtaggagaggcagaggtgaccccaaaatcctaaactatacattgt

SEQ ID NO: 2260 - DNA, 414 bp, Homo sapiens
agcagctgccagccacggctccgccggccccgcacccgggcgcggccaggccgtgaggggtgcgctctgcctctctgagcccagcctgccggccggcccgctcaccttgtggctctggtaagtctcgagcgcccggatcgccgtctcggtgagcttcacatgcagtacggtgatgttgtcctgccccagccgtccgcacgacagcccatagcgctgctcctcccgcaggccccctgtcccccccgccgccatcttaaactccccggggtgccgccgccgccgccgctccggctctagcctccactgcggccgcggctgcttgggcttctgcagccgccgccactgctagggccatcccgctgctgacgtactgtcatatactgcgcggagccagacctcggactgccaccgccg

SEQ ID NO: 2261 - DNA, 1526 bp, Homo sapiens
cttgacgctgggttccggcctagggttctggctttcctcctgggctagtgaacgcggcgaagtcctcctctttctaatctccagagccgcagttccatcctctgggtcagcggcttaccctgactgggctgcggtatctgccttccttcccccaacaaggcgacaggtagtcggggctggggccggaactgactgagtgggccgcaactgactgagtgggccgcggctcccgcctgaggaggctaggaaggactgaacagcagccgacttcccaggctctaaaaatcgtgcctctgagttagagctacctcaaaagcaagaccaagcatgagaaatggagtcttttggccagtattggggtgttcggaattcaagcgtatgagagagtggacggtagcgttgagaattttcatttgaagatctcgtcttaaccaccccaagtgtagtcagaggcggcgttttccctgcgagagtgccctggaacaaagcaaggatagcgtgggttagacatacctgaaatgaaagcgtcttactttatctaggtacatatttgcgtcagtaaggcgcaacgccatttctctcttggaattcagaagtgaaatatggtgactgggacgcctgtacattgctttgacttaaaaattgaagtccattattctgaccgaaagttaatctgatgattaattggttaaacatactatcgttgctaattagcataattattatttacaataaagtgagctaaatagctacaactaaaatatatttaaattactgtgatattgtgatgctaaagatgtgttgaaattaatatcttgaatttctcaaccctgcctaaatgcctctgagagtaattagtataattaaaagtcactagagaaagtgaatgactctaataacaggataacaaattcttttcaagtcagatggtttccagttctttgctttcaacaaaattaatggtggcccatgaattgtcagctgatgaaggaacactatttggtttttggcatgcaactcggaaagaaaccaaacgattgattgacatgcttacaacaaaactactagcattctcacctatttatgtaaaaccatttctcagcacttgtatctgtgaaaacaacagaattgaaaatgaaccctgttaatctaccagtaggaactattcatccagataaatgaattaattggtgggtcagccccatctatctcactaagagatgtgttcccaatagaatttcaccttttataactgtgtgttatcaatatttgcaatcgtgtcattttgatccattatatactaaagatgattgtgatgattactcacttcagaagaattccagcgtagagccataaagttacacgaaattttttaaggtttactacatatgtcatatttttattgcgaagaagtgatcaagaaaaggttgttcaaacatcaaagtactatatttgaataacattttttgttagagtacaatctaaatatgttagagataataaaagaacaatgttgaagagctcat

SEQ ID NO: 2262 - DNA, 3556 bp, Homo sapiens
ccagtttcgtgccccaccccgggcacacgaggcctccactgcggttgcgcagcctgccgaagagcgtgcggcttctactgcggctgcgcaagctcgacgcgcgcactcttgtctgcttacgagggctcctcccttcagctttggtccctcggggcgtctgggcagcctacgctttccgataaaaatggcagaatgaaagaattatgagtggaactagagaataggaaagacatgaaccaacgcccaaaatgagaaagaaggacatataaagaaaaagacaaatacaagtgaaaaaaatagactaatggattaacgtccctgtcgtgtgacattttctggtatgacagctgaagatgttgaaccgtatggtgcagttttgcaaatagtgtatgaagtgggttgtaagttttaccagtaattgtctatagatacaaaaaggagccaacctctttttttttcttttagtgtgatgttccttgttctatcttcgaactctcaaaggtagcctttacacagatgttcaaactaattctaccagtgtcatatgtctaccaatctcattacttcccttgtatgtacttctagagcaaagagctcattacagtaagaatgatggtaaattttactgaggcaaacaaagatttctgaacgcgagcagtgtgtgtgaaatgcttatgcactagctgatagcataactctggtcaaagaaatttggtcacttaaatattataattgaatttagcccctaaagtagctgttcttaacctggaatctgaagaacagcctgttggtggggctcccagggaatttgtgaaccactgaaattatatacataatttcatgtctgtgtaccgtgtacatttatttttcttacttttttttgagatggagtttcgctctgttgcccagcctggagtgcagtggcaccacctcagctcactgcaagctccgcctcctgggttcacaccattctcctgcctcagcctcccgagtagctgggactacaggtgcccgccaccatgcccggctaattttttgtgtttttagtagagacggggtttcaccatgttagccaggatggtctcaatctcctgacctcgtgatccgcctgccttggcctcccaaagtgctggaattacaggtgtgagccaccgcgcccggccctgttttttcttttttctttctttttttttttttttttttgagactggagttttgctcttgttgcccaggctggagtgcaatggcacgatctcggcttactgcaacctccgcctcccgagttcaagctgttctcctgcctcagcctcccgagtaactgggattacaggcacctgccatcacgcccggctaaatttcttttgtatttggtggaggcgaggtttcaccatgttggtcaggctgatcttgaacgcccgacctcaggtaatccagccgccttggcctcccgaagtgctggggttacaggtgtgagccaccgctcccggctcatgtgtacatttatctaagggagaggtttgtagctttcatttgccttgctttctctgcgttttgccatcccatttctttttatcttctgcacattccagaatgatcttgattgaggatctttctatgaaaactagaagtattcccaagaatgctttaattttgttaaatatcagggcgtaggttataatattgtatcactctgggacggacagggttaggctttggagtagaaagaccctagcctcaatcctgcacttactctgccacttactgttctgaaccttgagaaaatgacttaatctctcagagattcagtttacactgaaactcagttttacacatctgaaaaaagaggactattaatatctgcaacagatttaaggactaacaaatatgaagtatataaagcacctatgttatctactttactggatacataagtgttcagtgaatgggaaccatttaaaagcttacaaaaagcaggaacagtaattgaagatatcagtctatagagtaaccactatgtttattcattatttgttactctaatacttgcataagaacgtatatgtgcattcatgcgtgtatacatattggccatcattaccttttgtctgttgtgtataatacagattcttgttcttctgtgtcatcaccaacatgtaatattgtcagaatttttattttttgtcagtttattggttttaaaactcttatcttgtgttcactttgcattccttgcaggttgaggatgttttgttttctggtcttagtctcattcttccttctttttcctgttggtcttgttcttttctttttgatttgtagggtatattaggatggtgcaaaagtaattgaggtttttgcatcgttgaaatttgtcatttgatactggaataccctcttaaaccttcttaaatgtggttatgttatacatcattttaatgggcatttctcactttgttttttttttttttgctaatgacttattacttgctgtttatatttattttagactatggaaatgatattagacaaaaagcaacttcaagtggttttcttatttgagttcaaaatgggtcataacgcagcagagataacttgaaacatgaacagcgcatttggcccaggaactactaacgaacatacagggcagctgtgattcaagaagttttgcaaagcagactagagccttgaatatgaggaacacagtggccagccattggatgcttcacttcttgaagcatcttgacagctttttgcaggtgaaatgcttccacaccagcaggatgcagaaaaatgctttccaagagtttgttgaatccagaagcatggatgtttatgctgcaggaataaacaaatttatttctcgttggcaaaaaagtgttgattgtaatggttcctattttgattaataaagatgtgtttgagcctagttataatgatttaaaattaatggtccaaaaatgcaattacttttgcaccaccaccaacacacacacacacctacacattctggatttgaattccatgttgattatatgcacttggaatatttcttttccatctgtggattgttctgtcacttattttctttaataaatgggtttctgaacctctgttgtattgacattttgggtcagattattctttgctgtgtaggctgttctatgccttgtagggatgttcagcaacatccctggcctctattggccaggtgccggtagtacccctccagtcatgacagtcagcagtgtttccagacattgcctagtttctcctggggggcacaattgccctaagttgagaaccactggttatagtgactttgttgtgtagttatcctgctaacatttttttattatatgccagacaagccttaagtgtttcatatgaattaatcctaactcatttacgcatcacaacaacatatgatgtagatattattgtccctattttaaagaggagaaatcttatgtcctctaatatgcagaaaatgttaactttaccaagctataacttacatataaaatgcacctatttgaagtgtacagctgtagggttt

SEQ ID NO: 2263 - DNA, 1694 bp, Homo sapiens
gccggcccacagccagagccatgcaagcgcagttctcttcggacaggtaaaccctttctcagcgggctcctccgcgcgctgagtgtcagttgcacgtcttacctgataggtgggtaggcactcgcctgtggaggagcctgaagcttctaggggtgccttgctctttcaggagaaagcggccagaaggagcgggtggggagccctggagaggtgggagtggaggctctcttttatacctgcgtctgtcgctgattccaaaaggcgtaggggagcccgggacgcgccctccaggccactgggcgggcagtgtatcctgcgggaacccgagcctgctcggggctctgtggggttgagggtcgtggaaggcttctaggcgcaggagcggcggcgactgtggctactgacattaagaagggtccccgggagttttgcgagaaattagagggtgacgacggccagcgggcgctggtcataaaattccgggctcagcccggcctccagaggtcagaaataggtggttatctgagagggagggacgaggcgaactctccgagagccacaaactggagaagccgctcccgctggctgggaccagggactctcctgcaagaggcctagggtcactaaggaaacataaccagcggtagtgcagggaacggaacctgcgtgatgtcacagcggctggagcagctcctctctcttccctcagagccactgtctcaagactctgcccttcttcaagagaagagcccagaagaagagagaatgactgctaggccctttatggctggattcagggtgagctggattttcttttcatttcctgaaatatcttatattttctactttcattctggtggtttggggcccaaaaaaacttcaattcagtcacttgaattccacccgccccaccaactttcatgttgaattataatccccagtgttggaggaggggcctggtaggaggtgatagatcataggggcagatatccaccttgctgttcttttgatagtgagtgagttctcacaagatctggttgtttaaaagtgggtggcacctgccctctctctctctcttcctccttctccagccatgtaaggcatgcctgcttccccttcaccttccaccatgattgtaagtttcctgaggcctccccaggtgtgcttcctgtacagcctgtggaatgagttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatg

SEQ ID NO: 2264 - DNA, 3247 bp, Homo sapiens
gaaccagttcatgtcagtgcagtcctgactcgcccgatgttatttgtgtctgtctccttgtttcaagatctcaggtaaccattcatgagcctgaggctgtgagaaatgctcgctgtgcaaaggggaactctcaccagattttctgaaactgttctagaaatacacttttcggattgattcagcattaccagcttatccaacaaaagtattaacatatacattaacaacgtcgaaagtagcctactttaagagaaaatatgcagaagaagaagatttacatcaagattaccatgggtattttccaaaacacctgatattacctgaggacagaacttgcattctcaaactttctctggagaagctcaggtttcttgaagacccagaaacctacttaagaaggtctgtgttaattaacaatttgctgaggaagatacatctagagacggagaaagagagctatgaatactttaaagaagctccctgttataagactgcatattctgatacaagaaaacggctgaagtttatggtacaggaatgctgttctcagtctctctattatgaagagctgcattcgtatcatattgtgccttatgcttcggagaatgccatttatgaaatgggctacactagcagccacttggagcaaaattctcagttgcttatttataaaatgaattaaagtaactgttaagtccattgatactttgtttctaaatgcttgaactgtttatagtgaagatgttaatataaggcactcattaccagtgcacttgatatcaaagatgagatgcatgctgaactgattggagagagcaatggttattactcagcagtccttagaatcatcaaattgaatagaaaatatgttcacatatgataaagcggtcaattagtgctttagaagcaaagattttttttaaacataagatgtgtaggaaggggcctacgttaaacaattacacagatgaaaaattttcttttatgccttgatttccaaattctgccactcttactggaaagtaatgaaagtaacagattaaattgataatgccatgtccctgaggatgaagggtggaacacatttaattttctgtaaatgatatgaggaagggctggttctttctgaagtgctttgacttgtcaagcattgtgccaaataattgacaccattctccttttaccattagtagcaattcgagatggggcaaagacactgcaactaaactgctgaatgtaacaaccagattactccaaactgatccattgtactattttgcggggagggcttagacttttctctttaaaagtgaattttaacgaaatagccttgcagatgggcttatctataagttctacaggttggttaaaatttgtggtgggcctttagttagccgtttacattttatttgtttttttttataggctgtgaagctcaggaaaagggtaggcaggtaaaatttgtttttaatgagttgatactttttagaaaccttatctgcaaaaattaatgagaacaacaaattccacatgatgttatttcttcatctagctaagagtacatttaaggctgcctggatgaaactttgcactgatttttgtataatagttgatcattcactatttgacaaattgtttcagaatgcctttggtggtgaagtttagataagtccctatgttttgcaattttacagataattatttaacaagttggatagattcatgaaattgtttgaagtggttcatactgttctttcaggtttgagtgagatgtcagatttcagtgtctgaagttttgtcctatggagcatatcatttaaagaattgtcattaactgataaaacagattggaaaaactaggtgccaaaggtgtatttaagaaaataccaaagactcaaagatgagtgttaggaagactatgataatgaagataagaatctaaagtaaggattgcataggacatagaagaacattgttaaaggggtttggaatgatttgcttactaatgtactttcagaacactttatacataataatggtaatcaagggcactgctttaaatgaagatactacagacctttaggaatcatatgccttggaaaacaatctatgtatggtgacttgtcaacaaagtatcttccctagttggatgccaacttgtaaccaagaagactttcttctattcaagagaaatttggttttagttttgatttaatacttggtccctctaattaatcactggggtgattaacatgaattctgttggtataaagagtattggttccctaattagcctgcattgttgaagaccacatagatgtattactgataagactatgaggctcatgtttaattactcaatcaaaattaggaagaaatgctttggaagaaactaaaaaattacaatttaggttaatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacagatataaaagcctgttttatttgatgacatcattaactgagttttctcatctatacattcatacatcgagaaggaactgtcttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataa

SEQ ID NO: 2265 - DNA, 2634 bp, Homo sapiens
tgcttgtacctagaagggagacgaggaaacacacatgtagctgagcaaacttaaaccagtgcaccgctgaaaacgagagaaaaaggatacaaacagtccagaaacaatgtactttcctagcatcataagctgaagtctgaagctccactgacctgtagagaagctcctgagcaacaatatctccatagtcatgagaaagaaggttgatcctgcggttctggagccccagatgccgcaaaagcgcttccacgatgctggcctgctcaaatatggaatagtgatgtggtctctgaggaaaggaaagcccacatacacaggatgaagtcatgaggacagctctctctgccagcctgaccctcatagtctgcgtctgcccccacaccccatcaccagccccacataggtgctgcttaccggtttgtcactgaagccaaagcctaagaaatcaagggcaatcacccgatgaaacctcaaggtcagaccttcccaaatctacaagaaagaaacgatgatttgggctttctgctcctgcccctccctttcaccagacctacagttgcacaggagcttcagccctatcttggcttaacagacttccataaagagaaaacgccatgaaactaccacaggtcccacagatgatcctcttggaaaatgctttattcctggtaattaatccctgttgagggagggtaacttggcagtgatcccttccagagtgccaaggagttgtttattcccttcagtaaataaggaacagttcaacatttaatgtttttttaaaagcaattcaaatgtgcaagagccttctggtgctgacaacaaaatccttgaggttttttaaatttttattaaaaaaaaatttttttttgagacagactctcgctctgtcacctaggctgaagtgcagtggtgcaatctcagctcactgcaacctctgcctcccgggttcaagcgattctcctgcctcagcctcccaagtagctgggattacaggcttgtgccaccatgcctggccaatttttatacttttagtagagatggggttttgccatgttggcctggctggtctcaaactcctgacctcaggtcatcctcccacctcagcctcccaaagtgctaggatttgagcccccgcgcccggccgagattttttaagacatagtaggacgtagaagtctgacttcattaccttgtaccagtcgtagctggatgttggaaaaccgtgtaaaagcacaactatctctggacttccaaccacacccacagagtctaggaagaaggaaagtacaatcaattatgccaaatccctataaaaataacctcgaagatgttaaaatctaagtaatctgatacaaagaacaagcaactgtgaccaaattgacattaaaatgacacaattatttgtaaaatgtaagcttaactgcgttaggtgagaacaggccttttctcctttcaatctgtatattaaaacattgtaaaaatcatgctatgtgaaaatacttgaaggcaccttgtttactttcacctaggtgtttttaaacagcatctccccatttctccttttgttctgtaatatgcaaattttttcagtgaaaagtaaattttcagttaaaagcatatgatcacaacacataaactacaaattctttgtactttatcatgaatggcctcacagaaattctctaagatacagcaactattcccaaggaacacctttagcttatgctgtttgctcagcactttttattcagcaggagacccaatctaacatcaaaaacataataaaactattacaaaatcctgtcaactataaaaagggcttaatcaacataaacatgaacttttttaatgcatatgacaatatggaagcattcagcatcatctaaattaggtaaacatttagacaatattaaccttgctaatagtatgggattagaacaggtatattcatatactgccagtgacatgaaaatttggtaataaggttttcaaaaataatttagaagcagttaaaaattgtatatactttagcctaagagttttgttcttgagaatctgtgcaaataaaatcattccatttatacaagtagtatagtttgaaaatgtaaggaaaaaataaactgtatggacatgaagcttttacttcaacattagttttctaaaacagtaaaactggaagtaacccaagccaacataataaaaattgtatacttacttaattgaatatagcaaatgagaggaggtcaggagcaataatgaaaaacggtttatgacaaacatttttcgttattgctcttgacccccgctcaaaacaaatcatttccaatctgtttctcagtttcttcacctataaaatgaggttaatggcacctatctccaaatgctgttgtaaagattaaacaatgaaggctgaaaacataactcagtgcctggcatatggtaattacttgataagtagtggtcataataatcatcatcactagcaaattaatttatataatggtatcaagacttaaatcacagttacactacaaataatctacagaaaaaatgaaatcagggatggtaaggagagagaaccaatggtggttatatctattaatattttatatattacctgacaggttgctc

SEQ ID NO: 2266 - DNA, 1038 bp, Homo sapiens
tctgcaatatgcagacacataaattattattttaaacatatacttaaaagacggataaaatgattttttttcatgtgacccagattctgttatcagtagatacaaaattaatttcattcctattaggatggaaactggtatgctgctgtggccatagatattctgagaaacctcttaagccagtgaaccaaaaaccatatgaaagaaagtaatactttctatgattggtcaactggctgttcaaaaattcaacaagcaaacaaacatgcaaacatgtgacatatgtcattattttgtaaaaacataatgccactctggccccaggaatcactacagcccagctggtccttaaaggtgcaaacagcctttaattgctactaaacatcttctctggtattttactgcccatcacacttgccacatgattctcagaagcttaggcttccaagatgtttaaggaaaataaacagggtgtgatgtggatcaagttttcagtgattgttttaagtgtcattttaaaaagaacttcctagtaatgaagtatgtaatagtccttgatattaaattttttctagtgaaataaactatgctttaataagacaatgttgctctaagtttgaccgcctgattttttttttctcttttttagagggtactatttcatatattgtgtgagccccacaaatgtctattttaaaaagagtatagtccctggccaggcgcggtggctcacgcctgtaatcccagcagtttgggaggccgaggtgggcggatcacctgaggtctggagttcgagaccagcctgaccaatatggtgaaaccccgtttctactaaaaatacaaaattagctgggcatggtactgctagtgtagagacattctcttgatctgtgtttatcttgaatcataacaccccagtgaactcttattatttgtttctctgttaattctgttatatttctagtatatgagcatattatctacaaacaatgacactgttatctctttctttgcaacttttcttttttctcttcttac

SEQ ID NO: 2267 - DNA, 506 bp, Homo sapiens
ccaagcctccccacctatcccccaccccgcacgttgcgcgctcactgactgcaccagaacttagccggtcagtccagaggtttattttgagcacaggtgggagggacagggggaggagagaagcgcaggggtcgtggcctcatcaggtccgaggtccagggaggcgggtccggtcctgttggtcctggtcccgaattggtagctgggtgtatctccggaccatgttgggggcgcaccatccctgggaggggtggctgaggctcagcgagggaggggacgctacgcgggccacctcccttcccagcagaccactagcctcttccatcggtctgcatgccggggtgagagtgggagccgggtccgaatgctgagttctcctcgcctagtgcctctcctcacctaatgcccctggctcgacccaaagcccgcgcctgccgcgggtgacccactgcctgagttcgaatccaagctccacccagtattgtgacttttgacaagttacttaa

SEQ ID NO: 2268 - DNA, 713 bp, Homo sapiens
gcatggaaggaaggactgtgtctgtgagggatgatcatcctctcatgtgatccttggagatgccaggaagccccttgacacatgtggcatgggctccttcagaggcttttggatccgtcgtgaatgtggcatgggcatgcaaagaaagacagaggctgcaagggataaacttcatcttgggagatccctggagatggcagggaacccatggacacatgtggcatgggctcctttgggtgccggtggatcccttcatacggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtggtgtgggcatggaaggaaggccagtggagacaatggatgatcttgttcttagcagatcactggatgtggcagggagtcctaggacatgtgtggtgtgggcttcttcaggtgctggtggtgttggcatgaggaaaggaggtatcttcgagggacaatcttcttcttgtgcgatccttggagatgccatgaggcccctggacacatgtggtgtgggctcctttggaggctgttgtatcccttctgaatgtggcgtgggcatagaaggaaggccagtggccacgagggacaatcttggtcttgggagatcctggaaatga

SEQ ID NO: 2269 - DNA, 333 bp, Homo sapiens
cggaagtgagccacacactctgtgtcctcgcctcaccaggaaactactaaagttcctggggaagcaaagtagaatttcataagaacaaaatggatggagaggagaaaacctatggtggctgtgaaggccctgatgccacgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacctacaaggttc

SEQ ID NO: 2270 - DNA, 298 bp, Homo sapiens
aacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggat

SEQ ID NO: 2271 - DNA, 14547 bp, Homo sapiens
aaaaaaaaaaaaaaaaaaaggaaacctgagattctgcttaacaattgtaaagtcagaaggtatgaagagtatttgaagttagacctgtggacaggctgattggatcttcagcagtatgagaaagtttagttaagccaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaat

SEQ ID NO: 2272 - DNA, 2028 bp, Homo sapiens
gcctttacaatggggtgatatgacatattgctaagcccaatacttaggtaatattgtgccatataccagagaccagatcaaaggcctaataaggactcttgtacctggagccaggacttgtgcaggatggtgactctcatccctgaacatttccacaggtgttattgtgacatatacctgtgcccacctcctgagtgatttaataatcctgcctgttatagcccacagatgacatattgacgtatacctgggccaagaaccttggtgatttgactctcatatcttaacagtgtcctcagaagggaccgtcacatatctctggacccatcatctaggttatgtgactctcctctcctacctgaaccctgcttccagtgaagagtgtagcatttctaagcactgcatccaaatgacatgactctcttgcctgggcccttttaacaggagttgtgacatatctctaggcccatcacttaggtgatgcgactctcctttcctgcctggatgttctccacaagaggcattatgccatagagctgagcctagcacccaagttttgtgacttttctgttagggccctgcctacaaagagaatattggaatatttctggcttaggatttaggtgatgtggttgtcctgcctgtttaataactacagaggggatggtgacacatacctaggcacagctaacgggcatgataatgactcatatgtggacccagccaataggagaaattttgactcataactaggtttagggacatgagtgatgtaaagggtctccttctggtaaaaaggtcacagaagattataacacacacatattttataacacccttgggttgtatagagagtgtcagaacagggcctagcacatggagaaaattgtgagtctcatatgcacacccacctgacagtaaggactttcaccatcacagatggatgaaggcaactgtcctacatgaaaacagaacatgtgtggtattgtaaatctaatccctaaaattttatttcatcgtgatagtcatgtgatataaatttcatgtgatataaatctttgccaagcacctgtgagatttcactcttcagactggttccagcctacatatgggattttgatatctacctgggccaaccttgaagtgttaaagaactcttctgcctgggccctactctcagtaagaattgtgacatcactggatccagcacgcagctgcaccatgcccacagacatcatcgtgacatatctctgtgtccatcacttagaagatgtaactctcctctctggaaaagaccctacacacagggcagaatagtgacatattcctaggccaggcacacaggtgatgatacttttttgccaggccatgcccaaaagagaacattttgacatatcagagggcctatcatgtaggtgatatggctcttcttgggacctaccacttgaatagtgacatattgctaggctatgcaaaaaggtgatggtactcttttgccagggccatgctttaaggaaggctttgtgacatatctctgggcctatcacctaggtgatgtgacttcctgcttggccctgcccacatcgagcattgtgacataagggtggaacctgcacctaggtgatggaactctcttgcttggatccttttctaagggggactggtgaatatctctggacccaggaccaggtgatgtggctctgcagcctgggttctgcccacatattaaattgtgacatatacttaaagaagcacctatatgatatgactgtcttcttctgcctgagccctgcctactggtgacattggaccatatctctgagcccctgacctaagtgatgggactctcttctgtctgggcctttacaatgggaagattgtgacatgttgatgagcccagcacttcggtattgtgactctcgtcttgttgctgaacaatgcccgtgaacaggacttttgccgtatttcagagcccagcacccagttgatgttactcttctgcataaacaggtcatgcataaagaggga

SEQ ID NO: 2273 - DNA, 1681 bp, Homo sapiens
ttaaacatcttacttgttttgtaaaagtgtaattatgcaatttccttttcaaatacacaagactaaaaatacaaatctatcttgttctatttataactgattttttttagttctgtatgtattcgttgaacatatttttttacttccaattgtttttccagatttcacttttcctctttttccataacccgtgaagatagttttaatttgctagttcattttttgctgtatttgaaaatgtaattatttaatatagaaggcacagaattccctgcaaaatcttacatgtttaaaaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcat

SEQ ID NO: 2274 - DNA, 2511 bp, Homo sapiens
gactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 2275 - DNA, 5174 bp, Homo sapiens
aaacacccaaccgcgcagcccacgctgcggggccacgacttggccggatttatgttcatggctgaggatgccatgggccgagtaagaaggagaaccgccacccaaccacgcagccaagagcaacccagggatccctcctctgcttgctcccctcccccacccctgctgtaccttctgcgcagccatctcggtaacgggcgtcaggggcgctcggcggcctgctgtccaagctggggtcaggagcctggcggtagcaaagagcatcaccgaaaggaagctggtaggctagcgaggccagccccaaagacccacagatacacgcgctgctccgaactcgcgggcccgcggcgtccactaatgagatgaacctgggcgcgcagcggctggacctcagctgctagggcgccgccaaggccctgctggacaccttctggtacctgggcctcgtgtattacacctgtggctgccgccgaggcgcggttcaatttgaagtctgagcccctacaggcccgtgaatcctggattacaactgcagtttgtgcaagaagcagcagcacctgcacttccacttagcaacctccggcttcacgctcctccagggcgcagagagcatcaaagcattatcaccgacccaacacacaccggcgctgcgtagtttctgcagcaggtgtggggtgaagagttgccacacagctgtctgacaccgggtgtacggcgtcacccctcacttcctggacaaggcaacattttcctaaaggtaaagaccatgaacatgtagaggcccccttactctcatgctagtccgcattcagccggaagcaattcagcaaatttgccatttaagtgacgccctggatctgtctttcagagtagtggcttaccctgcagcctcatttctctgataagtatttttttaaagccattgattcagtttgttcatctttttcttgttggaagaagggggtggggtgacaatttccagcttctttacatgaaagagctgaaaccagaagtctcgcttgtgaccatttttgcaatatactacaatcactataagcctatgatttagaaatatcatggtaaatgcctgagaagcagaaaaaatagttgaaagaagttttctcagggagccagagcaggagtgggggcgagtatggatttagattcaaatgatttctggtttcattaaaggctagtgttattctttaagaacttttaagatcatgtatgtatattattttgagaaaattaaagaataagtgatgcattttatgtagaaataatctatataaattctacatagaaaaatacgtagaaataccaagtttaatttcaagattaaataaatgctcaaaaatacatacaattcctaaaacagttattaccacttacttgttaatgttagttgtgactgtttataaattaacgtgcacattttactcttgatccaaatgctactgtttgaacattaattggcttaagtaataatttttaaattgtacttcacaaaatttagaggaaacaatgcaagggaagggactatattcccatttccctgatgaagacactaaagcttaaaagattaggtaacttgctgaaagtcatgcactaagtaagtggttgactggcacagtctcacaaatccatctgctgttatgtatacctctctccctctacacatttttgaatagccatgcctttatcagaaaaaatggtgttactcttccactaggattgggaaccaaaattactgataaaagtacaaggagagttgaatacgatctttcagttcttttcaagaatcacaaatccctaagccaataaaaaagtttagaagctagaagcaaagacagagatcttccaaatttgtttaatgaaggaagtctaaactctgattccaaaacctggcaaagatagttcactacacacaaagaaagatgtggatctctctcacttattaacttatatttaattttttattaataaaatttgggtccataaaattaaactgtatataaaaatctatcatatcctggtagtttcctagtcatgagagcatgatgtaatattaggaaatattttaattaaccctccacagtatataaaaatccatcatatcctggtagttttctagtcatgagagcatggtgtaatattaagaaatattttaattaacccattatatcaataggtcaaaggagaaaaatcctatcatctgaggtgctgaacaaagaattcaataaattcaatcaatctgatgcactctgcagtcgttctaagttcttgtctactaaaatcctcgactactacacatccacaatcgcttctgtgaaactcttgggaccaaatggttcagaatttgtctcccatacatacataatatctatgtcaaggcctgtagtaatactgtggaatctaatacaatgatatttctgtagtgaaacatacaaatgttcactccaagatctaaagattacaaatagcatcatgtcagttcaaatcaggttttatggataaatgagtcaggaaaagtatgtttttcaaagcattttgaatgttagacttgtgcacaagggattgtgagtctgaatcatatttccgtcaactcttcttgcctttcatacaatttttttctttctgttatcttttttatcattgaaatacaacatttagatagaagattgtgcaaatcataagggacaacaagttgatgactttttacaaagtgaacacatgcatgtaacaaccagtaagaccaaaatatagaacattactggcaccccagaaacttatgttatacccctacctagtcattacccctgaaatttaagcactattctaacctatgttactatagaattgttttgccggctttttatactttatacaaatggaattataaattatgtatatttttatgcctggtttcttttgctcaatatgaatgcttttaagatctgtacactttgttgcatgtagggatatttgcttgtttcgttcctgaacagtattccattgtattaatataccacaatttattcattcaactgttgatatatatttaggttgtttctagtttgtgactatttccaataatgccactgtgaacatccttatgtcttttgaaaaacaggtttatgtatctctgttggatatatacttgtgtggtaagcagaattctaaggtgatctccaatgactcttgtcttggtataatctcttcccattgggtgtaggtggaacctgtaaatatgatgagatcttacttttatgattatattacttcatatggcaaaaaggatcttgcagatataattaaggtcacaaatcagttgcccttaaagtaggtgaggcagacctaatcaggtgagcacttacaagggcccaggtttttgctgagagattcgaagcatgagagagcatttggagggggccacgtgacaaggaactgcaggagtcctctaggtgatgagttgctgccccttgttgacagccagcaaaagaatggagggacctcagtactacagctacagggcactggactcagctggcaacatagatgagtctgcaagggcttcttccccagagatccagaaaggaacacaggaagtccaagagcatctcaccctgtgagaccttgagcagggaaaccagtcacatggtgcacagacctctgacctacacaactgtgagctaataaatgagtgttggtgtaagctgctaagactgtagcaatgtgtttaacaccaacagaaaccactatagattttgatacctggatgtgaggtgtagtcactgtaaacaccttaaaatgtagatgtggctttggaactggatagtaagcaaaggctggaagaattttgagatgcatgacagggaaagcctaaattcccttggacagactggtagtagacgtcagctggatatccaaactgctttggaactcctcttttctgccttctgttttctcctgtataaaatagaatgtttatagatgttatcctatgcccgtcccatcattgtatgtggtggtgttgggggaagatagcttgtcactttagtgctgatggtccacagttggagagggattttgccctaggagttttactggataggatcatacccaggaatctcatccgttcatgattcagatgatgaaattcagatgagcttttggaattgagctgatgccataatacaaagaaatttggagactgtgggatggattgaatgtattttatacgtgggaaatactggatcactgagggccagagggcaggctgaggcaggcagaattctaagatgacctctaatgacctctggtcttatatgaacttctcttgagtataagagcagcctgtgaatatgatgagataccactcctatgataatgttacacaatatggggaaagagattttgcagatgaattatgctcccagatcagtgaacctcgaaataaggaggttgacctgtgtgggccagacctaagtaagtgagcccttaagatggcctgagcccttcctgggagactggaagtgtgcgaaggaatatgtagagctctatgtggcaaagaactgcatgaggcctctaggagctaaaaattgaactgaattctgccaattacctgaatgagtttggaaatatattcctcctcagtctccagaaagaaacacagactcactgaccaatagaacaggctgacttcaccctgtgagacttgaacagagtacttgtaaacctatagaactgggagcttaaataaatggccattgtttaaagccattaaatttgtggtgatttgttactcagggatagaaaagtaacatagatggaatttctgggttatagaaaatgcataaattcagctttaataggtactcccaaatagttttccaagggtactaatttacactcctaccggcagttagagtttcagttcctctatagcctcccctgctctttatattggtagtcattctagctattctggtagatgtttgctgatgtcttcttgtgattttaatttgcatatctctgatgacttattttgggaagtctttgttatttgtcagtttaatatcctattttgtgaagtacctgttgaaatattgtgccagtgtttaactgcatttacttttattctttattttattctgtacataaaacattttctg

SEQ ID NO: 2276 - DNA, 5594 bp, Homo sapiens
gccggcggcgcggacctccttgtcaatgggagcgcggggccgggctgcccgcaggacggtcaggtgggccccccagctcgctgccagcgcggcctctgtccctctcgggccggctctccatcttgtcgcccgtagcccgccttctccgtggctctccagccgctggggccgcagagccgaggccgggttacctcaggaaacgcgatgtggtagtgggtcggaataaacccgcgcgccccagaattcgccttgggggcgtaaggacagattcggacttttcgtttcctatgtccacatttattgagcacctaatatgtgacacccgaggctgtaagaagaggaacgcagcgggcggagaaaagccagagctttttctctgtgagccgctgcctccagggccatagccgaccctgctccgagatcccagccgccgctctccgtgcaggaggggtgcccaccctggggaggccagggtgcccggagtggagggacagggcttcaagcgaccgggagtttccagcaaacccctgatccctgagcagtttattttaaaagcttttgcaaatgttggacggtttcgtttggtggaggccgtctttgcactaaattctcctgtcctcccccttcgaaacgcacaaaatgaattttgaacagattttggatgagaggttttcttccttttttcatcttctgaaacatttccccctcatttcttctcagataaagacccagaaacccgggacagttactcggtgtacagctagtcaaatactgaggaaaccagtcgatatttgccaaagattgggcatgttctgggtggtctcagattttgaagaaacgacttttttactgcacaaaatagttttacaatcagttccatcagacagccccaggggctctcctagggaaaggggccaataggcaaggttgcatggggataagagaggcaagcggccagtggaaaacggttttttgttttttttttcctaacagttgggcatttctgtagctctgaaagcaaacttgtttgtttcatttcaacgatagaaaaaaaacactcctgttttggaaatgtaacccagcataaaaatacatttgcaatggggaaaaagaaagcagtttagggccacccagaagaaaatattttttccctgatttttttttaatttggtatttcccagtgtgggtttgcctcattttacaaatagctgcccatgtcaagatgtgggtatgtgatttaaatattttaatttgaatcacattttacatagtctaggaaactgacaaaagaatcctatagagaattgttttataaagtgaataactgcttctctacctacccgcccctctcattcttcttttctgtgcgtgtttttggggggctgttatgggataaatcttgtttggcttaaaaatcactaaaacgcagcctttcaaatccaaaacagagagcttaggtacccaacattctatagaatgtattatttcctcaagaggttgctaggaacagttatgtagatctaccaggtgcagggaagcactccacaccctcacccaggtcctgtatccctgcaagactgcgttggaaagactgaagaggcattgctgtgctgggaaggaatgcttaaacctgccacagccatgttgtgattatgaagggagccaacctgaggacaaatcacattttctgaggatggcaaagcaaacagatgcaaagatcctgggtctttgatggcattgtggagttgctggacagcttccctacttttcacgttcctatgacacaatgttatcatcgtccttgttgtatcagccagggaagctaaagaatgatgcgctccaccacaatgagggactaaacaacaaaaaggaggcatgagattcaggaagcaaaaaaggaattcatcatatgaaggaatgaagatgttcaaaagaaaaccttcaacctcatgccagaagatgttcccagctgtataaatgcctaactcagcttctagtccttggaaattaagcagctcattgaaaattcaagagttccagccagaagctacagctaggctcagatgttgaaatcagtctctcctgctgatcaaactgtgacatagccaaagcaataggcctggcttttcagttaattctcagcgagcccttcctttccctctgtagtggttggtgtggcatttataatataactcctttatgtacactgtaaaccattccttctcagggcagatggaagtatgaaatctatctatttcagtctataaaattatatttagagcgttaggtaatgaatgtcctagtaaagtcggcagaggacaggtaggttaaatgacaagtaaggaatgacaggcaggtagtagatgataagagttgcagaacagtttggggagaaggactttatttttaaatgcctttagtaacactactactactaatatagcagtaaagtactttttacccattaataaatgggtaaaagtaatttcaagttagcaaatttctcatttatatgcagtgtttcatataacaatggctcaatcctgatccttgtaggaaactaccttaaccattgtgtattttttcagcttttaatgactatacaagcacatcttatcatattttatattttttacataaagaagtcatgcaacttacaccatgaacatctttccatatcaggtcatatggaactttttcattctttttaacaattgcagaatattgtgggaagtagtttaatttactcagctagtcttctaatgatggacatttggcttgtttacaatttccattctttcacaaagcctgctgcaacaaataacattattcatatggcattttgtttaagtgtgagtatatatgtaggataaatttctagaaagtagacttgctggattaaaagttatgtacattttaaattttgatagatattgccaaatttccatgcaaaggataaatttctttgtgtagaattgcttggttgcatggtgtatgcatttcatctttcagaaatgttgtatcagtttatattcctgggcaatatgggcaaacaagataacctgaaaatccccctagaaagacacctaaaatattaaaaaatatgtaacaaatatctcatgtatagaactaggcttgcaaaaaagtaaggcaaatccccagggatcaaaaaatgaagaagctgaaaaccaagggaggaagcagacattgaagccactgatgccctggggcatttatagttgcaggtaaccaagatgcttggtgtttaacagccacatgaagataagaccttggacccagcaaggtgtagagaggagccaagaccctcacaagaatctggaaccctcaagcactaaaagatggatagaaaaaaataacgagcgaaaggagataataaggcaaattgtctggcttggcttaggcatacagagtaaaaacgaaaagtatgtactgagaatttataaccacaggcctgccctcaagtgggataggagttctaatacatactaccttgggacaccttgggtgcctaacagaggcaaatgcaaatcctctccaaagactcatgtcttcaacctaggctacctaagattctgctatggtttgaatatttttccctccaaaactcctgttgaaatttaatccccattgtggccatattgagaggtggggtctttaagaggtgattgggtcataagggatctgccctcattaatggacgaatccattcatggattaatggattaatgggttatcacaggagagggactggtggctttatgaggagaaaagagacctgagctagcatactcagtcctcttaccatgtgatgccctgcaccacctttggacgcttcagagtccccaccagcaagaaggccctcagcagatgtggccccctgacctaaaacttcccagcctccattattgtaataaataaatcctattctttataaattatctaggttcgttattctgtgataagcagtagaaaacagactaagacaattcccatggataaaaggtttgattgaacataaattcacaatccaaaatttcataccaaaagaaagattcccatgcatgaatgcaagcagtaaaaacagctttattagacttccaggaacttcagataacgagcaatcagatagagagtataaaatgagttttatatttttaaaaggtttaaggaaacagtatcaggaataagatgtaactaagaacacacacataaacaaggcctgacaggttttataaaataaagtagaacttctaaaaaataaaaaagtgataatcaaattttagaatacaatggaatacttaaataaccaaattagattcagttgtaaaaagaattagcaaactggaaaaatctgagggaagtacctaaagtgcagcacagagttgcaagaatggaaaaatataaaaaacattgaatatgtgagcatttgaaggacacatatatgttgtactgatgatattctacatggatgaaagagaatgaggggatatgagaaatatttaaagagataattggtgagaattttccagaacaggtagaagacatgaatcgttagattcaggaagcacaataaatctcaaattctcctactgcatttcagcatacatcacacattttaatgaaatataactatatttcccaaaacaaactgttaatgagaagagtggcgttgttttacatttttgctaatctctttaatgtctagtttagtagaatactgttggattctcatatgtgcttttggattcaacctgttccaatatcacatgtcatatagcctttggaaaacaaatctgcaagagaatgagaatgaaaaagacaaattatgtcttagcattattataaatatacttttggccttgtgtaactcctgaaaaattctccaggttcttcaagggtctttagaacatacttggaggaacactgatttatgtatttatttaaaaaaattttctttagagattaggtcttgctttgtttcccaggctggagtgcagtggtgcaatcatagctcactgcacccttgaactcttgggctgaagcaatcctcctatgtcagctttccaagtagctgggacaataggggcacaccaccatgcccagctaatttttaaaattttttagaggtagggtctcactatgctgtccaagctggtctcaaactcccagcctcaagtgatcctccttcctcagcctactgagtatctgggattataggtgtgagacactgtgaccagctaggaccactgattttgtgtaagttttttattatgggttatgggtggtggactgggtgtgttacaaacaaatattctacacacgtacacacacaggtacatacacacacacaaacaaccatatatgctctacatgaatcccagtttttcagggaattagaatacatacaataaggtacacttggatttgaaactcaggggatttcatttctcttccatgatttaaagggtacttcaggatcctgcaataccatctttgtgaacatcaggaatattacgttggtacatacagaaagaagtcttgagtaataccagatatttttggttaataagatg

SEQ ID NO: 2277 - DNA, 965 bp, Homo sapiens
gaggaacatgttaaactacaccatagagactcagtatactacacccaggaacagtactttgtatccttcaatccaatcaaattgacactcaataaaccatgatagataaaaacttaccaggaagagcaaaacatcaagagagtctgacaaaagctctgccctcctctgtaacccagcagcctctgaaagaaagaatattgaaaacaacgctagtatttactgtacattagaaagccagtgtattagaagccttctaactactgatagatcagtctgggccttgtggttcatttgggccagactcaagctcagtatcccatctaatgcatcaaatatttatatatgaaaaattctgaaatgtaaaaatcaacatcaaaatggaatcagcctttcataaatgaaattgctaaactgtgaagttgtaaaatttagaaacttgatggcttaaaggaagaaagggaaattattgaaggtaattttaatgagatacctgtacaggtccaatgtattctacaaataactcaataatttggaaacgtgtgccaaaaacatgcttttctttggttgccaaagccaaaaagtatgtatgcccaactttgattttcatataaaacctgcgaatataaattgtactgttgtttctggaaactgggatttatttcacttaaatataataacttgcaaatatcttagggcaatttgtaataaaatcctagttaacacatttttgtgccaattctcttatttttaaatacgctcttattctcatcccaaatgccatattactcaattacatgagcattatttgaatgtacaatctttcaagatttcttccttggagtatttctcaaacttgagcattaggatgagtacaggaagggagagcaaggtatctacagaaaatattatttttctcaaaactagccatctggtcatatcactgttaggtttaatgtttgtacaat

SEQ ID NO: 2278 - DNA, 1321 bp, Homo sapiens
ctttccgtggcctctcggggctctgatcctccctttcgagagaatcctgcattctaaaggatctagtctggatgccaggagctgtgtataggatgagagcctggtggacctgattgaccgcctgttgttcagttcagttcagagactgaaaatcaggatttgtgctggagagtctttgaactgtgtgtgaaagtatctgaaggtccatgacaatttgaaagaaggcatatgaaaaaggtgcaggaatcgaaggcacgagatacacctgaaagtggtggagcaatgaatctgaacaggatgatggattgaaagtgctcaaaagaggcagctaggatcctgtattcatgtcctaccactgcagccagggaaagatcctcccacatctatcagaagactggaggattatgtctggagagattgaattctagggatgctcaggcccaaatgaaggtttgagcacacaatgaaatgagttgatattgactgttgggaaccagagttctcagtggatgaagagacacagaaaaataaaatgaaggaaggcaaagaagatctctgaagagatggattggaattggaagcattagtatgaaccatgattctaaaatagttatatattgatgtctatgcttgtatatatccagaagtttatgtatgtatgtttaaatgtgtgtgtaatatatatgtatacatatatgtacacatgtatatatttcctagctttgtctactgaaagggtccacaagcaaaatcttgtagcggatcttggtctctaagattgttccctgttaaaaaaaaaacaggatccgttggagaaattgctgattccagtgctgtagcagaaaaggtaatacatgatcctaaaatcagtagtctcattctgttagattactgtggggttcagtatggtagccactagtctcttgtgctatttatttatttatttttattattatgctttaagttctagggtacatgtgtacagcatgcaggtttgttgcatatgtatacatctgccatgttggtgtgctgcacccattaactggcaatttacattaggtaaatctcctaatgctatccctgctccctcccccaaccccatgtcaggccccagtatgtgatgatcctcatcctgtgtccaagtgttttcattgttcagttcccacctgtgagtgagaacatgcagtgtttggttttctatccttgcgatagtttgctcagaatgatggtttctaatttcatccatgtccctacaaaggacatgaactcatccttttttatggctgcatagtattccacggtgtatatgtgccacattttc

SEQ ID NO: 2279 - DNA, 2899 bp, Homo sapiens
ctctacgcgttttggtccctgtttggtgctttctgtttgcagctacggcagtgagtatgtatgtgacggaccccgagtcacccgcggcctgggacccctgcctaccctccgtctcgccagccgagctgtggaactagcgcgtgccccctcgccgacctcggcgtctccgatctgggcataggaaccaatcagaaacaatcgcttcagcaatcaagaccattgttcatcatggaggaacccatggatacctctgagcctctatctgcattaccattcactgggcagcagtcttttgagccaagtggcaaatttggacagtatccatcgatgcagatgaaccacatccaggcactggggaagtggaggacatagaacagctcaatcagtgtttgatccaacacttccatctcattaagacaagtttgatttttctttgctttttatttcatggaatacatgagaatctcttaactgttggagtttccaaggaggcatacctcatgacttcagttaatggaaagaacaaaactaaaatgctgtatggccaaagccacaaagggaaggatccacaatttacattcttggagctatcatctgtactgtactgttgtgatctactgattggcattggcatagtagtaggggtcaagtgacagaatccgtgccagcagtctccaggttcagaagcaattcaagaccctgatgatagctctccagcaaccaacacatggtgattgtgccaacttgttgctcagttataatgcagggccagtgattggtttaagtgaagaccatggttgagatcatttgtctttggtctaatagaatttgagtctagtagaatttgagtctccagggaaagagctacttgaccaaattaaactagtagcaggtagagcatgaatgacagcatattataccatcaagatgttcttagagcagtgtatggatggatcgattgtactgccatcagttgtgactgacgttgtattcaaggagaaagagaaacttgtttagaaagcactttgaaagttttttgagtacgggggtgccctgtatcaccccgttatggttgaactttctccttcaaaattaccagacttggcagcagtggcaaattattgggctaaaagacttaatcagacatattctgggttcaaggctcctaatataatacctggtgcaaacattatacttccactcattcagatggttgcatcctgccaggcatccagtgggactgggaatatggacacttgaacattaaacatcctgaagaattttggaatgacaggttacaagtgaacataatcagttctctatattaaaaaaaaaaaaagatttgggcatagattgggctcacataatctttagagagattttttcatttttgtgaaagtacagaaattcttaactgcttatgaaatgctgattgttaaacagcatccacagctattttgtgttgtttccctgaccccaccctgaagaaaagaaaaattatggcatattgaaaacagcagtatgatgtaagagaaaagatcacaaattccttgagggtgggtcttttccatactcataagcctatttataatattcagagtaatttattgacacatattaatattccctcctatcccattaattgccaaatcatcaaacatttattgagcacctactctgtgtagggtgtaagcagtactggggacttacagtgataaaagacatagttttagccttaagtgatgtactgtttcactgaagagatggaatataagaagccaagtaatttatggaattctcttctttgtttttcttttttttttttggcagtggagtcttgctctttaaatagagcaaggctagtctggaactcctgggctcatgtggtcctcccgccttagctttcagtgtagctgggactacaggtgtgaacacagcttggaaatctcttaaccatgggagttaagtctcaaaattctggtgatacaagtggttgaaacttaaaactgtatttaaaaaataggattcgtgaatttgagatagttcataagtctgcaaaaggctgtataaatacatattttacatttactattattaattttgtagtaaatttgagtacagcactctctttatctgtggaaacttcagactctcccctattactttaatttcagtgagacattattaaatataagtgggcttacacatttgttttgctttactgacaaataatacacaacttggaggcttttttttcctttctattcttcctctaaatgttcaacacttttctgattttgtgatttgaggttgtttaatagcttcctgaggctccattgagaccgtatatacgtgacacttaacagtctagccttcctcggtacatatagatatatgatggtggctttgcctgtagtaaattcatgccaaaacataggctttcagtgcctattacatatggctttcagctctctctactgagggatgtaggagtttatttctgaggtctgagcctcttttcctttacttcctttactctttcctaagccttctttataaaaactatgcatgttctattgttttcctttttgattccctttcttttattatccccagtaggagtgacttgtaattctcatatgttagaaaggcagatctcctggttgaagaaaagatccacccaagcaagtcagcatgtttaataatttttgagggggatctcaaatgtgggaaggattgttatataagacaaccaaatgatgacatgagacaataaatgctataggaattatggaggaataattagctatttattttcttggttagggaagagatattattagttgtagaagtaattactaacttctacattttttattgtggaaatcaaaaatatata

SEQ ID NO: 2280 - DNA, 905 bp, Homo sapiens
aagtactgtagcagatctttgagtttcaatgcaccttggttggtgttggcaacaaacaggagcttctgcacatcatgatgactttacctccattccctctacccagaaccctaaattattctgttattggatctgtgcctgtaatatcaggatactaccatccaaatctatctagatatcttgtgcaaatattttattgattacaagggctgtatacggggttacaaaaagacatgagctggattggacactcctaaaaccaaaaacaacagtgacaatagagtctcaggatagcagagtctgaaaataccttggtctcccccattatgtgagcccttacttgagagcttcatgaagacacttgtaacatattcaacgtcctgtactccagttttgactacgagatcagattttggaggtgagaggacatgatgtgcgcccatcctcccttgcttccagattgttttagtgggccctgatggtcatttttctaaacagaggccctgctttgtaatatgtggccaaggagataatttatctcacagaagcaccgggaagacttagccttaaagagcctacagtgtccttttggactctttcacttcgggacatttaataatggaccaaattcaacagaacaccaggaaggtcaagacgctctccaaagggcaggaagtacagcacttccgaagagtttagttggccctttgctggttgggctgagttttttatttttaagtgtttgtttttcagtgcaataatttttgtgtgtgtgtgattcttatcagaaagttgaattgttttctgcctacaccgttcatcagccccataacccaggaaggaacaggcattgttagcatcagattatacctcattattaaaaggaggcatggccacacatgaag

SEQ ID NO: 2281 - DNA, 6795 bp, Homo sapiens
  misc_feature (1)..(656): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttcacccatgtccctacaaaggacatgaactcatcattttttatggctgcatagtattccatggtgtatatgtgccacattttcttaatccagtctatcattgttggacatttggattggttccaagtctttgctattgtgaatagtgccacagtaaacatacgtgtgcatgtgtctttatagcagcatgatttatagtcctttgggtatatacccagtaatgggatggctgggtcaaatggtatttctagttctagatccctgcggaatcgccacactgtcttccacaatggttgaactagtttacagtcccaccaacagtgtaaaaatgttcctatttctccacatcctctccagcacctgttgtttcctgactttttaatgatggccattctaactggtgtaagatggtatctcattgtggttttgatttgcatttctctgatggccagtgatagtgagcattttttcatgtgttttttggctgcataaatgtcttcttttgagaagtgtctgttcatatcctttgcccactttttgatggggttgtttgtttttttcttgtaaatttgtttgggttcattgtagattccggatattagcactggggcctgttgtggggtggggggaggggggagggatagcattaggagatatacctaatgttaaatgatgagttaatgggtgcagcacaccagtatggcacatgtatacatatgtaactaacctgtacgttgtgcacatgtatcctaaaacttaaagtataatttaaaaaataaataaataaaaataaaaataaaaaggcaaacaaggacactataagaaaagtatgggccaaccaatatccctgatgaacacagatacaaaagtcctcaaaaaaaagtactagcaagcagaatttaacaacatattaggagaacatttaccatgataaagtggatttatcctccagatgtttcagcaaacacaaatcaaatgtgataaaccacattaacagaatgaaggataaaaaaatagctatctctatatatgcagaaaaagcatttgactaaattcaaaatcctctcatgactaaacctctcaacaaattgggcatagaaggcatgtaccttaacacaaaacaggacatatataacaagctcacagctcacatcatacccaacaatgaaaaagtgaaatcttttctgctaagatcaaaaacaagacaaggatatttattctcactacttctattcaacttatttctggaagtcctagccagagcaattaagccaaataaagaaataaaagattcaaattgaaaaggaagaagtaaaattgtctctgtttgatgacatattatatataggaaaccctaaaaactccaccaaaaagctattagaaatgataaatgaattcaataaaatttcagaattcaaaatcaatgtacaaaactcagtagtttctttacactcacaacaaactatatgacaaaaataaagaaatcaatctcattcacagtagcatcaaaaaaaacgtattttttttgtttaggagcacatttaggattgtacttaggagtacatttaaccaaggaggtgaaagatctgtattctgaacactataaaacattgatgaaaaattgtagatgacacaaatacatggaaagatattttatgttcatgggtaggaagaattaatattcttaaaatgtccttactgcccaaagcgatttataggtttaatgcaatatttatcaaaatttcaatgtcattcttcacagaaatagaaaaaacaatttgaaaatttatatggaaccacaaaggatcctgaataactaaaggactcttgagcaataagaacaaagctgaaggcctcacaatctgacttcaaaacatattacaggaaaagaacaaaagaaggaagaagagggtagaggagaagtgcagcaaggaaaaaagcaggggttgcaatcctagtctctgataaaacagactttaaaccaacaaagatcaaaagagacaaataagggcattgcataatggtaaaaggatcaatgcaacaagaagagctaattatcctaaatatatatgcacccaacacaggagcacccagatgcataaagtaagctcttagagacttaaaaagagacttagaccctcacacaataatagtgggagactttaacaccccactgtcaatactagacagatcaacgaaacagaaagttaacaaggatatccaggacttgaactcagctctggaccaagtggatccaataggcagctacagaactctccaccccaaatcaacggaatatacattcttctcagcaccacattgcacttattctaaaattgaccacatatttggaagtaaaacactcctcagcaaatgcaaaaaaaaatgggaatcataacagtctctcagatcgcagtgcaattaaattagaactcaggattaagaaactgactcaaacccacacaactacatgtaaactgaacaacctgctcctgaacaactactgggtaaataaagatattaaggcagaaataaataagttatttgaaaccaatgagaacaaagacataacataccagaatctctggtacacaattatagcagtgtgtagagggaaatttatagcactaaatgcccacaagagaaagcaggaaagatctaaaattgacaccctaacatctcaattaaaagaactcaagaggcaggagcatacaaaaagctagcagaggacaataaataactaagatcagagcagaactgaaggagatagagacacaaaaaaaccttcaaaaaaaaatcaatgaatccaggagctggttttttgaaaatatcaataaaatagatagaccactagccagactcataaagaagaaaacagagaagaatcaaacagatgcaataaaaaatgataaaggagataccaccactgatcccacagaaatacaaactactatcagagaatactataaacacctctacacaaactagaaaatctagaagaaatggacaaattcctggacacatacgccctcccaagactaaaccaggaagaagttgaatccctgaatagaccaataacaaggtctgaaattgtggcagtaattaatagcctaccaaccaaaaaacagtccaggaccagatggattcacagccgaattctaccagaggtacaaagaggagttggtaccattccttctgaaactattccaaacaacagaaaaagagagaatcctccctaactcattttatgaggccagaataattctggtaccaaaatttggcagagacacacacaaaaaaaagaaaatttcaagccaatatccctgatgaacatcgatgcaaaaatcctcaataaaatactggcaaaccaaatccagcagcacatcaaaagcttgtccaccacaatcaagtcggcttcatccctgggatacaaggctagttcaacatacgcaaatcaataaacataattcatcatataaatagaaccaatggcaaaaaccacatgcttctctcaatagatgcagaaaaggccttcgacaaaattcagcagcccttcatgctaaaaactctcaataaactaggtactgatggaacatatctcaaaataataatacctatttatgaaaaacccacagccaatactgaatggtgaaaaactggaagcattccctttgaaaaccagcacaagacaaggatgccctatctcaccactcctattcaacgtagtattggaagttctggccagggcaatcaggcaagagaaagaaattgtctctgtttgcagatgacatgattgtgtatttagaaaaccccatggtctcagcccaaaatcttcttaagctaataagcaacttcagaaaagtctcaggaagacccaggcgcggcgttttacctgcagcggctgtgctcgccccgccgcgacccccgcaggacggagccggatccccctgcactcgggcggacctgggaccctcagaggcgagccggctgcctcgggtcacacatccgcgaactccgggggcgggctccccaggacgccgccgaccccccacgacccccagccctcccgcttccgtggaaagccgccccgacgacccctgtgcgggctgttgaggggccgcaccccgccgaccgctgtgggaacacctccgcgcgtgcggcggggacgcggcgagtccggggcaggaagaacgcacggatggagacaacaggaaggaaagagaccttcctggtcacacttgggccacaggagaacaggcagcggcccaggaggatccagggtcctgatggtggttgagaagctggttcttagtgatcactcagaaacgtcggcctggccttgtggggtcagaccttgcatctcagtcagcccagggagaagaagaagatggtccacacccaagtgcagggaacatcgtggcagtcggctgggtgcctgcgtccaggcgaggacacctcccgcatcagggaaacacacgtttctggagtgaggaggctgaaggcagggcccagaggagagctgagccatggaaggaggtgtgtgcatggatggtgagctagagcaggtgcaggtgcctcagggaggatgtgtgggacgaactgactcagggaaccataagaaatgctttcaccaaacaggagaaacctgaaggtctgggtccagagcctcagatcttacactggcagcacacagggacacaacagttggactggcagcaacagggcttgcagcagctggactggcagcacacggggacacagcagctggactggcagcagcagggcttgcagcagctggactggcagcaggatgatccacagcctgaggagcagcaacagggcttacaacagctggactgggagcagccacaagaaccacagccccccttggaacccccacaggagccacagccccccttggagcccccacaggagccacagccccccttggagcccccacaggagccacagctggtgcaggaacaggctggcacccaggagcacacgggcttgcagcagcagacaggcacataacatctggagccacatcccccacagctggagctgcagcccccacagccagagccacagcccccacggccggagccacagcccccacagccagagccacaacccccacagctggagccacagcccccacagccggagccacagcctctggagcagccacagcagcccatggttctggtggattgagggtggagcaggtagaggagcaggtgagagggaggtgcaggtgtggagctccctgagcctgggctctttatatacctgtccagatgtcaggcatgacacagggtccctttcttgtgactgtttacactatttttccagagctctatttttttcctctttgctagtgacttccttctggctcagttgagcatctactttctttgttttctaaatttgtctttttccccatttgttttggcccctacaattaaaacctcagctccaggctgtctggttcttcctgcaaagctccagggtgctggtcacctgctctctgctgaccacatgtgaccaatgggcaacagcctctgcccacgtgctctcatctttcctgtgttgactccctcaataatattaattttacatttttagatttcaaaattatccacgatctttatactcatgccagtctcagctttccgggtgtgttagaccattctttgcattgctctaaagaaatacttgaggctgggtaatttataaaggaaagaggttagaatggctcatggttctgcaggctgcacaagcatggcacccacctctgctcagcttctggggaggccctcagggagttttcctcacggtggaaggcgaagcaggaacaggcacaccacatggtgagagtgggagcaaggggtgaggaggagccacacacttgtgaacaaccagatctgagtgaacacactcatcgccaagggggtggcactaagtcactcatgagggatccacccccatgacccagacacctccctgcaggcccctccttcaacactggccaacaactatatgaaaaaatgctccacatcactaactattcggggaatgtaaatcgaaaccaccacgagataccatctcatatcagtcagaatggcttttgat

SEQ ID NO: 2282 - DNA, 813 bp, Homo sapiens
ctcttcccgatctcctcctccccgagcccggcgcaccgagccggccgtgccaccgagctgcggctctggccccggcgccgcgggtgcgctgcggatgggcttggggcgcacccagcgagcagcgagagtcgcggtgtcccgggcgctcgctggcaccgtggccgcagcggccggcctgggagccaggagggcgaggcggctgcaccttcggggccagattggagttcgaagagtggcgggtaccccagaagctcggggccggggcgatggctgcagcctcgggagggtatcgccggatcgaactccgggaaagggaagcaaaggcatggaacctccgcacactggatgagaatccatcttccattcgagctgggaatagactttgtgaaagatattatgtaatggagtctcgggaaccctgagacctctccagcgaagctgaagtgaattaattaagtgctttaaacggtcttggtaaatattccgcgggagctggggaggaccgttgggatggctgtagcttgagttgaattttaactgtcctcattctgggttttgtcgctctgctttctgtgccaaggtgctgtgttacgggagagagtgactggaaagtaacaaagctgaatctttctccctggagtaaggccgaagactggattactacacgcctagacgtgacactacacccatagatctcatgcatcattaatgccatatgacattgccattttctttctcagttcacggacaaaagtggtgggttttcattgtcttcactgattgtcaatgcattaataaagaagatgtgtggta

SEQ ID NO: 2283 - DNA, 10019 bp, Homo sapiens
gggctccgagcccagctccactggccccggccgcggggctcgcccctccgtccccaaacgaccgtctccgctgccatgagatgccgacagcctgtgcgctggccgccaccccctgctccatcaggtgctggaatctgagtaaaagcctgggcgcgagctcccagccccggggcctgccaccggctccacgaagcgggcagctccagcggccgccgggagaaggaagggcgaccgggggagacgggtcgcagggacagcacgtggcggaaagttagccccggactagcacgccccacccggagaagccggcctggaaggggctgcggaccaccaggcggagcggtgggcgaccgaagtgcggctgggctggcctcctcgtctccgcactggaagaattgcccttccgcaagtcttcccttcccacatgggggccctccaggccgcacctcggtcgcccaccgcttcccttgagaagggagactaaagacaggcatctggaagctgtcactgtggcgcgcgggcagacaggggatcccattggagaggaagagccgtagtagtcgctgctgccttcggccgacccaacggccgcctgcttgggaggaagaaaaagaacgcccccgctgaagaattaaggcagccattggttgctctaggggtaaggaccgaggcctcccctgggtgtcactggagcagccacacgtgggggatcagccgacttcattcgatcgctggcgacagacccggcgacccgtaggaatgcgcgctggggctgcggctggagggcgtggcgacggcaacaggcgggtggctcgagtgggtgcgactctgggcgcgtgggactgagaactcctccgccgtggggaagatttttttcccagcagatgttggggtgttactgcgtgtctgaggggccggcggaatggaggggtcccggtgcgtgcagggcagcgaggtgtgtcagatgagctgtggatccctgcggccccacgtgggccggagaggggggcccacgacaacaagcgattgaggacagcgatggacagggcggggaaccagctgggtggaagcacagggagtgtggtgaggagggaagggctgtgatctgccctcggtacgacgccccaagggacagcctggcctcctgaattagggaaaagacaaccggtctctttagacgggcgcctcagagtctgacctgagtcttcaaacgcccagatcccctggggccttgagtctccctgtcccgctggccctgcctcgcctgcgcttcaggactccgacgcccccgcagccttgggctaagggtcagtcgtccccgggcgcgggtccggctgccctggaactgatgctggatttcgctggtaggtgggctaggggcttggtcaccccgtctgaattccactgtcaggacagctgtggaaccgccagagaaaagtctggccatgaaagaaaggtgaggggcgccgacgcagagcttatttattcagtctgtgggcggactcagacgtgcagagcaccaacctcttcaatttctgccctctagactccaaatcttttgaaattagggaccaccattttatgccaaacatacagtaggcgctcaataagtgttgaattaagattacacataaatgggccgggcgcggtggctcacgcctgtaatcccagcaccttgggaggctgaggtgggccaacatggtgaaaccttggctctaaaaaaatgcaaaaattagccaggcatggtggcgcttgcctgtagtcccagctactatagaggctgaggtgggagagtcgcttgaactctggaggcggaggttgcagtgagccgagatcgcgccactacactccagtctgggtgacgcagtgagaccctgtctcaaaaaatatataataataagattacacacagatgggtgctgtgcaaagggagggggaagacaaatactttcttctgcagctctggtacatggacattttgtcctttctccataaggaggatcagacagcagcagcactgcccatggaccagaggcctcatgtaaggcctgggaaaagagggctccacacaccaccaaccggatgtaagggcagttgcaaaggaactgtgttatcttgaccagaacagactgtagaatttgtttatcaaattttttttttttacttatttattttgtgaatgtatatgctgtaaactcatctgcttagattgtaagaatgtgaatgccctaccttggtgggtaggttagtttattctaatcagcaaaacttaacgttacatattccaacatctcatttgggatgtgaagatgctatggggagggtgggtatcctggcattgctagaatgttggagccttagcgagagagtggcagagtggggagaacctggcacttcagctacagatgatcacttatgagctttgttatatcaaataagttaaactttcatctcattttttttttttctattgtaaaatagggtagtaacagtgagtcctgggggaggacgtgttctgttagccagatccactctccaacctgctgtctgtcctttggagccttaactcaagagactttctttccctctagcttccagttgagtgaaggcactaggaagcaacagcgatggaacaaagaggaaggagtatggttatttattcccccctggctcccttactatggcaccattgcaggctggttgcctccctcaaccaaaggaagcagccagtatccctccctagggtgacccagagtaaacccctatggtttcccttcattttgcacatacctttgcagatagtctttttataaaactctactcacattatccagtaggaatgaacatctcattccttcacagaattgttttgagagttaactgagaaaatactgtattattattattagaatgacctataatttctgtccaaactgagaaacttttgaggctgggaaaagggggtttgtgctgatagtaatgatgtcaggacaataggaaaaacaaggacttatggccaccccagctattattgccagtaaactctgctttagacatattaagcaatcaagaagtggtcgtactatcacgcttctgtcactagactatgaatgtctcaaggtaagagtgcttttttgtctattagcttctgtcacatggtctggtatattcaataaattttgagttggagatgagggtaaagactaggaaatgaataatttttattgccatactaaggtaatgaagagtcaaggaggtctttaagcaaagaaaatttgcattttagaaaacagctatagtgaatatttggcattgttagtaatttagggtctattccctttttaattgaaccccaatttatttggagagcttttccaatgaatgtttcaacttggtaaaaagtaaatgcctcttaaaaaagaggttctgggccaggcgtactggttcatgccttgtaatcccagcactttgggaggccaaggcgggcagatcacctgaggtcaagagttcgagaccagcctggccaacatggcgaaaccccacctctactaaaaatacaaaaattagtgggatgtgctggtgcatgcctgtaatcccaactactcgggaggctgaggcaggagaatagcttgaactcacaaggtggaggttgcagtgagccgagatcgcaccagtacacttcagcctggctgacacagccagactccatctcaaaacaaaaccaaaaaaagaggttcctcgctggctgtggtagcatggtgtagtcccagctactcaagaggctgaggcaggaagatcacttaaagccaggagtttaaggctgtagtgcgttatgattgagcctgtgaacagccaccgtactccaacctgggcaacatagcaagatctcacgtccaaaaaaattaatttaatttattttcaataagaggctcctgaagagacgttccatcacacccttcctttcatcaccacagtacatacattcttaagaaagtatgtgatctaagcttggccaattagatgctgttacatttgaattttgaatcaagagacacaaagacaatacaaattgttacagtttatgcaggccataaattattttttactttttggcaaattgttacagtttatggggtctacaatttatttttttattttctggcttaagttatctaggatttgtttctgtggtttacagtcaaagaacccaaagaccagatcactcttgactaccataaaaatgattaattataaagggatacaagaaaaacaggaggctgggcacagtgtctcatggctgtaatcccagcactttgggaggccaaggtgggtggatcacttgaggtcagaagttcgagaccagcctggccaacatggtgaaaccccatctctactaaaaatacaaaagttagccgggcgtgatggtgggcgcctgtaatcccagctacttgggaggctgaagcttgagaatcacttgaaccggggaggcagaggttacagtgagccgagatcgcaccgctgcactccagcctgggcaatagagcaagactgagtcacagaacaacaacaacaacaacaaacaaaagcacacacacaaaacaggtgataagttagctattgccactttaattttggatggtttaactgactgtcctgaactgactgatcctgaactccttctgcaacacaatatgtaaaaatgttcattaaaacattgtaaaatgcatctacatttgagaggaaaaagtaaaactctctattcacagataacacaaatatacagaaaatcctaaggaatccactaaaaaatcattagaagtaataaatgaactcagcaagtttacaagatacaggatccactgagattctgataaacatggaaggcaaaaacattgaaaccgtcatttataaactcacataggctccagtgattatctcttcttttctttgttaaaaaaatgcatttaaaaatcattctagaaaattgttaggcaatgttaaatttaccaataactctgactcttctttgcccctaccactttttattatctttgaaaatcaagacaatatttgcccttcttcaatcttttatcatttcttatttttctctggcttctggaaagtgagtaattacctttacgatcacttatgaaatctcttgcatggataattcatttaggcctagaaactcatttaaagcaatcgattgcttgcttaccatgctggattttagtagcctttaaatcatgtttattctaccttttttcattaaaacattagtctctttgggagaggagacaaataaattaaaacttgagttttaccttttctttgtcatctgatagcattatgtcatcagcacgaagcagtagcttccatcctttcttgttcaccctcttgtggcaagtattacttgaaaaacaaaaaaataaatttaaaaaaagtctttgtattctttttaaaggcaaaaattatctaagcctgcagggacatttccattcttataggctatggtactctttaaagcacgctgtttaaaaaatctgattgcaataagtatgtcctgtgaagtgacatgctccttagagtaagatgacttggcttgctggccactctgtttggcagccagccctggagctgggtcagtttcccctggctctggcatcactccttctcagataattcctttctccctgtggccagtcattgtggtgacagttattattctttttcatgagcctagaaaatttatgtggtggatgtccctctgaatactagatactgccactgaattagaagagaatcatatgcacttgtatattctgacagccatgtcacttacaccttctcaccttttgtctcgtcctatttgctatctaccattctaccactgtccatttctaccagctgaataactctctgatgcaggggttactctgcaccctcatctcccttactgtagacttgttccttttgaatgagataaaatttccttgacttataatatttcagtcataatttccttgctacctcatgtaccgatacctattggattatgttcattttgttaattttcccaagttcaatttgctttaccactaattctctctttccaggctgagatttcaaaagtcatcagcattatatttcaccttacttctgtctgttttattgagtcccatctgaatcagcagaagtggctgtaggttggctggtatcatgaattttggcagattatgcttcatgagtcatcattccacactttaggaagataacgaactagccgttgcaagactgccttcctactcatcagcagagaaaacatggacttggaagccaggacacttgcgttcgtgttcctacactgtcaaacatcatgagctatgcaaaatttttaagttgatgtatttggatataggcgaagctgctgtaatgggaatatcccaagagtcattggttaaagaaaaatagatggttttttgtttgtttgtttttgagacagtcttgctctgtcacccaggctggagtgcagtggtgcgatctcagctcattgtaaactccacctcctgggttcaagtgattctcctgccccggtctcccaaatagctgggactacaggtgcaagccaccatgcacggctaatttttgtgtatttctagtagagatgagatttcaccatgttggccagactggtctcaaactcctgacctcaggtgatctacctgcctcggcctcccaaaatgctgggattacagatgtgggccaccgcacccagcctagatgtttatttccgattgttaccttatctactctgatcaaaacagtctcaccagcaccatatccacattctagcccatggaaagggtaaagaaaagaaagtggaagatattagtttccatttaaggaagtgacatggaaataatataagtcacctgtgttcacattccactggcaaaaattcagtcacaggaatgtacttagctgcagaggaggctaggatatgccctccaaaaactcaggggggatgtcctacttgtaaaaggaagaaatgaaaaatggacactgagaggaaatcagcagtctcagaggtaatatacttacacagttttttaaaaaacataaaatgatgcagaatgaagtttccactctattcaccatctatccagtcctcatgcctcccaacaagaggtaaatactttattattgtgtcatgtatctttccagagtttttctaagcaatttgcaacagatataaatatgtatccttatttcctaccttaccccatattgtacatgaaagaaaaaatatactatgtataacattctgtatctttttttcacttaatatattttgcagttccttttatatagatacatagttaccttcttcattcatttatacagctgcctactgtttctaaggctatatcactgataaagtctcatggatacactcaaggttttttcagtcttttatcatgataaaccatgccgcaataataaccttgtactagtcatttttaacatgtgaaagtatatctgcaagatacatttccagaaatgggattagccaatcatatgatattaagccaaccttttgatctctttgagctgcatttgttaactaataaattaagctcatatttacctcataggatcattattataatgaaataaccatataaacaattattgtacaacaatatcaaaaacaaaatagagataagtttatcaaaatatgtgtaagatctgtactctaaaaacctataaaactgtgttgagagaaattaaaggaagcctaaagtaatggagaaatataccatgatcatggattgaaagactcaatattgttaatatgtaattctccctaaattgatctacagattcaatataatcccaattgaaatccaagcaagctttttttaaaaatagaaattaacaatctgattgtaaaatgtatgtgaaaacacaaaagacctatgctagctagccaaaacaattttgaaaaagaacaaagttggataacttacactgtgcaatttcaatacttaactaaaaagctacaataatcaagacatggaatcggccaacatacaatcatatagtccagtgggagagcatatggaaagtctacatatagacacatatggtcaattgattgttggcacaagtgccaagataattctatgggaaaggacaatcttttcaactaatcatactgggactattggatatccatatagaagaaaagaacctcaaaccttatttcacctatacacaagattgaatccaatggatcataaacctaagtgtaaacagtaaagctttgtttagaagaaaacaaagaaaaactcttcatgactgtgggttaggcaacagttttgtagaggagacacagaaagcactaaccaactggatattatcaaacttcaaatttttgctcctcaaaatacaccactaagaaactaaaaaggtaagccacagactggggaaaaatacctacactatttgcaaaaaataataatgacaaaatatgtgaacatacacataataaaagaagatacatgtttggccaaatgcatgtgaaatggtggtcaacatcattagtcatcagagaaatgcaaattaaagtacaattgtatgcctcctagtagaatggtgaaaattagaaagactgatgattccagttgttcgggaagatgtggagtactggaactctgatgccttgttgctgtctttgtttagtgttggtataacagaatacctgaggctggatattttactttaaaaaagaggtttattgggcttatgattgtggtgactagaagagtcaagattgggcagctgcatctgatgaaggcctcatgttgcttcaactcatgacagaaagcagaaagagagagtgtgtgtaaagatcacattgtgagagaggatgcaagagagagaagccaaggaagccaaactcatttttaacaacttgctatcatgggaactaattcattctctcagagcaagaactactcacctctgtaggagggcattcatctattcttgagggatccatctccctcacccaaacaccttccactagcctacctcccaacaccaccacactggggataaaatttcaatatgcattccagtagggacagaccacatccaaaccattgcagttggtgaaaatgcaaaatgtacaagcactttggaaaacagattggcagtttcttatgtagttaaacatatatttaccatatgactctacatttacactaaaaaatagttacacgacagaaataatgagtccacaaaaaagcattcatagcagctttatgcatagcagccaaaaaatgaaacagcccaagagttcaacaacaggttaactgacaaacaaattgtggtacctatatttacataatagaaccctgctttggtataaaataaaccatggatacatgcaaaatgtagataaatctcaaatacattattctgagtgaaagacgtcagaccccaaaattacaaatggtatgattcaacatatatgaaattctaaaaacacaaaactgtagttacagaaagcaaaacaatggtggcttggggtatcagatgaggaggatggacttgaaaagagcacaggatggacttttggagtgataaaaatctgtatcatggttatagtgatgattagatgagtgaatgaatttgtcaaaattcatttgtctgtacacttaaaatgggtatggttgtatacaggttaaacatcaataaaaaaatcttaaattgctgtactaatattgtttttgtgatatcaaaacctgtaagagtggacctctttctctacaagttatcacatgccatcaaacttttgcttagatttgttgaatgcttttctgtctcaggcaccatgcaaagtattttgtatgcatctctcatttaatcatcacagcaatcctctggcatttctccatttcttgatgaggatactaaagcacagagacaataagaatattatccactttggg

SEQ ID NO: 2284 - DNA, 1145 bp, Homo sapiens
taagccatattctatatgcatatttattatgcatcattgtaatttaagatatatttggatgtaggctgtataaatgcttttaattgttctgtgaatagatccttagctttagtttcacctgaatcttgtgcaaaacacagctaaataattgaattgtattatagacattatgaggtaattgatcttttaaatgtaaggagtaagattgatctataataatgtgctggggaaaacatttatagatatgtacatcatggttactttttgtcctttcaaatggactttttatttctatttatggagagactgtaactactgcttttaatgtctttttaaagcaagctatttaccagcttgaaaatatcatgcatttaaaatagaatctatctggggagtctaattactattgttcctatttgagccagttgtctttcagtaaagctatagaatctctcaaagaagtaaatagaaatactacttcttaaatgtcataggaagcatatccactttgtttctattagtactttaagatctataagaccttattactaaaaagtagaggaatataaagaattcatcaatttctgtatatgggctttaacctaattttccaggttatgcgacttataaagcactgtgaccaaacttccagagacagtaaaaaaaaaaaaaagaaaaaaaagttttactccttcagaagtattgtcatgctactgctgtacttattttcctaatctctctctatctgctatactccctccttttctttctttttcttttaagcttttatatttattccttcctttgttttcctctctgtaagacagctactactgagcactaattagtagaaagtcagagtggaggttatctgtgcatgtctttctgcaaacattactgttgaggccatctgaagagagggattgataggttaggctgttgcaccgtgaatgtcctgctttgcatttttaacctcagctccccaacatatatatcttgcagtttatatgccttttcatttaaccgaaacctcttttatttaatttttaacataacaacctacaattcttgtgtttttattatgctgtatttttctgtgtttcttattacatgtgattgctaaataaatcatatttgagggaaaa

SEQ ID NO: 2285 - DNA, 1377 bp, Homo sapiens
ctatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccca

SEQ ID NO: 2286 - DNA, 1791 bp, Homo sapiens
agaccaatttgtcacccaatatgtgggtgtctaatactaagtaatttaaccaacttttgaagccccgcttatccacaaaaatgtttttcagcaaaactttgtttcctgttaagctattaatacgggtcatcttttagctttgtaattgaaaaaaaaaaagtttagatagtagtttaccttaaaagcccattcgaactgacataggaagatgaaagagactgacttgtccaaattgtcaggtccacctctgcatcacagtggatgtcaggatgtaaattttcagtttttctcttacatctagaaagtaaatatattgctgagagggaaattgtttgcatcaaaccagataaggaaggagggctaggcaaatttagttctcatttagcaaaacttcctgatttgttttgttacttaaatggtgacatcagtgtttggtcatggtagacacttaggtgatgatagccaaaacatccatcgattttactaaaatcactgccattaagagagttttttgtctcttcatgttcaatgtttgaaaggtattcagtaatctatttcagaagcaaatcaattagggaatggtgtttattaaaatacggtacagttgccaggactttaaaagatggtactggtttctaacaacttacgagtatatagggtatttaaaagatgggagagattgaagaaagacaaaggtttaaaggtcatagccttcgagcataagaggcatatgaatggtgtcttggccttaactcccaattatacgaacttctgttttagctgaataggccagtgcctcgtgccttgatatttcggcaaatctattagtggttccttaagcatagggaactttgtactttatgctctgtcgccataataatgtatttatagaattaaacattctcaaattagggtcttgttaaactgactttttctttcagaaagtagctacttaaattctgttacagctacaaaagatccatcaagtgctgactgcttaaactgaagaaggtgtccagggccttaattctgcaaacatttcctgttgttagaaagtatgatgcttgaacagcgatctcagtgtattttatgttttaaagggggtaacgtttggtgtgtttaagagagctgatgtgttttggatgagactaaagttgatccttggttttacattaagatgaacctgggtccatgtgtctgcttaaagaatgtaaattggcatacttgataggaggataaagctttgtaggaattagaaaagatcattctcttttttgttgcagaagcagtatagtatagtagttagagcatgggccctggagccaggctgcttggtgtcttcctttatttatttatttatttaattataaaaagtaaatataaagtgagctatgttgaccaggttcgtcttgaactcctggcctcaagcaatcctcctgcctcagcctcccaaagtgctgggattacaggcatgagccaccacaacctggcctgcttgggtttttctatcttggctctgccacctagctgtgggtccttggacaagttacttcatctctctgtgcctcaggtttttcaaatgtaaaattgggataattggatctgtctcatagggttgtgaaaattaatgagttaatgctcttagaagagtacctcatatgtaataagcacgcaactgttaattattgttaatgtagaagttaattctgtgtataaatcagatacactgtggtcaaagatttgtgtgtatttgtaagaaaagaggagaatggagaatctatttttaagtgg

SEQ ID NO: 2287 - DNA, 470 bp, Homo sapiens
atcttgtgatcaccctcattacctcttctgggccccctgtggacctgcgttgacccagcatgggctacaatgggggagttgggtaatcgctcccgttgcatcctgtttctgtctgaaaacccttgtctttctgaatccatctttcagtctctcacattctgtctttcccctcctccttcaccttccctccgtccctctcccttgcgcacttgccgggtaccagctgagtgcatccttttcccaaacctgctctgcttccaaggggcccttttctgtctcctccacctgtccccatgttttggggactgcctggaaatccgggacaccctcctgaggagggagctggtgcccaacggcacctcttaggatgaacccagccagctgcgttcctggcctctgcagaatggcatacagaaggcattttaagcaagcgagctgagctcgccgcaggactccgactaccaggcacc

SEQ ID NO: 2288 - DNA, 1293 bp, Homo sapiens
taggcactacaattccctaagaaattcattttcaaaacatctaagcgactttcgggagctccttgggggaaatgttacgaagggagtgggcaggtaaagacgggatgcgaggggattatgttcacgaagcgatgtgtaggctcctctattcgaaggacctcggggagcccctcagctcccaggagagctgctgcagccacttcaattctccactacagaaggggcggaggtggcccctggagggtggcgatgggaacggggctcatctttagtctggtggcctctcgctgggtgtcgagggggtgtaactggcttcaagaaaagagctagggagttgaaatgccagacagggcagagaacggagaggtggcccaacggacttaacggcgtgcggcgaggaactgcctgccggcaatccgctaactagtgaggattgattgactctttctgtcatcagcatccttggaacccctacccctcctcaggactcccgacttttcgctcgccactggccgggggccgcgggcgcagggctgggcgtgcgtgtgtagctgcgcgcgcgcgggtgtgcgcgcctgtgtgtgtgcgcagcccgagctctgagcccggctgccaagccccagccggctatcctgcgtcccgccttgcagccgcctcctcaaagcctcctcacctggcgccgccgcccgccgcccgcccagccccgcaccggcgctgcctcccctgaaagtttccccagcgtagacaccttcgcgctgcagcagcccagggagacggtgttccgaagctgtgccttggagtggctcttcttacacctttccgcctcatccccacctaattcgggcagggagtagaaatttttccaaattaaggggagaaaggggggaggggcattatcgagagaaagcaagaggagcggccgcaactgagaatatcctgcctgatgccagggaattgactgacgtgtctgtggggttacggaagaaaactgaataggcagccaagttggcccaggaggggctgggaggcttccgggtgccgggaaggtggtcccggtctccatttccactggtacgaaggcttggaggcgcctctatggtgagggcttttgaaccgccatcccctcctgatcccttggaaaggaggagccttcagagctgaggagggggaagtccaggaaaagcccctggacttgtgtgcgtcgcatccttggcttgggattttaaggacacgaaggagaattaacagcgcctcaagcaatatcagctacttttgagattgtgacatatatgt

SEQ ID NO: 2289 - DNA, 6659 bp, Homo sapiens
cgtttattcatttacttccgctgcagatttcttgactgctgaatttcatgagaagggattgttcagggagggacatggggctgaagacctggagaggaggtggtgctaccgctgttcaaatctgagggtggtggagatggagccttggggaggagcaggtgctgccttttaagtctatgagagtcgttgagctggaggtccagggaggagccagtgctcccactgatgtcttaggttgtggagctgaagacaatgaaggagccagtgtggctgttctgtgagactcgtggagctggagatccaggtgggagaggtgttttagctcggggaagagctgatgttctaccttgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagattgagggtcgtgcagctgcagacccggggaggagctgatgttctagatagagggtcatgcagctgaagactcggggaggagctgatgttgtagtttgagggtcatgcagttgaggactttgggaggagctgatgttgttcgtgttgagggtctttcagctggggactcagggaggagctgataatcttgattaagggtcatggagctggagacccagacaggagctgatgttctagttagtggatcttccagctacagagtcagagaggagctgatgttctagattgagggtcatgcagctgaatactcggggaggagctgatgttgtagtttgagggtcatgcagttgaggacttcgggaggagctgatgttgttcacgttgagggtctttcagctggggactcagagaggagctgataatcttgattgagggtcatggagctggaaacctagacaggagttgatgttctagttagtggatcttccagctgcagacccagggaggagctgatgttctagtttgagggtcgtgcagctgaagacccggggaggagctgatgttctagattgagggtcgtggagctgcagacgcggagaggagctgatgttctagtttgagggtcgtgcagctggagacctggagaggagctgatgttctagtttgaggttcttgcagctgcagacctggagaggagctgatgttctagattgagggtcgtgcagctgcacacttggagaggagctgatgttctagattgagggtcttgcagctgcagacctggagaggagctgatgttctagtttgaggatcttgcagctgcagacccggagaggagctgatgttctactttgagggtcgtgcagctggagacctggagaggagctgatgttctagtttgagggtcatgcaggtgaagactcggggaggagctgatgttctagtttgaaggtcttgcagctgcagacctggagaggagctgatgttctagtttgaaggtcttgcagctgcagacctggagaggagctgatgttctagattgagggtcgtgcagctgaagactcggggaggagctgatgttctagattaagggtcatgcagctgaagactcagggaggagctgaggttctagtttgagggtcgtgcagctgaagacttgggaggagctgagattctagtttgagggtcgtgcagcagaagactcagggaggagctgatgttctagattgagggccctacagctgcagacctgaagaggtgctgatgttcgagattgagggtcgtgcagctgaatactcggagaggagctgatgttatagtttgagggccctacagctgaagacccggagagtatctgatcttcgagattgagggtcatgcagctgaagactccgggaggagctgagttgctaatttgagggtcttgcagctgctgacttggggaggagctgatgttctagtttgagggccctacagttggaaatctgtacaggagctgatgttctagtttgagggtcatgcaggtgaaaaatcggggaggagctgatattctagtttgagggccctgcagctagagatgcagacaggagctgatgttgtagtttgagggtcgtacagctgaagattcagggaggagctgctcgtgtatttttagggtcatgcagctgcagacccggagaggagctgatgttaaagattgagggtcatgcagctgaagactctgggaggagctgacgttctaatttgaggtccctacaggtggacaccgagagaggagcttatgttctagattgagggtcatgcagcagaagactcggggaagagctgaggttgtagtttgagggtcgtgcagctggagaaccagacaggagctgatgttgtagattgagcgtcgtgcagctgaagactcagggaggagctgatgttgttcgttttgagggtgtttcagctggagactcagggaggagctgacgttctagattgagggtcttgcagctgcagacctgtagaggaactgatgttctagattgagggtcacgcagctgaagacttggggagaagctgatgttctaacttgagggtcgtgcagctgaggactcggggaggagctgatgttgacagctgtgcagctggagatccggcggggagctgatgttccggtttgagggccggggagctgatgttccagtttgatggccgtgcacctggagacccagggaggaacatcaaactggaacatctgctccccgcagtgcctccagctgcatggctcccaaactggaacatcggttcccacccgggtctccagctgcacggccctcaaactgcaacatcggctatccccgagtctccagctgcacggccctcaaactggaacatcagcttctccccaagtctttcagctgaatggccctcaaactggaacttcagctccccaccgggtatccagctgcatggccctcaaactggaagttcagctccccaccgggtctccagctgcacggccctcagactggaacatcagctccccactgggtctccagctgcacggccctcagactggaacatcagctccccaccgggtctccagcttcacggccctcaaactggaacttcagctccccaacgggtctccagcttcacggccctcaaactggaacttcagctccccaccgggtatccagctgcatggccctcaaaccggaagttcggctcccccgcgggtctccagctgcacggccctcagactggaacatcagctccccgccgggtctccagctgcacggccctcaaactggaatagtttgaactcagcggggagctgatgttccagtttgagggctgtgcagctggagacccggcagggagctgatgttccggttgtagggctgtgcagccggagacccagggggaagctgatgttccagttgtagggccgtgctactggagacccaggggtggagctgatgttccagtttgagggccatgcagttgatgacccggcggggagctgatgttcaatttgagggccatgcagctggtgacctggcagggagctgatgttccagtttgaggaccgtgctcctggagacctagcggggagctgatgttccagtttaaggccatgcagctgtatgcccggggggaactgatgttgcagtttgagggccgtgcatcgggagacccggtggggagccagtgttgcaggttgagggccgtgcagctggagaccctgtggggagctgatgttcttgtttgagagccgtgcagctggagaccctgtggggagctgatgttcctgtttgagagctgtgcagctggagatctggtggggagctgatgttccagtatgagggccgtgcggctggagacctggtggggagctgatgttccagtttgagggccgtgcacctggagacccggcagggagctgatgttccagtttgagggctgtgcagctggataccgggggtggagctgatgttccagtttgagggccatgcatctggagacccagttggtagccagtgttgcaggttgagggctgtggagttggagacccgggttggggggagctgatgttccaggttgagggccatgctgctggagacccagcggggagctgatgttgcagtttgaggcggtgcagctggacatgcaggggggaagtgatgttgcaatttgagggctgtgcagctggagaccctgtggggagctgatgttcctgtttgagggtctcggagctgatgttccagtttaaggccatgcagctggagacccggtggggagctgatgttccagtttgagggccatgcatctggagacccggtggggagctgatgttgcaggttgagggccattcatctggagacccagtggggagctgatgttgcaggttgagggctgtgcacctggagccccggggtggagctgatattccagtttgagggccgtgcagctggcaatctggtggggagctgatgttccagtttgagggccatgcagctggagaccgggcagggagctcatgttccagtttgcaggcagtgcagctggagacccggcggggagctgatgttccagtttgaggtccgtgcagctggagatctggtggggagctgatgttccagtttgagggccctgcagctggagacccgtggggatctgatgttccagtttgagggtggtgctgctggcgacccaggcgggagctgatgttctagttttagggccctacagctggagacccggggaggagctgacattccctttcgagggctgtgcaggtggagacctggggaggaactgatgttgttctaatttgagtgtggtgcagctggagatccagggatgagatggccctgcggttcaaatatgagggtcccggagctggactctacgtgaggaaccaatgctgcctctgatgtcttaggttgtggagctggaaactcgcggaggagctggtattggtgtttctagttgagggtcgtggtatttccagggtttcacagaggccagattttatttcagttactcagaagagaaagaaaatgtcttctgaaagaggtgaactcagtcattaccaatagaaaaagtatccactgtatttatctcttatacaaacagaaaaatataacattttcccccttagaatatatatatatatatatatatatatatatatatatatatatatatatatataaaacttaaggttctattgtatgtatccgaacaataaaatctggaaaccagcatgaaactctattattcacatgttaaaatgttgaaactatgaccaaaatatgaaaactgctggagctatcagaaagacacaagacaaaaagcttcttgcatatgtataaactaaatgtgataatctcaaaaaactgttcaaaattataattactttccagtttaaaaactttaatcctaaattaaaaaaaaaaatctatacacaaaccactgatttgcccagaccaaagaaagaaagaaagaaagaaaagaaagaaagaaagaaagaaagaaagaaagaaagaaagaaagaaagaaagaaagaaagaaagaaagaaaaagaaatcagcggtaaggtaagcaggacccagaggagctgatattcacagttcttacatggacaactctttcaggaattatccataaagtactttattttacaacctgcttttcttataaaactaaaggtgcacttttttacataaaagttttatacagtgttaaaaccagaactgtgtgtaaaatactgcatgtaaatgtttctaaatagtcttgttccagtggttcatcggtgacttctgtggcttcgtcatcattatccatggatgattctgaaagaatctctccagttttactggaattggatcctactaattcttctgtttcacggcagtcagaagaaccactactttcagggccttcgttttcactaccttcagaatgtagtaaatctttctcagcttgagacacatcagattcctccatttcattattttcctcagaagtctcttcattcacagttgaggcatcatcagattctttttcttggttttttctttctgggaccatttctcttgatgtcataaaagactctaaaaataagcaaatgttgttgtacttaaattttatattcaaaatacctccacagttaagtttcgtgaattctgatgttctgtagttcaaatcacatcccctgaaattcagcagcaactgcatacaggtgggagaaaagcccagcgtcgacattacaaggagttccatgatgtacaattctttcacaaaaacaatgaatgcaagaatttgaggatctccttactcctcccttttacagatggtctctcaatcccttcttcttcctcttcatcttcatcttctt

SEQ ID NO: 2290 - DNA, 1080 bp, Homo sapiens
agaaaaaaaaagaaaagtgagggtggagggagggagagcacgacgtgcgcgcaccctctccccttgtccactgctgccgcctccttcttctgccgctcctggtgctgcttgtgtgctcgtttggagcggacctggtacctcttttgtgaagcggcagctgaggagactccggcgctcgccatggccgaagaaaagcccaaggaaggagtcaagactgagaacaacgatcatattaatttgaaggtggcggggcaggatggttctgtggtgcagtttaagattaagaggcatacaccacttagtaaactaatgaaagcctattgtgaacgacagggattgtcaatgaggcagatcagattccgattcgacgggcaaccaatgaaacagacacacctgcacagttggaaatggaggatgaagatacaattgatgtgttccaacagcagacgggaggtgtctactgaaaagggaacctgcttctttactccagaactctgttctttaaagaccaagattacattctcaattagaaaactgcaatttgcttccaccacatcctgactactaccgtatagttttctctattctttcatttcccccttccccattcctttactgtacataaagtaactggtatatgtgcacaagcatattactttttttttttaaaactaaacagccaatggtatgttttgattgacatcaagtggagacggggcggaaaaatactgattctgtgaaaataccccctttctccattagtggcatgctcattcagctcttatctttatattccagtaagttattttgctctcactgttttaacaacaacaacaaaaaaacaacaacataaaaatccttgcataccttgttcaattggagaattttaatgtttttcatttatcattgtaaaaccaaggacaattttataacttttttgtacttagctgttacatgcagagcaatctgtctttaagtagggataaattactctaaaacaaaaaagaatcctagatagttttcccttcaagtcaagcgtcttgttgtttaaataaacttcttgtttaaaaaaaaaaaaag

SEQ ID NO: 2291 - DNA, 351 bp, Homo sapiens
atggccagtacagtggtagcagttggactgaccattgctgctgcaggatttgcaggccgttatgttttgcaagccatgaagcatatggagcctcaagtaaaacaagtttttcaaagcctaccaaaatctgccttcagtggtggctattatagaggtgggtttgaacccaaaatgacaaaacgggaagcagcattaatactaggtgtaagccctactgccaataaagggaaaataagagatgctcactgacgaattatgctttcaaatcatcctgacaaaggaggatctccttatatagcagccaaaatcaatgaagctaaagatttactagaaggtcaagctaaaaaatga

SEQ ID NO: 2292 - DNA, 4664 bp, Homo sapiens
agagcagcgccactcggagacgggatggttccgtgggttgtgtaggagcacaggaaagcggaggccgggccacacagcaccgcgaacccagcagcccaagcccagcggaccaagcagccacccccgggagccgccactgcctggagcagtcaccggcgggagcctccatttccaggagccgccaccgctgggagctgccacagccgggagccgccaccgccagaagcctccatctcccgggagccgccatcgctgggagccgccacctccaggagccgccacggccaccgggagccgtcaccgcagggaacctccatctcctggagccaccaccgctgggagctgccacctcaggagcagcggcagcactgggacccgccgggccccctcgcacccagcggctctgcaggtgccctacacccgggaggggccgagggagcccacgccgccggcgggaccgcagggatttgctggctctttctgcgctgaggggtcgcggcgcggggcggaggtcgggtggggaaagctggagccgcagggaacgcgcaggacaggctcgctgggtgtcgactctagccctctgtcagagaccttgggacccgcgcaatgtggcagtggaaggcgcagggtctgaccccggccgcggccgccgcagcagctgatctgtcaaccccggccagagccgagccgcctgaggcctgcagtgttctccatcaccactgtgatggcatccgcttccgtgactgtcactgtgcaccctccgcctgtcctgggcccacgcaggacccccaagcggggctctgcacaggccaggagggctacccagggactgaccacgggttgttcatgggtcctcacctgcttttccaggtccagggtgagaggacgaatttgaaggtagaagtcacagagttgcaggatgtggagtgcgaggagtggccccggggaagcagctccaactgagggtgattaaaatctgaagcaggccgggcgcagtggctcacatctgtaatcccagcacttttggaggccgaggcaggtggatcacctgacgtcaggagttcgagaccagcctgggcaacatggtgaaaccccgtctctgctaaaaatacaaagttagccaggcatgatggcgagcgcctgtaatcccagctactagggaggctgaggcacgagaatcgcttgaacctgggagggggaggttgcagtcacctgagattggaccattgcactccagcctgggcaacaagagcgaaactccatctcagaaaaaaaaaaaaaaaaaaaaaatctaaagtaaagaggtcaaagatcggaaacccctgcccctacacctttcaagaactgcttggtaagaactgctcgtagttacggtaaagatgccttgagccaggatagcagtacattgttgctgtagctggttgtattattttgttaaacatttccataaagatttaagaggtgtacacatgtgtaatataggaaggaaggatgtaaagtagtatgatctggggcttctccactcctgccccagattgtggaggctgcagtggggcctctccttatttttgcattggtctctgtgccacaaccaagcttcacttcgtcttgaatgtcagcatatgttgctgctgcttaaatattttataatttcaaaaaattagctgggcgtggtggtgggcgccagtagtcccagctactcgggaggctgaggcaggagaatggccgttaacctgggaggtggagcttgcagtgagccgagattgcgccaccgcactccagcctgggtgaaagagcaagactccgtctcaagaaaaataataaaataaaataaaataaaatatattgtataatttacttgtataattctatgtgaatgttgcttatgtaataggattattttgtaaagctttctgtttaaatattttaaatttgcatatcacaaccctgtggtagtatgaaatgttactggtttttttttttcttttttcttttttctttttattttttatattattattatactttaagttctagggtacatgtgcacaacgtgcagttttgttacataggtatacatgtgccatattggtttgctgcacccatcaactcgtcctttacattaggtatttctcccaatgctatccctcccccagccccccacccgaaatgttactgttaactttcaatcatgttatgcatcataacgttttttgtttaatgaacagatatgagcaaaggacgttaatcccggtatcttctctagttgtagttgtgtgtggttctcgagtggctgcgcatgtgaacacgtgtgatttctcagtgtactgtactgtgatttgtttttattgcttgttttgtttcccctcagtgtctgtaacccttagcaggctctgacctagtcaggctagaagaagcataaggatcttttattgctttgtgctgggtgagggctggccctaaacatctgcctaatcctttcaacgggcccaggaaaagccagactggcatcatgtccacagcatcgcttaatatcgttggttgtcatccagacacctcaacttgtgctgcagaggaaataagttccttctcacggatcatcatgatggatattgaaacctcagggtgcagaactaacacctgttcatcatcgtggatgttaaagaattgggtaacatgccaagcggtaagccttggatgggccatgagaatatcctctaaaaagcacgcagtattgtgcccctctcacaaccaacacacacatgacctgtcccctggcacccccaaatttaagagtggattgcaaatcttttggagaccatggccctgctacatgtagaaaaacctgttctgctattcctgggcccacaataaacccagaaattatgttttgagttactgtgatttaaactccctctcttcttaaatggaacagctcattggggctttctggatctgtttccatttttctttaaaaataaattgtgagcatgcattgtggtgatgcagaggcaggcattctgtgagatacaagctccagaaggattctcctcaatgtgtcagtgttgggatgcacacttcctaaataaatcatcattgtctccgtcttctccattaatagcgctctttcagtgtgacatggaaaagcaggatggcatacaccccactgaaggatgtaggcggaggcagatctctcaaccaggcatattgcttctgtactgctcttcttttgctctaaggtatgggttccctcaacctcttagctagagaccagcaaatgtcagggaagcacccggtgtctggctccccttccaaatcaacaccagtgtcttgttacagacaagaagtcagaggaaagggcggggtcccagcagggcagaagcctaagctactatgaggcactcacaagtggcagctcctgttactccctcttaaattatgtgggaaatcttaacggaagggcaatgggccccaggaatacctgcagcgtagtgacctcagatcctgatactcaccatgaaactctaagatactgattggaagcgacttgtggctgctggctgtgtgtgtgactctgccggggaccctggcagcccccctgtagctgtcttgatgcctctctgtcacccacatcatctgcctacttaacgcccagctctgctcagaaaacgttatgtcctgtgtcgaggagagacgacgcaaaattctgaagtccatttccctctggctcctggcataccctcgctccttttctgagcccagctcgtggtgtgccagagcctgtgtggtcccctgacttctgcacagtgtagaactttctccaatagtcacaatggcaaagggagaactggggggctggcaggtaattagaatttctctccctctctcttttaatactttcattttgaatgtcttatttgttcatgtgtatgttttaacttaaaaaattctttctgatatttttaattttgtgtcataagaatgttttcctctacagtatttgtcataccagtttataaccacagaaatgcagagattttatttctattggaaacattactacagctatgttttacttttgaacagaatttttacttgtatagggtgcttactaatgttaaatagtttggagtatataacatttacattaaggactcatggtaggttaaaaccctaaagggtaaggggtttaaaggaaataaatattcaaactgagtcttattgccaattttggtgtaaatgagtttgtgtcatttcaattacaaagataaaagtatgccatataatttatgtaaaatttgtttttgtggtgtacataatagttatcaagtctgttgacagaagtatattttaaaagaatatacatgtgatgaatccataatatctgaaactttgctgagatatgagtggggcacacttcattgtaaattacagcaaggaaagaaattaaggaaagaagttaagagagtgagagtgagtggatattcacacaattgtgaaatgtttattagttaccttttgtgatgtagtgtggttctcattttaaaccttggaaggtgaaaatgtacaaactataaatatgaatgttcaaacactgacagaaattctaatatgaattaaaaaataacgaaaaaacaacaatatattttatcttactaattatg

SEQ ID NO: 2293 - DNA, 2970 bp, Homo sapiens
gatatagtctgttaccatgggaaaaccatccttccatggctgtggtgatttggggacttttagagtgacagtgttagacagactgattttattggctgaatcttagattttactgatatatagcatatcccataccatgatatgcgggcaatattccagcttgagacaattttttttttttttttttgagacagagtcttgctctgtcgcccaggctggagtgcagtggcacaatttcggctcactgcactaattttttgtatttttagtagagacagtagagtatttttagtgttagccaggatggtctcgatctcctgacctcatgatccgcctgcctcggcctcccagagtgctgggattacaggcatgagccaccgcgcctggccgagacaatttttaaaaagacatttctcaagagagttataagccaaaatttccctagccccctccaactcattctgtccttctcccagtgcatgtcaggacagggaagaaggctttaaatcagattttaagaaagaggatacattggtttacaacctttgcctatcgtccagagagtttctgatcttttctttttttttgagacggagtcttgctctgtcgcccaggctggagtgtagtggcacgatcttggctcactgcaagctctgcctcccaggttcacgccattctcctgccccagcctcccgagcagttgggactacaggcacctgccaccacgcctggcaaattttttgtatttttagtaaagacggggtttcattgtgttagccaggatggtttcgatctcctgaccttgtgatccgcccacctcggcctcccagagtgctgggattacaggtgtgagccactacacccggccctgatcttttctttgacggtggcagtatctcattttttgataatacacatgggtaatggcaagctcttgggaccccatgccaagcatcaagatcccatttacctggtgataggaaagacagacattcctcaccctttctacccacacccttgttcacagggatgactgtaactaaggtctgcaggtatttatgcttaggagaagaaatcgtagttcaattcaccaggaatatgagaaacaaaagaaagccactatgtgctatgtaaatgtctggccatccaaagccaccttatgcagaggaacactggaagggccttgataaatttctcataattattatcgggcctctttgtgattactcacatttttctcaatataggggaaagatcagcattttaccaaatccacaaccatcaaacaaacaagagctttaatattgctaaagaaaatcacacagctgagcagattgatgtagatttgaattcatgaccacctatcttaactggaccctcagctctgcctagctagtattcattctagctactagttttgattatttgtattgactcttttatattttctccaccttcctcaaatatctcaccttcccccacccctcagtggacaaaaaaaaaaaaaaaattcttcatgaagaaaactgaagccttcaaatagaaatttcctcaccttcaaggcaccaaagccacaacttacctacccccgctcctgcctgctcctctccccatcccttctgctacaacgaaggaagcagtaatggctccatcaatggcttctcacacttggtgtcagaggccttcacacgagggtttgcactcccctacaaggacatgaagactttctagaagccaagatggaggagcaggggccaagtttatcctcctgcctgaaacaaccaaccaaacagtaaatacatgaaataatgagtttcaagacactggacatgaggtaacaaaagacagtgatctctcagaggcaagaaacaaacaaggagaacccctcggttgcccagcttaccgcttgagaggatgtatttcacggagggagaacccaggcaaagcaagtgactctgaggtgaggggatagctgggagtgtggagcagccaagctggctagagtgctcaggacagggtactggagaggagaaaggtggatatatagagaattctggggatctgcaaagggccccccttgagtgttccacagagcatgattcatcatataagtgtaaggaaaccacttgagacaaaggaaaggaccacccaaaacaatgggccggaacagtagccagaagtcacacacagcctggaccacgcctgtccccatcagccagattggaaaacctcaaatttatggagcattggtcagaggtctcagaagggccttgcctcgtagtggggattcattagccctagtttaaacattgctggaacctacctaacaaatctcaaaagcaagacctgaattcaggaatcaagctgtttctaagtaactgaagtgtatcccagaacaaaacccaagaacattaacagaaatccaaaattaacgagcacccaaaaatgtaaaattcacaatggctggttttccaataaaaaattaccagtcatgcaaactataacccatcataaggagaaaaatcagttgaaaccactacagctgacacctatgtgagaattagacaaggacactaaaagaattattataactgtattccatatgtactaagtagagactaggaagatatttttaaatacccactttgaattttagagacgaaaactaaaatgtctgagatgatggggtgggtggggtaggcagaaagaggaggatgggaagaagtaccaaggggaaggaggaatgatttggggatgacggctgtgtttattatcttaattgtggtgatggtttcacaggtatatgtaatttctaaacttatcaaattgtacacttaaaatatgtggtctatggaatgttaattatatctcaataaagctgttaaaattgtactgaaacaaaaccattgggggaaactgggtaaagagtccaaaggacctccctatactatcattgtaacttcctgtcaa

SEQ ID NO: 2294 - DNA, 802 bp, Homo sapiens
gcttcttttattagtttttattagtttttcaaaagtatcagaaataacagaatgttgggagaagataaatctgccttttgaaaccaaatatttaatattttcattaaattgtttcaatacaacttcaggcaaatgccaactggaagaccaagcccagaaattcagaggaaataatcttccaaacaaggaacaccaaggtgatcttcttccattccagccacaatactggtgatcataatggtgctagtcagttatccagattatcgagtgtttacctgataagagaaaaacttagatttcaaaacctgtaatgacagaattttaaagctggaaaatgtttaaggcaattaataaaaggaaaacctgtattaagaactgctgtcaccttgatgactagcaaatatttatcaaaagtaaaaacttggccaggcacgtatttgtaatcagcttatggcagaatacattttgaggattcatctcatcttccttcagatgtcaaaatggtacaatctagttaggagctctgagaattgctatttcctccattcctaaaacaggacaagcagcaacagaactgtctagatctaaaatactgatggaggagtatcctttttccaaaatgattaggaccagaagtgttttgaattttggagtatttcaaattaggaatgctcaatttacagataattcacttatttgtttactctgtctagtatgtaatctctgagagcaaagacttttgttcactaatgtgaacatggtagataggtggcccgccaacaccgccaaaagggcaaaccac

SEQ ID NO: 2295 - DNA, 997 bp, Homo sapiens
agaatgaagatggcttcctgtcccgctagcgtcacgtcgggatctgccttcaccaaggccttcactcgcgccagaggcaacctcgagagacgagccccaggcacactcgttggggcctggggctgcgaggccgctgcctccccagcaggtccctcctcctctcggggcgtcccgcttcctgccgccgccgccgccgccatcccggccttgagcgtgctgcgcgcggccgccgactgtgcgcgcgcatgcggcgcaggccctttcccgcgcgggctggaggccacaccctgtgtaggcgcgcggctccgcccctacgcggcagtgcgctgccaggaaaccgggtgggcgggggtcgggctccggctcttcccacgcgcctagccacccgtgggctgtcgtgcacttggttgacgctaccggcgaccctctggccccgacgggcctgtggagcccaggcacctcccattggtgcctgtgcctggctggtgaggggagaaatctagaccaggctcgcaagagagtctccgtcaaaacagagtgtgcatattccaaggctaacgagggcacgtgtccgagggaggcccggccctggagggcccagcatcgtggaagagggtgccaaggaggcagcgaaatctggaccaaattcaaggataaccagttatagatgctcttgaaggaggggtagggcttttggcaggcagaaatgaagaaattcagcccagccagaggaaacaagaaaaagtcatggaggctagaaaagatgaaattgtggtgagcaatacaagcagctgagcgtcagagatacaagcagctgagcgtcagggacacaagaagctgggcattgaggatacaagcagctgagcatcagggatacaaatggctgagcagagaagcaactgagcatctaagactacagacagatgtggctaacttcagacagtgcagcttcaggcaaagatcttcttctcgcaccatcccctttccaactccccat

SEQ ID NO: 2296 - DNA, 5174 bp, Homo sapiens
acatggggaggcccagccagtcaaacccagaacagcccggctgagctcagcctaattctgtgactttcaggatgagtaacaaaataaatgattcttattttaagtcaaaattttggagagcaatcttcctcttgtcaatgtctatctcagtgctatttcagactcctttcgtactgtcaaatctcactcaacttttagcatctatttcaattggcatctcttccaagaagatttttctaatttcctcaagtgatgtgttatctcccctataattgaaccccattttgatatttgtgtccctttttagctttttttttaacttgttttctattagaggtgttagtgtcctactcatcttgcttttcctacagctaatgaagagctataagaatggaatcgagactaggagaggaacatccaaaggagagaaaatgactgcagtgggagagaacaagagctacgatcaaaaagaggagagacaagcagcactgaggaagacagaagggtaagaagagatgatgtcagaagtgggatccaaagaaaagcttccagtgacccccaggagcactgagtgaccaagcaagaatctaagccctcaatagaatgacaccactgtgtggtcaagaatggagaaacccaagaaacttagcatcccaatattgaggtgtcttcagtatctaaaaattcttttacatccatgctttaaaagaacttaaagtcatttgataatgaaaacaatacttccagtttggtgtctaatacttttacttcccagcagcataataccactttggtcaggttgaaccactgcacaattttgcagctctttcagaaaaataatgaaaacaattggaaagacatgatgtacatgcaaatggtgagaaaatgatactattgtccaatcctttcccgtaaatgtaaaatatccttagttcatctccaaactgtgtatttattataagcccttacatcagggattttgtttctttcagtttttgtagcaccaaatagacacagcggctaacaagaaataaatctgaaaagtcactgaaatatttatcacatgtcagaaattttctggtctgtacctttaaccatgttcctggcttcacatattcttcttaagagtaagctataacataagattgagttcccaccctgtgtttgctactgatgtgatttgtttaccatgaataatactttgttaatatcttttgtatattactttacaatttccaagtattttatatacagtgactcacttagtgactcattcattttaatgtaatggtgtcccccaaaccacagataatgattagacacatgaactcttgtgtcagattgcatgggttcaaatcccagttccacctgctagctgtgtgaccttggacaagtcacataatatatctgtgcttcagtttttgtatctataaaatggaacctactgaatagagttgttgaagggatttggtgagatagtccataaaagcactcagcacagtggctagaaaatagagctgcataaatgttagttatgaataaattacttacctacctcactggggtataaccgtggtttatagataaactaagcagcatttttgagcagtggttttagaaaagcaagctcacacaaatctgtgcagggagtatttcatgacttccatggggtgaggaattttattttttctatcaggtgtgaagaggacccaatggacagtaaactctctagttattgctagagtaaatgttggagagtttctcacagtaacctccaagagggattgtgtctgtcttgtttgctgttgcatttccagaacctagcatgcactaggtacacaataagtatttgttaaatgaataaacacatggaaacatctgagtaagtatgtgattaaacttcagcttagtgtattccaggaatcaaatatgaaaggataaatgatcttttgaaaataggaagagatttagggatggtgtctccaattattatgaatttcttagagaatggttgttaataaatatcaaaggggataatatgcctgatgatctttttatataaaaatgaaaatatcttttataaaatttaaaaatggggttttatgtttgaatcattcctgccagataattcaggaagcttgtataaagaactagaaaggttgagttcaactcagcataaaaactctgtatccccaaacattgttccttatccactgttcaaatgtcctcaaatctttgaagcctttaaagtaattaatgaaatttcaaattcatacatctaaaaagtttttatatagactcaaaatatggttctaaccatgaaacttagaaatcatagtgacaatcagtataatataagctggtaaaatttgtgagattttcagaaggcaaaatccatgttttttgtctattcactgattcagccacttattcatccaacaaataccgagtgcctacattgtgccaggcagtggtcaaggcagtcacagccctttctctatagttttccagctagagagggatgagatgggttggaccaccccatattttggaagatctttttctatgttggcctccctgaatcttcagagcattgagttctaagttgtctaaagctggtcttatgaacaggctgtgtctgtatgataaaaacaaactagttaaaagatgagaaatttaggcattattcacacatccacacatatctatagatgtttaaaataatgtagacaaaatattccacctcttggggtcctacgggcacagttgagtaacatgaaatgagataagatcagtttgatgtcacagttgaaaactgcatttgtaaatctgtgtaatccatctcgagccaagttctttggagacagtctaaaatccttaaaaagcctctgcatgctagattttgcatttagatctaagtattgtcttaaaagactgtgattgttcacataactggagaattccctattgactacatgattgaggaaacacaaaagtctgttattctttccaaagtcaattgtaacttaagctcattatctccctgcagatgttctatttcaaatgacaacagaatcaaaatgtaaatgctccagtgaaaaggcttggaaactcttttactgaactgtgctctatgtatttgccttcaaaatcatagcaggaaaaagtttagaaaaatctatcccaccggccactgacctaaaaaagggaaaaaattaaatttcaccaggatttctggtgatatcgtagaagttttttaaattataacgtttaatacctaatttgtttattacattgaattgagcttcatgtcagagcaatgcaggtttttattttaatataatttgggacatgtcagtggctctaatatgatcgttaataatgaagataattagtataatacaagttgtggtaatttccttcttctggcttcagtgaaacttaagagaaccacaggtggcttaagtcttagtgatggctacctctgattaaaactttaggaaaagacttacatttcaaccaacaagattttactgaaggaaaatggtcatttgtatatgagaccactctgacgtataatccatccttagatgtcctaggtgtgatggattgcttctttactttgacaaacaatctggtatgcctttatcagcacttaacattaaccaaatgaagcataaatacaaaggtttctagaaaacacaaatgtaaactatcttaccatttgatagttgtttctgtaacactgtgacaatatttgtattgatgtgaaaccatatgataactttaattttgaccaaacatttatgactaagtgaaaacatactcactcaccttaagctccaaatttatacaatgtattgaaatgtgttgaaatgaccattttctcatgacaagggttcagtgatttcccttcatgagaatcctgtggcattgcctgaatagctttaatatatctttgttaaatgataactaaaatatatgttttattaaatttttcttataaaaatgtgaactatctctttcaaactgaataatacatcgtctccattcattcccttttatcatgcttgtcctttttgtaaatctattttacataacatacagggtcctaactgcccccacctcaccacccccgttctctctagtaaaaaatgatatgtattcaaggatgggaatctgttatcacaggggtgtattgttgaaattagcaaatgtcctagttttcttgctgtttttcctctggtgagggatgcattgtgaagagcagggaaaacctggtattgacaatactatcacccaacagggcataataaaatgtgctgggtagttttgattggttttgttttattttcaagaagacagtctaaactgagcttcatacatttctattttgggggattatctgaagtgtcaaattgtattgtatcttggggaatcaatttctgtatttgagaaaagggaacattcaaatatttgcctgtggtttactgatctattttgaatacttcaactaagcaattattcttttcttaggttcatttatgtgcttaaggtattcaaatgcccaaacaattattgcttcctatttatttcataaagtaaaatcagacttaggtgcctagatttaccataaaccaaaaattatgacctgtaaatgtagttataacagattattttccagtgaatgatattttctgaaaaatgatatctcattgtctatttacctatgggaatatattaaagttggtgattttattttatttttctagaggaagcagcatctgccattcacaatattgatatcactggtttccacctgcccaattataagagaaataatacttgtttatctgagagtgccaaaaatatctggtttatatttggggaaattgacctaaactttgtgtgacacaaatatttgaatatatatgcacatataatttagttttgctaagctttaaaatatgaaataggcttctatgacagcacatcagtgtgagtagagtttagatttcttcagtgtttatcaatcaaaaagtataaaactcaaaaaatattgagagtgggtttatgtatataacatacgagaatctgttcacagggctaggtcctttgctagtattctcttactagattcttaatacttggtaagaaaagaacctaagttgtaa

SEQ ID NO: 2297 - DNA, 1676 bp, Homo sapiens
cttcaatctcctttattatttttcttttgaagaatcaaacttgtccatctctcccctcccaagtgactttcctcactcatgtaatcattttcttcataaatgcccttttactatcccacagaaaaagtaaagatttaaaaaatcatttttaaggtacatccaagatttcatagcaatattttatttgtgttcacagtgcaagataaatctgactttctcaatatttttggtcttcatatggcatctgaaacagttgttcacattcacacatttatgtttcaccatatgcatactgtgtacagctctgttgttctaaaatattttattggttttcctttatatctcaacttttgatgggtgtccttgaagaactttcatgaaaaaaatgtaaatgtgaatgattcattcattttgaacatatgtaactattttaggagattttcaggagattttaccctacatggagtacactgttcttagcagggaatgtgctttatattactattctactcacagctggatgctgcagatgtattaacattgtaaacatgtactttttctattctatgcttactttaatacattatttatatgtgctagactgtgctgagttttggtggttgtcaaaggcagtcagtaattttataaatttcacttttgtggatagttaagtataacatggtttagtataaaatctggtcttcctctagatttctaagtcactagaagaatttcttggcaaattgattgttcaaggccagttttgttagttgtaaggtggaagccaccccaatcctctcccagtgtttcataggcattttcagacctggatgctattatagttcctcctctagttttccagtagagaattcgtatgtggtccagaggttcaagagagagagagaaaaaatttctcctcaaaagaattgaacccttactttagaaacttctgacaatcttcagaacattccatgtgggtgtccttgtgtttctcatagtatgacttattgattcatggtgtctcttattaaagaagcatgaatgtatcactagctgttaccagaacaaacagctgtagaatgtaatgacccatcctatttctaaatttacttctatcagtggataatttgtgtataggaaaaggtgtggaaattttttaattgttaaaaactggaatacctttctaccttttgtagtctttaagatttcataatgatggttttaatgtattactatcttactattatgtattgtgtttaaacaagaccaatcagtgaaatattgaatgtcaatactttttgttagaaatgccctctgaaaatgttagaaaatgtaaaactttacctgtgacaaggaataaattcatgattagaagaattatactgtttttcttgtgcaaataatacttaaggcagatgttcagtctcacagtgatgttggaaagcatattttatgcagtctaaacactatttctgtattagatatttaaatgcatgaggataaattctaattgctttttgtttaaaacagaaacatagaagaagcattagccccagtttgtataaaatgtctgctgcaactgaattcatgatagttcatgaaaactgaaaatcattccaattttgtaaaactgctgctactggttttatcaataaagttttagcagatggcttata

SEQ ID NO: 2298 - DNA, 726 bp, Homo sapiens
ggaacgggctggacagttgatccttccttagcaggaaactactcccacccaggagcctctgtagacctgaccattttctccctgcatctagcaggtatctcctccattctaggggctattaacttcattgtgacaattattaacataaaccccctgccatatctcaataccaaacacccctctttgtctgatccgtcctaatcacagcagtcctactcctcctctcccttccagtcctggccgctggcattactatattattaacagaccacaaccttgataccaccttctttgatccagtcggagggggagaccctatcctgtaccaacacctattttgattcttcggtcaccccaaagtctatattctcatcctaccgggcttcgggataatttcccatatcgtaacatactattctggaaaaaaagaaccattcgggtatatgggcatagtctgagctatgaaatcaattggtttcctaggatttattgtatgagctcatcatatattcacagtagggatagacgtggatacacgagcctacttcacctccgctactataattatcgccatttccactggcgtcaaagtatttagttgacttgctacgcttcacagaagtaacatcaaatgatctgccgcggtactctgagccgtagggttcatcttcctcttcactgtgggtagtctaaccggcattgtactagcaaactcatcattagata

SEQ ID NO: 2299 - DNA, 425 bp, Homo sapiens
gtctcagtcgccgctgccagctctcgcactctgttcttccgccgctccgccgtcgcgtttctctgccgggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaacc

SEQ ID NO: 2300 - DNA, 2617 bp, Homo sapiens
aggattttcataatcatgaagaagtgaaagatctgacggatgaaaattgcattttgaagacagatattgctatacccagacaggaaatatgcacaatgaaaaatgacaacctggaaaaagaaaataaatatcttaaggacattaaaattgctaaaggaacaaatgctgcccttgaaaattgtataaaactcaatgaggaaatgataacaaaaacagcattccggtatcaacaagagcttaatgatctcaaagctgagaatacaaggctcaattctgaactgttgaaggaaaaagaaagcaagaaaaaactggaagctgaaattgaatcttatcagtctagactggctgctgctataagtaaacacagtgaaaatgtgaaaacagaaagaaacttaaaacttgctttagagagaacacaagatgtttttgaacaagtaaaaatgagttctgatatttccgaagtagaagataagaattagtttcttactgaacaactttctaaaacgcatattatattcaatactttaaaagataagttctggccgccgccgctgcagcctgctgggctggaggaagcggagctggtgctgtcccggctctcttgcggggaagcaactgagggggcagcgcggcgggccctggcagccgaagaggctggcaggtggcgccgtggggtgggtgctcctggtgagaggagtccactccatacgtgcgggcggaggctggcccccgagagccgccgacatgaagaaagacgtgtggatcctgctggtgggagaacctagagttgggaagacatcaatgattatgtctctggtcagtgaagaatttccagaagaggttcctccccgggcagaagaaatcaccgttccagctgatgtcaccccagagagagttccaacacacattgtagattactcagaagcagaacagagtaatgaacaacttcatcaagaaatatctcaggctaatatcatctgtatattgtatgctgttaacaacaagcattctattgataaggtaacaagtcgatggattcctctcataaatgaaagaacagacaaagacagcaggctggagtgcagtggcgggatctcggctcactacaaccttcacctcccagctgcctgccttggcctcccaaagtgctaagattacagcctctgcccacccgccaccccgtctacaaagtgagcagcgtctctgcctggccacccatcatctgggatgtgaggagcccctctgcccagccgccccgaatgggaagtgaggaacacctctgcctggccgccccatctgggaagtaaggagcacctctgcccagccgccaccccgtctaggaagtgaggagcgtctctgcctgaccgcccatcctctgggatgtgaggagcgcctctgtctggctgccctgtctgggatgtgaggagagactctgcccggcctcccatcgtctgggaagtgaggagcgcctctgcccggctgccccatctgggaggtgaggagcaccactgcccggccgccccacgtctgggaggaagtgaggagcgcctctgcccggctgccccaaatggaaagtgaggagcacctctgcccgaccgccccgtctgggatgtggggagtgcctctgcccagctgccccatgtgggaagtgaggagcgcctctgcctggccaccaccccacctaggaagtgaggagcacctctgcccggctgccctgtctgggaagtgaggagcgcatctgcccggctgccctgtctgggaagtgaggagcacctctgcccggccgccaccctgtttaggaagtgaggagcgcctctgcccagccgccccgtctgggatgtggggagcacctctgccaggctgtcccatctgggaagtgaggagcgcctctgcccggccaccccgtctgggaggtgaggagtgcctctgcctggctgcccggtctgggaaatgaggagcacttctgcccggccaccccgtctgggaggaagtgaggagtgcctctgcccagccaccccatctgggaagtgaggagcacctctgcccggccacccatcatctgggaagtgaggagcgtctctgcccagccaccctgtctgggaggtgaggagtgcctctgcccggccgccccatctgggaggtgaggaccacctctgcctggctgccccatctgggaggtgaggagcgcctctgcccggccgccccgtctgggaggtgaggagcgcctctgcccggccgccccgtctgggaagtggggagcacctctgcccggccaccccatctgggaggaagtgaggagtgcctctgcccagccgcgccatctgggaggtgaggagcatctctgcctggccaccccatctgggaattgaggagcacctctgcccggccacccatcgtctgggaagtgaggagcacctctgcccagacgccccatcttggatgtgaggagcacctctgcccagccaccaccccgtctgggaggtgaggagcacctctgcctggccgccccgtcttggaagagaggagcatctctgcctggccaccccatctgggaggtgaggagcccctctgcctggccgcccatcatctgggaagtgaggagtgcctctgcccagcc

SEQ ID NO: 2301 - DNA, 4645 bp, Homo sapiens
actcgtccacccgcctgagccaacttgcccgcgactcagagtgtgtctggactccgcttcctccaatgccaaaggaaaatgtctataatctcactcttcagcgggaagcgttggactccgcggtggtccttgactacacacaccgcagtgcccaccgggaacgtattccatatctctgagcgcctggtggggaatgtggactgtgaccctgactggatgaaatgtatcatcagcatggattctgtgataaattacaagatacaaactcaaaaggaactgctttctatgtgcctcatattttaatgtttctcccctttgtgaatgcttaggtgagactgtagtcatgaaaactgagtaaagactttattacacacattactgaggcttctctccaatgtggacattctgaagttgaagacttgaggcctgaatgaagcacataccaccctcctcatacttccgtagtttctctcccgtgtggagcttctgaagcataataaaattcaagtgatccagcaattctattactgggtatatccaaaggaaaggaaattagtatgtcacggagatatctgcactcccaggttcattgtagcactactcacaatagtcaagataaggaatccacctaagtgtctatcaatacatgaatgaagaaaaggtggcatatatacacaatggaatcctctttagacataacaaggaaacaaaattttatcatttgtggcaacatggatgagttttcaaggacattgttaatataagccaagcaaagaaagagaaatactgactgtcctcactcatatggaagttaaaaaaagttgattttgtagtagagagtagaacagtggatgtagacaggcaaggaagtgtaggaggtaggtgagatggccaaaggttggccaacagatacaaaagaggtagaggggaagaataagttctactgttctgcagcactaaaggtgactatcatcaacaattatttacaaattgctaaaaatgtgttgtagtctcacaaatgcaccacactgtaacagtctctctgtaacagtctctcttatcccccggagttcttaatctcacgtccaatatgattaagaagcacagacacaagggtgaaattggagtaaaagtttaataagtgaaagaaaaaagctctccacagtggagatggggatccaaataagttgcccagtatgaggctggggtccggggtttttatggactgggaaggggaaggaatgcacttagcctgcgggctgtcttggagaaagcgtgattcagcttggtctgggaccttggcccgggaccaatcaggaaccgaagtgatgattcataagggctattcagcttggcccgggaccaatcaggagttgaagtgattattcctaagggctattcagcttggcctgggaccaatcaggagctgaagtgatgatttacagaggctgggcttttccttttccacaaaagaaagtgccaacctgaacctactgaagcccactgtgttcatgcccacaaaagaagaaactttttcctcggagcctgctgattatacaaaggacaaaggcatttctgtgtctggtcttgttcccttaactgagtgagccggaggtttgtgcgagtttttacctgaatgggctggaggttcttctatctgtgcagccatgggcatgtctccaggcacaatcccctgtgctagttcccttatcagtgcctgtagcttgattgtcttccccaggctgctttttgtgttatgtggggatgagacactgacccgtttggctgggggtctccagggacccttcccttgctgtctaccaactcctctcaaatggattttgaattttccaacacaaagaaatggtaaatgtttgaggtaacagatacaccaattacactgattggatcactataaattgtatgcacacattaaaatagcacgttgtaccccataaatatgaacaattatgtgtcatttagaaataatgataaaagtatatccagattcaagcgcctcttgtagcgtctcccacaatcctcacatttggatgggttttccccactatagtctctcggctggtctttacggtatgtcctgtgtacaagcctctttccacagtcctcacatttgaatggttttttctggcagtggagtctcttatgattcaaaatacttgaggcccggctaaagttcttcccacattccttacaattataaggtctctctcccgtgtggaccctctggtgcaagtcaagattaaacttagtaacatagcccttcccacactcctcacatttatatggcttttcaccactgtgggatctctgatgggaagacagttgtgaatttgtataaaatccctttccacattcttcacatttgaagcttttttctccactgtggactcgctgatggttcaaaaggcatgaggaccatctgaagctcttcccacattctttacaattatatggtttttctcctgtgtggaccacctgatgcttataaaaatctagcctaccaataaagccttttccacactgctcacatctgtacggtttctctcctgtgtggaccatgcaatgcctattaagtgctgatctctgatgaaagctcttatcacatgtatcacacctaaatggtttttctcctgtgtgaaccatggaatggctcttaagtcttgacctaaaatagaaggtcttaccacatatatcacatttgaatggtttctccccagtatggattctcttatgttccttaagctgggaatcatgaatgaaggccttcccacatgcctcacaaatgtaaggtttctctcctgtgtgtaatttacgatgaacattaagtgctgatctacgactgaaacctttcccacattgctcacatttgaatggtttctctccagtgtggactctctgatgagtttgcagatgtgagctttgactaaattccttgccacacacatcacacataaagagtttctctcccacgtggactctctgatgaacatgaagagctgagatgtaacagatgctttttccacactcatcacatgtataagacttctcttctgagtataactgctgaggaagatcaaagatgggaacatcactgatggactgtttacacttcccaccctgggaaggtttctgtcctgtatgaattgtgggtagtcctgcttcaacctgggaggggacatcaccattttcaaagaactgagagttatttatgatagagtcctgagacctggttaagtcttttgcaatttgttcccagatttgctggcaggaccactcttcatgtgctcctgcttctggaacagactccaactcagtttggatcttgcctcctataaagacacagatttaagagatgtgtacaggtgaagcctttattcagtgatctcaaggtttcacacttaggacatgacattaaactttaatgaatacagagaatgttcagtttgttttccaagtacaccctgatttctggtttgcatgaggccaattcagaaccacatcatgtctcacatgtgaaatccttgatagaaataatagacttaatttaaaaatatgatatacatttaacttgttactatttgtaatgaatttcctagtcagtccaaaatcttgcatgataaattatgaaaataaaaatttatgtacataatgaaatatgaatcaaaaggaactttaaggaaaagcaataacttaatcaacactttgtatatttgtgtttatgctgtatatccttataaagaagttaaactaggccaggtgcggtggctcaagcctttaatcccagcactttgggattgatcactggagtccagcagttcgagaccagcctgggcaatatagcaaaaccctgtccctactaaaaatacataaattagccaggtgtggtcgtgcactctgtagtcccagctacttgggaagctgaggtggaagaattgcttgagcctgggaggtggaagttgcagtgagccctgggtgacagagcgagaccctgtctcaaaaaaaaaaaaaaaaaaaagtgctggatgcagtggctcacacctgtaatcccagcattttgggaggctgaagtgggcagatcacttgaggtcaggagttcaagaccagcctggccttgaaaccccgtctctgctaaaaatacaaaaattagccacgtgtggtggcacatgcctgtagtcccagctactcaggaggctgaggcaggagaattgcttaaacctggaaggcagaggttgcagtgagctgagattgagatcgtgccactgcactccaacctgggagatagagcgagactctgcctcaaaaaaaaaaaaaaagttaacctaaccaaaaagaggttgggactttgtcctcagcatctgagaggtaatctctaggatcctgaagtgtcatacctcaggagagtgtcttggttggcttgaaggcaatcactggatcactctgcatagtgaaacaatataatttatggttgcaactggcaaatcctttgggggattgggagtgggagatgctcctctccatgtcagaaataagcaatgtgatttaaggtggagctttaggtcacagagagttagtggactaggagactgattaaccacctaggaatcatcaatcaatactggctcca

SEQ ID NO: 2302 - DNA, 2959 bp, Homo sapiens
ctgagatgagacttcatggaaggggctacaaagtacagtctaaaggcctagataaagtttgaaacttgatttagaaagtcatgaaaagccactcagagttttaagcaaagagtgatggggcagcaatggctgtgcatttttcaggttgaaagtagtgagatgtcagttcttcctggaagatatcatgagaatgcacacaaaactgaacattttctcagcagcaaggagtgctaaagggtgcacactccaagtcaacaactcaccgtgtgcagcaccttcctcacacattttgctttgctttctgtcacaggaccatcagacgtagaacgtcctgactctcctgaattactagaatgtcagcaacaaactcacaaagtagattagagggtaggaatagatacataaatttttaaaaacctgccaatcatactgttttctagacagtaatataataagaacatgaggcaggacatccacaaatagtagagaataattaatagtccagaactgccaaataggaattccccttatgaaaacacccttgcagctaatcaggtagcccttgtttagaaaccaattagcactcataaaatatttgtacaaggagtgagtgggggagaaatgagcacaatatgggttctgccatcaatcagcttataatacaactaaagaaagaaaacatgctcaaagcaccattagagaaagggtgagccctaatgacatagtttcacattcaatatggtaggagttgaaacaagggagaaatgctgtggtttgaagtggttcaacaaggtaggatttctagagaaaggggggtttaggagttagataagtagaggatcagcattctaggtatgaaggcaggattatctggcatgtggcagggtgaatgatgttaatcagtaactgctaattgatatttactgagcagctgctgtgtcctcacgatggtaagactattagaggaagacagcccacctgcctaactgggaacacaaggcacacatatattggaaagatcatgttgcacaaaacaggtgttcaataaataatttttgaataaatgtgaacactgaatagcaaataaatgttatagatcgtaatagttgtagaagattggttgggattgtagggactggatgtggggcaatggctgtgggtctagagtatattcattgtgcagtggacacacacctaatctgtcctcaaggacagaaccatgtggaggaataggaaaacaagagaagcaggcaagaagcggaggcagtgagtacagcagctaagaaatgttacattgggttcatccagagcaagaaaagctgagagctgtccgtgagggaaggccacacaggcaagaggagtgggacaggggagtaaaggagtgggctacaacaggccctgcagatgtggaagccagacccacagaggcacttagaaagtgaggatcctggatgaattattttagggagaaagtgtaggtttagatcagctggcagatgtgtttgtgggctacagccaagtttttcaggactaagaaggagcaaaataagtagaacttcttgggacaggagatctagggtactccagaaccagggaaatgagaaacaagaggggaattttaagaaagagagggaagatcatctatgaggttggagatgaaaggtgttggagatggtgaggcacaagtcaaaagactcactcgaagggcaggaactctgcttatttgtccatattcccagagtttgtcatgaggtctggcccacgtgggcagtcactcggccactatgtatcactgtggctgccatggtggatggaggctggacagaacctgtggtgatcggcagtctttctggaggactcaccagggaggggtctcagggtgggcatctcctttcaccttcctgtgcatgtcactgcactgttcttcttccctccctgaacagcacacacactgcatccttagtttcaggggtctgaaaacaaatgctacgaccaccttgctttggtggcttttctgaacaggcattgtgagaagagatgttctggccaggtgaaagtggactttatttttaggtaggtttttcagtttagaaaggtttcctttgcttatcccttgaggacttctgtgctgctgcttctcctccatcttgctagttaacagaacaggggcagaagtgacaccaatgctctcggccatgcctgccttgggaagcactaccgggccccactgtttagaatcttagatggaaatgtacacaaggcattgacacacgcctgcgggagtgacccagtgcttccctcccatgggactcagggtcagcgtgggaaggcagctggcagggacaggagccccgcccgcaaggtggactgagcctcacttccacacaaaaccagagtcccatctgccccagagcgctcgctctcctccccttccttccgctcaatgcagcctgacacgcctttgaccagaactgcaacatttcaaacacaaacccagatctgttgggaaatcctaattaaaaacgttgcattcccaggtggcacaatcacatcctgcctaaaacttctggcccacatcccaccacccagatgttgaaaagaaacctttctctgcttaacaccaaaacctgcacttcaaggtttctttaggggacaaagaaaaaaaaagtacacacatgcagagttcagcctacatgttcattgaggaaaaagagcgtggcttattcatctttcaatcttttgattgttggcattatgattatgattatgattaattactctgacctgacaggaattgaagaagagactatatgctggtgctctgaaatgatctacccaactctgtcatctgtaacaaccagtgataactctcttgtcttgtaaaaagggtttgtacataacttgtacatggtttcattttgtatttttcgcagattaaaaatttatgtatttgtgttct

SEQ ID NO: 2303 - DNA, 837 bp, Homo sapiens
caggcgcggagaggcgcacagcgcggcacagcgaggcgccggcccagactccactccccagctgtgaaaggaggagctctacggtgactttgaagacttggaaacaggggacgtgcacaagggaaaatcgggccccgatactcagaatgaagatgtagagaaacaaggaagaaattgaccctgacgaagaagaaagtgccaagaaaaagcatttggataagaagagaaaattgaaggagatgtttgatgtggaatatgatgaaggagaaagcacatattttgatgatcttaaaggagaaatgcagaaacaagcacagctgaatcatgcagaatttgaagatcaagatgatgaagccagagttcagtatgagggttttcgacctgggatatgcgtctgaagaaacatcgctggtataagaaaatcctcaagtcccgagatccaatcatattttctgtagggtggaggaggtttcagaccatcccgctctgttatatcgaagaccacaatggaagacaaaggcttctaaagtataccccacagcatgtgcatcgcggagcagccttttgggataaaatatgattacaataacttgcctattgctgagattaaaccttacaggctgcgttattttagctttgtgcttttcctttcataaaattccactcctaagatttttctcttttctgggagcagggaggtggtttggagtatatacgtaaatctatatccaaatctaaatgtccatatccagtatgttaaactagaatctaaaatttgtggtttgctatatttctttttttccttttcctttaagaccctatcactccacagggaac

SEQ ID NO: 2304 - DNA, 1280 bp, Homo sapiens
gaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactgtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctgagaa

SEQ ID NO: 2305 - DNA, 8265 bp, Homo sapiens
aagagatgtggtgtcgctgtcacccaggctggagtgcagtggcgaacatggctcactgcagccttgacctcttaggctcgagcaatcctcctgcctcagtcccccaagtaacttggactataggcacccaccaccacacccagctaatgtttatatttttcgtagagacagagttttgctgtgttgccaggctgatcaactcctgagcttatgcaatccactcacctcggcctcccaaagtgccaggattacaggcgtgagccaccttgcccggccaagatgaggtattattacatcattattgtaagcaggcaagaagaatctgttggatgattacaacattgctggattgatagcagcctcacctgccaggctcaaactccagatccaaagtccacaaatatatcataaatctgaagaggaactgggagaagcttctgctggcagctcatgccattgttgccattgaaaaccctgctgatgtgtcatatcctgcaggaatactagctagtgggctgtgctgaagtttgctgctgctgctggagccacatgtattgctggtcacttcacttctggaacctttgctaaccagatccaatcatcttctgccacccacatcttctggtggttactgattctagggctaactatcagcctctctcaggggcttcttatggtaacctacctacctaccactgctgtatgtaacagattctcctctgagctatgtggatattgtcatcccatgcaacaacaaggaagctcaatcactgagtctaatgtagtggatgctggcccaggaagctctgtgcatgtgttgcaccatctcccatgatcatgcctgatctctacttctatagagatcctgaagagattgaaaaggaagagtaggctgcagctgaaaaaggaggaatttcaaagtgaatggactgctgtagtgcaagtttactgctactcaatctgaggttgcagactggtttaaagacatgcaggtgccctctgtgcctattcagcagttccctactgaagattggagcacttagcctaccatgaatgactggtctgcaacttccactgctcagaccactgaatgggtaagaataaccactgagtggccttaagctgttcttccacaagctcttaaacaagatggaaataacgctgatggaaataaacaacagtttccaagaaaacacgaacagctgaagtggcaatgtttaagtaacatctggtagactttaacatgaatgttattaagcaggaaattatgatcttttaagttggaacatgtaatgttaatccttttgcaccaaaatatctctttaagtctaaattatccacttttttttttaattcttcgtagagatagaggtttcgctttgttgcccaggctgttcttgacttcctaacttcaagcaatccttctgcctcagcctcccagagtgctgggattataggcatttgccaccgtgcctggtgtacccagtttctgttatcaacagaatgcagtggtgtatggttgctaaagggtcccaagatcaggacctacgttaaggtggattttgaattatttaaaattctgattttgttttatttttaattaatctttgggggaaggatgggaggggggtgagggttgaagaagtaaacattgtacctattggatacaatgtttaatatttgtgtgatgggcacactggaagcccaaacctcactattacacaatacattcatgtaacaagcctgcacatgcacctcctgaatctatttttaaaaatttaattctctagcacagactccctttttttggtaagatggcggggtacgacttaactactcgcatcacgcaccttttggatcggcatctagtctttccgctccttgagtttctctctgtaaaggagatatataaagaaaaggaattattacaaggtaaattggaccttcttagtgatgccaacatggtagactttgctatggatgcatacaaaaacctttattctgatgatattcctcatgctttgaaagagaatagaaccacagttgttgcacaactgaaacagcttcaggcagaaacagaactaattgtgaaaatgtttgaagatccagaaacgacaaggcaaatgcggtcaaccagggatggtaggatgctctttgactacctggcggacaagcatggttttaggcaggagtatttagatacattctacacatatgcaaaattccagtatgaatgtgggaattactcaggagcagcagaatatctttattttttcagagtgttggttccagcaacagacagaaatgctgtaagttcactctggggaaagctggcctctgaaatcttaaagcagaattgggatgcagacatggaagaccttacatggttaaaagagaccatagataataattctgtgagttctccactccagtctcttcagcagagagcatggctcgttcactggtctctgttttcttcaatcaccccaaaggttgtgataatattgttgatctcttcctttaccagccacagcatcttaatgtgtccacacattcttcactatttgactacagcagtcatagcaaacaaggatgttcgaaaacgttggcaggtgctaaaagatctaggtaaagttactcaacaggagtcttacacatataaagacccaattacagaatttgttgaatgcttatagattaactttgacttagatggggctaagaaaaagctgagagaatgtgaatcagtgcttgtgaacgacttcttggtggcttgtcttaaggatttcattgacaatgcccatctcttcatatttgagactttctgtcacatccaccagtgtatcagcattaacatgttggcagacaaattgaacatgactccagatgaaactgaaaggtggattgtaaatgtgattagaaatgcaagactggatgccaagattgattctaaattaggtcatgtggttatggtaacaatgtactctcaccctatcagcaagtgattgaaaagaccaaaagcctttcttttagaagctagattttggccatgaatattgagaagaaacttaatgacaatagcaggtcagaggctcctaactgggcaactcaagattctggcttctactgaagaaacataaggaaaagattttaaaaaaactctaaaagaaagatgaaataataaaactattatataaagggtgacttacattttggaaacaacatattgagtgtaaattgtgaagaattggaataaaattgactgattcaaaaaaatttaattcacaaaaaaattttaatccttttaagctaattatagattcacatgtagttgtaagaagttacaaagaggctaggtgcagtagctgacgcccatgatccccgcactttgggaggccgaggcaggcagatctcttgaggccaggagtttgagactagcctggccaacatggcaaaaccccatctctacaaaaaattagcaaagcatggtggcacatgcctgtaattacagctacttgggaggctgaggcatgagaatcacttgacctgggattacaagtgtaatcccagccataggctgggtgcagtggctcacacctgtaatcccagcactttgggaggccaaggtacgggtggatcacctgaggtcaagagttcaagaccagcctggccaacatggtgaaaccccgtctctacaaaaacacaaaaattagccgggcatgatggtgcgcacctgtaatcccagctactcaggaggctgaggcaggagaatcgcatgaacccaggaggcagatgttgcagtgagccaagatcacgccattgcactccagcctgggcaacagagtgagactccacctcaaaaaaaaaaaaacaaaaaaaaaccaccagccatttgggaagccaaggcaggattgcttgagaccaaccagaagttcaaggttgcctgggcaacagagcaagactgtctcgagacaaaacaaaaagtcagcatcttctgcccacttttactttaacatacatttatggatctattgtctctttccctgttctaaaactttaaatttcacaagaatgaagattttgctgtcttgtttcctgctgtgtccccagcataaacagcataaagaagtgccataagatagaaatttttgttttctgttcaccagtatatccacagcacctagaacagcatctgctttagacttattagatgaagacttaaaaaaaaaaggaacagcacttctgcacatatttagcacttgatacatatttgtggaataatttctatcataactagcagctacttcctaatttgatatgtagcatcccgtattaacaggacttttgtgaatggagaggacatctatttattctttgttatgtgccaaatatatttgtattaatcataactcttaatattcctttaaaattaaataattgtttccacagctcttaaaatagaatttaggaacctagcaacatgccactcatccattaacagtgataaattatttaattttataaacttttcattaaagtaactgatatagtttggatatgtgtacctgcccaaatctcatgttgaattgtaatccccagtgttggaggtggggcctcacgggagttgactggatcatgggggcagctttctcatgaatggtttagcaccatccacttggtgctgttctcatgatagtgagttctcatggtgtctggtcatttaaaagcatgtggcatggctcacacctgtaaccccaacactttgggaagccaaggtgggcagattgcttgagtccaggagttagagaccagcctggtcaacatagcaaaaccctgtctctctgaaaaatataaaaagtcaccaggtgtggtggcacacacctgtggtcccagctacttgggaggctgaggtgggaggatcacttgaaccgggagttggatgttgccatgagccaacatcccagacactgcactccagtctggcgacagagcaagaccctgtctcaaaacaaccacaataacaaaaagctgttgacacctcccctgcaacttcttgctcctgctctggccatgtgatgtgcctactcctccttcatcttacaccatgattgtaagtttcctgaggcctccccaggagccaagcagatgccagcatcatgcttcctgtacatcctgcagactcgagagccaattagacctcttgtcattataaattacccaatctcaggtattttttttacagcaatgcaagaatgcactaataacgaatctaggtcgggcacagtggctcacgcctgtaatcccagcactttggcaggccccaggcaggaggattacttgaactcaggagtttgagaccagcctgggcaacataacaagaccctctccatgttggggtctctttaaaaacacacacagctgggcgcggtggctcacgcctgtaatcctagcactttgggaggccaaggcgggcggattacctgaggtcaggagttcgacacccgcctggctaacatggtgaaaccccatctttactaatgatacaaaaattagctgggcctggtggcacacacctgtagtcccagctactcgggaggttgaggcaggagaatcacttgaacctgagaggcagaggttacagtgagctgagatcatgccactgcactccagcctgggcaacagagtgatactccatctcaaaaagaaaaaaaaggcggggcacggtggctcacgcctgttatcccagcactctgggaggccgaggtgggtggatcacctgaggtcaggagttcaagaccagcctgcccaacatggtgaaaccccatctctactaaaaatacaaaaattagccagccatggtggcaggcacctgtaatcccagctactcgggaggctgaggcaggagaatcgcttgagcctgggaggcggaggttgcagtgagccgagatcgtgccactgcactccagcctgggtgatagagtgagactgcatttcaaaaaactaaaaagaaaacacacacacacacggccaggtgcggtggctcatgtctataatcctagcactttgggaggccgaggtgggcaaatcatttgaggccaagagttcgagaccagcctgggcaacatggcaataccctgtctcctctaaaaatataaaaattagccaggtgtaatggcacatatctagtcccagctactcaggaggctgaggcaggagaatcacttgaacccaggaggcagaggttgcagtgagccaagatcatgccactgcactgtagcctgggtgacagagtgagactccatcaaaaaaaaattaaacacacacatacacaaatctaatgtatcagatatccttaaatgcttctaacactgaaaatgagatgaatatcacaactagaatggttatcacattatacataagtgggttgcaaaaactgattttattatacacgtatactttttaatttacatttggattcaaactttttttattatacactcctggcatatgtaacattcagatagttctctttctagcactatgataatctcatcagatcccaagagttggggaggaggacttgatttcagactatccagtttgcaaatccacatcacatatgcctttacgaattattttgaataggtagtatgcattacacaaacactatacagtgaagtctttttcaacctctctcagttaattatatcttctcaaaactattctacgcaaacacaaagacatatgtactatatgtttttgtttttgttttgagacagagtctcactctgtcacctaggcagagtgcggcagtgcgatctcagctcactgcaacctctgcctcctgagttcaagcaattctcctgcctcagcctcccaagtagctgagattacaggcacgtgccaccatgcctggctaaattttgtacttttagtagagatgaggttttgccacgttggccagactggtctcaaacccctgacctcaggtgataggcccacctcggcctcccaaagtgctaggattacagtcatgagccatcattaccagcctactatatatatattttttaacactgtatacaatacacacagtttgcaccttttttttcttcatttaataatgtatcttgaggattgttgcatttggcacttcatctaaatacaaattattttttctcccactaaaatatagatttcatgatgatgagcacttatcttttcactgctttttatttttaaatgtgtttttctgttgtttcatgaatatttagtttgtatgctatcttttgcctttgtcagtaatgctgttgcaatcaatatccttgtacacgtcaattcttacaagtaggagtataaatacaggatgaaattccaaacgtagatttgctgtgtcaaggggtgtgtacctttccaattgataaggtattgccaaatgtcttcccattgaggttgaaccaatttatatactcactagccttgttgctaacattataacacaagaagcattaaaattgatttttgaacaaaatcaatgtatatgcttttaagtgttctttctttttaaaaaatcattattggaaaatgcaagcaggaatacatggcaagcagagcccatgcaatggccagaattcctacagcagaaatgacttcaacatttgtttataaagattttctccaaatgatttgttgaaataacttgagtcttcaaggtttaattttccaaatgttggctcaaacctgcactgaaattctggcctacggtgtcctagcaaaaatctccctttgcaagatgctgaggtatattggcaaaaccgcagatcacatgactccgggagtttgagaccagcctcgccaacatggtgaaatcctgtctctactaaaaatactaaaattagccgggcatggtggggcatgcccgtattcccagctactcaggaggctgagacagaagaatccttgaacctgggaggcagaggttgcagtgaaggtgacaaaacgagactctgtctaaaaaaaaaagtagaggtcaaggcaatcattcctagggaccaggtagaacccaactggagaggaagatgacacaattcaacatgctatggaggagggagagtaggttttatccaggatcacatgggacaaatgcaaggacaggctcaagtttcccacatgcagcatttctcaatcccattttccttggcaagagttcttcccattactaggctattccaatatagactaagctgttgccctggaaggactcta

SEQ ID NO: 2306 - DNA, 658 bp, Homo sapiens
ttttttttttcccgagaggtctttctgtatttcagcactacaggtgtgggcagacagaacagctcatccagaaagaatccaaactgaaaacctaactttcaaatcacacccacatgttaagctggtgcagcagcctccccagatacaaggaaaatgacccttctctgcatggcactcagtggtgtaaagacactcggactcttaagcttatagaagacagagctttctagtgggctgaaaatacttaatgttccattgtttgccctctgattcctcaggtggccactgaaatctcatgcattcgtcggctcaaagtttggaattctacctagtcttgagactactatcttgtatttctttgcagtaatttttttgcattgagatttctttccctctgaattctagcctggtgccttgtaggtttcttgctgccttccctttcccagataatagcatcctacaaaatttggtgttatttctaaacccagagtagatacttcagtcctagtgattatttccctaggctgtcagctcatatggtagccctcaaaagttgaatgctggccaggtgcagtggctcacacctgtaatcccagcactttgggaggccaagggaggtggatcacgaggtcaggagtttgacaccagcctgggcaac

SEQ ID NO: 2307 - DNA, 343 bp, Homo sapiens
gtgtgctgaagaagaccactggccttgtgggattggctgtgtgcaatactccacatgagaggctaagaatattgtacacaaagattcttgacgttcttgaggaaatccctaaaaatgcagcatatagaaagtatacagaacagattacaaatgagaagctggctatggttaaagcggaaccagatgttaaaaaattagaagaccaacttcaaggcagtcaattagaagaggtgattctttaggctgaacatgaactaaatctggcaagaaaaatgagggagtggaaaccatgggcgccattagtggaagagcctcctgccgatcagtggaaatggccaatata

SEQ ID NO: 2308 - DNA, 306 bp, Homo sapiens
atggcaggacaagcgtttaagtttcttccactctttgaccgagtattggttgaaaggagtgctgttgaaactgtaaccaaaggaggcattatgcttccagaaaaatctcaaggaaaagtattgcaagcaacagtagtcgctgttggatcgggttctaaaggaaagggtggagagattcaaccagttcgtgtgaaagttggagataaagttcttctcccataacatggaggcaccaaagtagttctagatgacaaggattatttcctatttagagatggtgacgttcttggaaagtacgtaaactga

SEQ ID NO: 2309 - DNA, 1234 bp, Homo sapiens
caggttttggtgagaaggaggagcacaggtggaacagcttttggggagacaatcagcagttttatttgggatatgtgaagtttttggtgtctggtagacctcctggtggagaagctgtgtagcaggggcccatataagcctggagttcaggagaaagcctgggctggaggtacacgttggggagttgctgacaggcacagctaaagaaatgtgttactgacaagcctgcaggccacatggcgagatggaaagcaagcagtaaagaccaaagaaactcgttgaggacaatggaagatgggctcagaagaaaatggatacagctgaagctagatgggtcatgggtgaaagcaggacaggacctcattctccaacagataccaagtaagcccccaacactgcacaggctgccacacttggcgagggaaccagagtccccaatctccctgctacacaaagtcagtagctgttttgcttgcattgatgggtaggcagcggctggtgcctcagtgccgtgaggcgatgtcctctacccacagctctggaagccaactcaccatgccagggagggcaacttgcaacatcatggtcacaaagtggccaccctaccatttcagcaaatgtcttcctatgtccattaactagggggaactggctaactccatacgctttttaaaaggttatttacatttaaatgaaattcaacagcttttctacattcagaagcttctataaacagaggctgcggcctgggaagactgtggttctaccactcctgtttctaacaggaatcaagtactatttccttttgtaccactcagcagcacacactggacatcattgttgaagagacagagattttcttgtaaaagttgatgtatctattatcccaagaaaaagagaagctccattctcaggccaccttcaaaacaaggcaaagaaaaaccttcacaaataactgtgtttcttttgtaggatcctaaaagctcttagcaccgattctctttcagttagatcctaacttgtaggggacttttatttccaaaatggcaacaccttttaaaaaatctgtcaacgcaaatccaccattccctctcatcttctctctttcttggcctttgtttaattgacgagggaaacaaagaatcaggtctatttataggcacagccattggtactgactttcatccagttcatttgactttgaatatgaacctaaaaaaaaggggctcaggtt

SEQ ID NO: 2310 - DNA, 4108 bp, Homo sapiens
aacatttatctatgtattcagaatcacacacaagttacctttacagttcaatttactatatagaaatcattgggttttatatttgcagttaacttttgaactgagattacaatattataacaaaaaactttacattaattcagaactttttagcataccaaattgaaatacataggttcaaatttcagatttatggcaaacagtcttcaaatacaatacagacatttcttaaaagttaccgtatcattcacatgtgatatttgcaactctgagctatttcttatagaacagctctcctgcagatatggcaaagttgatatgccatgaagttcaaggcctgtatagtcaagccaaggactcaaagttgcaccatctttaaaaaggtttggcatttctggaccacaacaatgcacaacatgtaaagaaggtaggaaacagttccccctccttgttaaatggttaaaaaaagttacatggtagcttggaattttgcataaaaccccataatataccttggaaaagtccaagggcaatttgatggcaatggattggggccctatatatatatatttttaatagaacccatgagatttaaatgggcattaatcaaatcaaaaaatattaagcacctactggtttaagagatttaaatttattagagattcatgatcaatttctttccacctcgaaatcaaggtgtaaaaaccagctattaagtgcattccaaacttctcctatgtagcacaggtagaattttctgtccattggcaccaaagtgaagtcacatttcctcttgggagacagaaattccacacctgaacacagagtaagttaggaaaaaatgacccctgttgtttattactattgtgattctgagatctaggatttctaatatactagcagtaaacaaagcaaattcctggcaacaactgtcaggttagtgatgctaactcccttcccccaaccaccataaaattttagtaagaaaagaattaaaagtaatgactaagcagaacaaattggaaataacaagaaactaaggggacagttcaaaccaacaacaaaaaatcctaaatttgaaatcactgcaactgaagataataagtgtgcttcaccccaacccccatcccaactctgaatttaaacattccgtgcaaaagagcaacaggtttctggataaagatgtagcccttctttaagttttagtgctctgcagttttctgcaattttatttccctccccccaagtttattcaaagtatttaacagaatcttccatttcagccaaaagattgtgattcaaagatttactaaggtactctatgcattctatctatacagaaacacctatttattattacagttgatttatgcaggattaacatttttggtgttaaaattgttaaacatcatgcttactgcacatcaactctccataatgaatctgaacttcacaatgatttaccaaacactttacttaaattactaattaaataaatgaaaaatgcaccgagccaaacaaaacttaactgggctataaagaaaaaaacccttcaaaacagtccatatacacatctatttcaaaactacctttgctagctagcccctttcccaaagttttagcctgaaaaaacagtaaaatctacacaaaattttattgcaatcatacaagggttacattaggtcaacaaatactatgatgcaattttacatttattaaactacagttcaaagcacaaatttacacattctaaatacactaaacgttatctaatgaagtcacactggtcttctaacatttgatatatctgggtgaaagacatgaactttacaagactttaaacacaaatccttagtataaaaactgtgttcttgtatgtaaacgatttaatggggaacccaattaatgggcttccatctccactaagtcatccattttgttgcatattttattttaaacgcttaaggggtaggacaaactggtaggtttaaatctggatacattatctaaatctcccattatccccaatgaattatagatgaaagctgattttgtctggtcccaaatagctattactaatagtttttgttgccaaaagaattaagagaataagattgtttaaattatttttccacactggaatgttgaccagacaagcttaacctgcaacttcagatctaaagaagcgttaatgcctgtttaagcttcagcggaaaagctgtcttcttggctcagctgaatgcaagaaggcacaaagaagaagttcttcatcattgagtctgaagtaattccagcatcttgcatctcataccaatcactgaatgacatcatgtaataaatggctggcctctgaaaatcattaaaagcagatggttcatggaaagaatctgctcccatgttatcaaagataagccaatctcccacattcagctcaggaagaagacagctttccacaatttgatcaagctcatcacaggatggaccccaaaggctgcttgtaaacagaggctcatcttccttgtatttcttgtgaacctctggaatggtatttaagtcctcagacagtttacttgcaaaagaaccataaacaccatcattcatataatacatgaaggctggttcatcacttccggttttttctactccagagggaaatttatcattttcaacaactttctttgctatgatattaactgcgagtgtaaatgcagaagacacatagtagcttccgggttctgaaattatcttaacaccagatccttcaggaaagtagatatccaacagagggctgataacatgattaacctcttccaattgaaattcagttcccgtgaatcctccaccaatgtctaacatgttcatcgtaaagccaatttctccagccatgtcaaacacacatcgagcatcagatagagcatgtacatatacttgagattctttgcaagcactcgaaacatgaaatttaaccccaattatttggacatcaagttccttagcacattccaagagatgcctacagttcttcagggtagtgccaaacttcatgttaccctcttcacctccaatattatcttctgttgcaatatgtagtaagaccttggcatttgggtgattacgtgcaattttcttcaattcaatttcattgtcacatgtcaggatattcactccaacttttgctgcatactttatctgagacacttgcttgcaaggacttatgtaaataatgttttctggaggtacacccaactcttgcactaaagccatttcatttttactggaacaagcaaatccggttccaagagctgccaaaatctcaagtacagctggagcagagttgcacttcactgtgtagaatggctttatctgagccactacattctgccattgactgtgtttcttcacaatctttccaagatctcccacaaaaaatgcatttttccctgtcagggtatgttcataaacatagttatcaataacatttccaaggtttgttccttcatccaacaggccaacggagtagtttgcatcatcaataaatcctttcatctcagccgtattccacaaagccgaaagtcataaaccaggaaagacaagagacgggccaccaagcctatgtctgggtccttagaatatgcaacaaaatggacaagttgggagatggaacccccctatcatcagctaggttcccaaggtggctcagcgttgaagtcgaactgctctctatacagcacttctcctaggccctctgggtagttgtatacttggtcagaaagttcgccgtgagataacggcccaaagagtcgggtaaagcgtcttctctttttcggcggaatttttaaagagggatgtggttaccttgagcagaaatacccaaggcggcctgggccataggctgcgggaacgacttgggggtaaaagcgcggcaccgacaccagctgtgtgcagcagtggcggcggcggccgaaggagaaatagaacagcgcaggcaaaagaagaaaggcgcgggctgggtgggaagaggattcggactcgtcacactgcagagcagcagagcgagaaaggatgagaagaggcagagaaggcgacggcagaagaaaaaaggaaaaac

SEQ ID NO: 2311 - DNA, 3077 bp, Homo sapiens
aggtgttggaatcggtgggtggattgccagtacatttgcaccgtgtcctagagagcctctatgcatttcaactctgattctccttcaccatctacgcgcagcccacaaccgcaggaccccacccctggctctgaatctcccatgtcctggcgccaagcaggtgagtcagcctaggaggaggaagggcttccggaagccaagcccatgctggggtggtgagaaacaactttcctatgcaaggaggtgcctgagcaccccctgatgatcaagctggagccccctcacctccccgaagtgtgctggaggaaaggccagaaagaggcagcagtcttcacccactgaggctgagtttctcactcatgccaagttttacataagctggggaccatgtgcttcaaggctagaggtcttggtgggcccagggccttggaggggcctggatgaccaaggggtccgtggcttaggccctggctctgcatggggaatcttgggaaggttggaagcccacagcccctactgagaaaggagccacgggccagatcttttgcacaaatcctgcctgtgctccttgactgtctctccccaccggggtcacggtgaccaagcaggcaggagactccatccgttcacaggactagcatcctgggagggccctggcctgagcgagctgctgcaggggaccctcatgctggatggttggccactcagcacccttttctctgtggagcagggatgacatttgagagccaccaaagatgggcaggaaaaacaaaggccaccacagaggaagctgaaggcagaaagagatgcagagaaagtgggagaaactcggctgtgctttgtgggggccctgcagggacatcagctcctgaaggggtgaaagaaagggtcccctgaactttgacactgttcttctcgaggcctggccagccctgtggctccttagaggaatctgggtgcctgctgtccctagtacctgacaagccccaggtgagaagacctgagttcacctgcgctgccacgtgtaacctgatggccccggcaccctcgcagggtttgaatagctgccctttccacctgtttcccggattttccacaccacccagaggctcatattcaaccccacagcctacaagtcagccaggggcctttggccacatgtactgatgatgagaatcactggattgtaagctgtaaaagcacaaggatggtgttttgttccccgctaccccctgcacctgaggcccagcgaggattgctgctcggatgaaggagagcgagtgttcgtggagctctttgcagaagccacgggaagcccttcctgtgccttctcaggtttagtctcagacagccccactttccagatgaggaaacagaggctaagaaaggagaataaacttgtccagaatcagtggtgaagctgggatttgaaccccatcctgttggactcaacacttcctctgaaaagacaggataagggagctgcctacttctggctttgggaaccggcagagaggagcagagttgggccagacgcgtcacctcccaagctctgcggcacccaagggttcccagggtcctcttcctccatttggctcttttcttctctggactctcccaccttcgaggattggactccttgcagggagagcaaagcagagaacagaggaggcccatctgaggagagagtgctggagcagatggagcacagagagagcccccaaaccttagcctcacctggagagtggctccctgcaagctgagcccctgtgtgcccagaagtgacataggcattcaggaaagggactgagggaggaaagaaggagccattcctcttcccaggggcgcctgccctgggttcctgagggacgctccatgtttacatctccaaagcccagtcccaaacacgccagagtgcaatgccctccctcagacccagggccatcctcagagcagccgggaggcagcctgtccacccttaccacaggcaggtcgcccaggcagcctcctcttagagctcctgaattctggagcatgaaatagaaatgtgaaaaacaggctggcgtggtggctcacacctgtaatcccagcactttgggaggctgaggtgggcagatcatttgagatcaggagtttgagaccaacctggccaacacagtgagaccctgtctctactaaaatacaagtaaataagccaggcatggtggtccacacctgcagtcccagttacctgggaggctgaggcaggagaatcatttgcatccaggagatggaagttgctgtgagctgagatcgcaccgctgcactccagcctgggcaacagagtgagactctgtcaaaaaaaaaaaaaagaatgagagagaaaataaatactacaaaatgttaacaatgggtgaatgtaggtgaagagtatgtggcagggtgttttttattctcgcaaattttgtgtaggtttgaagttaccacagaatagcaaatataagaatgattcctgcagacacacgagtgatttcaactgttcacagggctcaggcaggaagcagatctcttgccctccctctgatccaggtcacttagtccagtccctgaaagcagtggatggacaaccatgccaccctctttcttccaatacaccttattttgtatcctgccctttttgtgtagcattagatcatgagcattttcctctgctataaatgtcccctcaaatatgttgtttcttgtgactccctagtgttctacccacgatttcctcggctgctccaccttggtggaattcagtgattcttctgccttttcaccattgtaagtgatgctttgatgaaaagctttgtaggtttatctgtgctgcacctctgaccagtcttttctggaagactctaaggaaggagacaggggcatggaccactggcttttgaaggcattcggtgggtcctgccatgccgccttcccacattccagaagggtggtcccagtgaacaacccaccagcacggggccccgctccatggtgccccagcaaggccagcgtccctatacaggaaaattaaaccatttgccaattcaaggcactccaga

SEQ ID NO: 2312 - DNA, 2005 bp, Homo sapiens
attacaccagctctctcagtccggggaggaggaggagcaggaggaacgcgaggaggaaggagaggaggagcggccagcagtagccacgaccgccaccaccaggcagaggaagagttcgtggggaggaaaagacctctcctcccccttggagcgccttctctctgcttttggagaaagggaatacacgataaagaaggagacggaaagaagagaaaaagtgaggcgggagacagagggaaaagggcgtgaacagaaagggccggagcgtgcaggggagcacagggcgcgggggcggcactgccgagccgggagcgctgccgcttgggcaggtgccgcggccgctgcccggaggcggcatgtgacgcgcggccgcagctgcccgcgggcggagcgctctcagaccccggagcgcacaccgcggggccatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccagaaagaaggactttgctgctttgggccaggatctgaacttaggtgtaaaccattgccctggcagagggaacctacccagtccattgctgcctgctacaagatatgaacagtaatggcacatattttggttatgagtcactcagaggactgtggattgaatgaactgtatccatccccatcatgatgtacagaaccaagtctcttcactacacttgtgttctgattagtggccaaataaatgacagtcagaacttcagctaaggtacaataaggttttgctgtggcgtggcacctggtctctttctagaaggaaagttcaacatacagcacaattctggacacattgtattggtttgatgctcctacctggaacagatcctcatgagctagtaagtttgaaggggagtcataaagaggaacaggcattatacgcaaggctgaagaagcagttggtaactaacagtacatctttttctaaggccaacactaaacataagttgcagagctggcctgtggtggaactcacaagtcttattggcaatatatgtgaggagacaaaaagcaacatatggagaaatacaaaaatatactccctagagatactgcctcttcagatgtcaagaaaaacctggatgaaatgaagcaagagtggcacgctgcaaagttacaaattcaaggccacccacagaaccaaacattaacacttaggtggagctggtctcttgggcagcctgacatctggtccactcctctgtcctatgccgggatcatcatgaccgtagagattatgtcactgttttgcatccttgttacataactcagttcctggtagattccagtgaaaggcacatggtggtgatatttttgagaaagtagagaagaaaagaatgaatccggatggttgttgagacagaaactgagcgtcgaacctcattttctctcgtacccaaaccttgatgaaacaacagaggaaagtattgggctgcaattgtaggcgcacaaaagcaaaccttgagtcatggatgaccgaccaaggaagagtccccttgggaggaggaggtgccaaagaccagtgatactgctttgggttatgtgcactgagggtttccaaccctgacggatatggattctaatttaaaatatcacagggaagaaaaaaatagacgttcccatggcaacattttctcagggccagctcttctgtcttattatcatatcttatttaaatatttcctggaatcagtttaaacttaatccctctgtgtgtcttctattttcagtggccatggagagcgtaacatctggtcagaggttttccttaaataaatcatataattgtaggc

SEQ ID NO: 2313 - DNA, 1516 bp, Homo sapiens
ctctgggccaaaggagtcagtgctggggttggtgtgtatgtgtgttggaggggggcaggccagaaactgagacaggaggagaggagccaaatcaggtagtcactgtattttattggaaaacattgatatatatttttcttcacagcttgaactgaacacaatattgcccggtttaaaaaaaacaaaaccaaaacattccgaaaatgtccacagcctcacgcctacctgcccttaccctcagctcttggctgggtctcccactatgccccatccctccttccctcagaggctgggtgccagagggtggatgagaagagattctcaaagctgggcaggtcccaggaaaagccacttgatcgacctgggcagtgaggggaagcagggggtggggggtggggtggggaggtggtggggggagccagatgaaatgaacagaaaaggggaaaaaacccagacgactgaactgcccacattgacttacttgtcccagaggcgaaagtcagaagcaagggcacggatcatgctctccgctgggggagtatgggggcaggcaggtgggcgagggaagaggcagggaagagggcacggagcacagatgtgaggaagcggcgccaagtcaccacggagaagcgggaggtgctggcggaccaggacgcagaggctgctgtagctgccgtcccctgggcagctggccgacaagactgttttattgcagaacagctcgagagcgcttcaggaacgcgggcaagtccaatttgcagagtggccaaatgagcagtccccacccagccaaacctcagaaagccaatcagatggtttcagaacagcagccagtgggatgtgagtgttgcccactgtcagtccccttctgtgagttggccccctcgaccccctcctgggccacatccagtcaacgccacaattcctcaacgccccctcagtccttctggaatgcctctcttggcacccctgccccaacaggctgctgggatctgcacgtggaatcacagggctggttgcatgcaacggcaaagggcatgctcttctgcctgggggagggcctcttgtccctcccagcaggtcccgggacagggctggcagccaccccagcacccaaaataagatgacaaacaagaggaaacaaaccaaaatggaggagagccatccgggctggaggagggcagaggctccccaaggggatctggggagggcttcaacttatgaatgcatcaggccttggaagacatggatggaagaggcgagggcaaaaggaagagatgaggggcatggagagagactcagggaagaaggagaaagagcaatcatgcagcttgggacaaatcttttgttgctttatcagattctcagtcaatcaattggtgtttgctagaaccggggtacgcaggggagtgttgaagagagagtgcgcgcgcgagaagagagagatcaagagaacgggcatcgccagctgcccggggggccttcactttgcagtcatcatctgtacaaactctgt

SEQ ID NO: 2314 - DNA, 2622 bp, Homo sapiens
tggaatctgattttaaagaatggcccagcagatgaaggtgtttttttaaattgttagtcatgtgaaacgaactgagtattgatcagtaatacagacagggcagctgtgagagagtttgatgctaatctttgcagaactcaagaacatactccataaagtacagctgaaaagatcacgaaaaccttggagccttcgaggaaagagaagggtgacttggggacacaatcacaggaagggcatatggatccgagcatccagggtggttactggggtgatcagacaaataagcattgatgcctggaaggcagaaatcacactgcgacatcaaatgtttcatcaagcaaacagcaaggatctcttcaggctgtgttctctagacccgaaaatgtcctctgtggtttggctgacaaatggaatctctttagaaaacatgcaaaagggtatctcagctatccatgaacgattcggtctaggacaaagaactaacagttccttccaaaatagaggtctgttggtctgtttgacgtcatcccatcatcctatctctccctgtccttgtctgcagtagaagttaatgtaatcataccagatgtttaatgtgaacaagtaatttccaaatgtagaaacaccactgatgcacttagggggaaaaacagtggcagggtgttagagcatctcatcagaggtgaaaatcacccacttggaaacctactgtgcacccgttgtgagttctaagagtgtatcagaaagctgattttaccatctgttgtgaaagattatctgcaatgagggctgctagaaagtcagcctgctgatctcacaagtatatgacttcttattccacttcaaaagtggggaacttgacaagtttcttgtctgccttttgatgttgattctatagattaattagttcaggaacaagtctttcatatacattagactggtatcattgagttctgagctattctgttgttctttaactgacactctggattgccagtgtcggctgctacattctgatacagtaagtcaaaggaatctagtggccaagagttgtagtttagaaacaacccatctgaatactgcttttaccactttgatacctgaaaagatcatccccctttctaaaacctgaaaacaacatatagagaaatactgtagaaaccattgctagtgtcttaactaggaaaagcaagtagactcatcaacaatcctttcaaaacaagacctagagataaacagttttttccagtgtcaattttcatagacatttttaaaaaattaaacacatcttgtcacccagtgctagcaaaaattgtaaagagcaaaaccaaagtttttgatgttagtcttatttttgtaagcagggtatactatagtcgtggcccatatggaacacacaggcagccggttttctgctacctgagccttggagaagatgagaaggaagggctgcctgctgtgctgccctttgaaaaggtccaaagcagacaggagcgcacacagcagaagtcaccttctccttctgatgaccacctttcaaaaggcttaacagaatcaccaagtgtcacagtcagctcttggccagtggaaaattgtctgggcctgtatatgttggaggaactcagatagaaaaggacttgtaaacagcatggaaacctcaacatctgctgtctcaagcacttaaaaaaggctacaattcaggtgttactggatgacttaactgcatggacatttaggggctgacttgtgttgtgattattccaattgtgggctttggagaagcagagggatgattttcagttgtgtgggtgttaagtctatggattgggaatttaccactgaaattgatcgttcaaagtgtgacttcatagtagggccagctcctcctaagttgtccttttgtttttcacataaaatacatctggtactttttacttggaaagttgtactatgtccatgaaaatggttaaatgagaaggccataaagattcatttaatagctgaaaagcaacttttaaaatagaataggacgaatttaacatggaatgatgtgaccttctagggaactttttatagagagcttacatagtgtaattggggagaattttgtcttctatttccattcaacagtagcaaactggtggttttataaaattaacattatagtatgttatataaataaacgttatataaaatgacattaaagtataactgtgaaaaattaaagacttggcgttatccacaacctttatgtgcaataaggaaaactgcagtaggcccccaaagtgccgtctttccctagcattttactcaatgtttgcctttgtgtatgtttagattgctattgtaaagctagccatgtgtgttcctgccctttactgatatttaacacattttctcaaagcttttctttttttaaaaaaacaaaactcaaaataaaacaactaactggctgagctaattttgttttgtattttaaagtaaagtatcatctgttggtagaaggctgtagtgtgatactattcttagtctgtttccctcactgagaggttcttttctgggtgtaagctattcctctccagctttctttaggcctggggttggcaaactacagctggc

SEQ ID NO: 2315 - DNA, 1894 bp, Homo sapiens
ttttaagtgtacctatgtgctgccccttaaaacattcatggcatctggcaaatagacccttgtaggctggcctggcatattcagatgttgccgcatcatcacagagaaggtcaaatgaagatgtaaccattgctgctcatgtgtcttctctaagcaacaaggggagcgggatgtaagagagaagttgctaatgatactgtacaaaggatggattaaataatgaagtcaatttcattgatagaaaatgcaaattttaagattctcagtgtatgaggtctcagcctcgggagcatttattttttactttcctgctaaaaatccactggggaggtataaaattcactccaaagaagtttgcctgggccaaaagcctccaggttccttctgagaacaaaatactaatgattttttttttttttttggctgcttgggagagactttcagcattctttcacgatatccagatatgtcccttcagcacacacactcaactttctcatctggttcgtttcatcctcccgaaagaacggtgctctcccactcttactctatttcaaagagctactctgtctcaaccacagcagccctgccaagaaaaggcaagatgaaaggctagagcatgtgctaccttgagatttcaagaagtgtcctacctcagctgaagatggagaaacggggagtggagaggggatcagcccagggtaccatgtgatgactaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgaccagctgagttaccatataccctgatgattccccttctgtaacagaaggtgacaacaactttgtgaactttctatatctttatctgatgccccaagtggcatcatctttatgtacatgccttagttgagaatatgagactgctctaatctttgtgaatgccttcacacttcagctgaggatgtcaccttctctgtcactccccatcctgcaacctctgcctttgctctgtctaccccagcaattttcatagtgttatccaggtactgtgctaaaaggtcagctcttctgtaaaatgccatgcttcgcagcttcaaaaagcaaaattctgtatttcatggagggagggaagggtcattctcttctaagaaaaatagactggacaggcgaatgcatgcatgcatgtgtttagagttgcttctcagaagacaaagagatgatagcaactattaaaatatgaatgaatgaatgagtgaatgagttgaaggcctagctcgggctgataaagcttttgccttagtagaggttttatgtcaacaccttcaggagggaagcccttatttctgggttgaactccccttccatgatattatgctagcaattgccatcacttagttcctggcgaaggcagaaaaagaaaacaaaaaatcagcattgtcattgacaaaactggatgctgaagataaagtaaaattgtcttttcccttgtcccacatttttgggattaaagccagaattgaataggaaatacagtactatttctgaagttgatagccgatctttaagaagaccctgtctttaaaatgaaactagcaggcaaacacctaaataatcgaaaattaccaaagaacaacaacgaaacaagaaaacctaaagatttttacttcctattcttattcctttccttattactgtgacaccccttgcattgctcagttgcctgtgtgtcaaaataacttgtggacgttggaaattatttgaaaatgtattgtgtggaatgtaataaaatgatgatatttttat

SEQ ID NO: 2316 - DNA, 2614 bp, Homo sapiens
atttttgtattcttagtggagacggggtttcgctatgttggtcaggctggttttgaactcctgatttccggtgatccaccaccctcggccttccaaagtgctgggattacaggcgtgagccaccgcgcctggccggaaatcatgtaatttaaaactatatatgggtgtcttaggcggcatcggtcccaactctaaagtacgcgttagacgggcctgggccagaagtgggccatggagacctcgggacccgcagggctgccgcccgacccagcgagcctctgaaggtgcaccgccacccccactgtttatcttactgcctcatagtaggcacattgtcgttctcaatataattgcacacagttttattctggatcctcatttgcctttaagaattttctcaatttttctttttatttgatcgcaccactgcaacctccgcctgctgggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactgcaacttccgcctcccaggttcaggcgattctcctgcctcagcctcccaagtagctgcgactacaggcgtgtagcaccacacctggctaatttttgtatttttagtagagatgaggtttcaccatattggccaggctgttctcaactcctgacctcgtgatccgcccacctcagcctcctaaagtgctgggattacagctgtgagccaccctgcccggccacttttgtatgatttctaatgtatttgtaatttacctaacaaattgcctaatctgctatgttaatgtatttatgaattaaaataaatacgactgc

SEQ ID NO: 2317 - DNA, 3828 bp, Homo sapiens
acagtctctccttcgccagctcccacaccgctgccctccacttcgtccccgccatcgccgcccgaccgcctgctgctgctgcagctgccgccttccgccccgctgccgtcgcccaggctcgccccctcctcctcgtcctcggtgctgtcgctcagggacgcgccgtcctgcatcaactccttcccctccagcgcgtccagctccagatccacagtcgccggccctcgcccattgaaatgcctcaagggccacaccgaggtctcggggcggccgcggctactgccattgttgccgagacccccgccgccgccgcctcggaaggccagagtccgacggttcctttccgctagcagggggccccccgcgccaccgccaagcgaggtggggccgcccgcgtcttgggggagcagcaactccttggcttcctcggcggcgccggcggccggcccggcggaggcctccaggtcttggggctccaggccctccaattccacttcctcgtcggccccccgcccattaggcggctgaagcgcgggcggcgctggcggcgggggctgtctcggctggggctgcggaggccaagctgaggcctccccgccagcgttattgttcgtggagccgccgccgctagcggtgaccaacccgcctcctcggaacgccagcgtcctgcggttcatttcactgaacgacatggcgcgcgccgccgccgccgccgcccggtgccccggctcgcgcacggcctcgggccgcgtcccgcgcgctccccgcggctccccctctgtctcgcccccgcccccggcgttccggtctcgcggggctcggcctcgccctctcgcccggcagcccggctcgcgctcgctcccgggtctgctgcacgcgtccgctgccgctgccgctgccgggccgacgcctccgaccgctctctcgtcctccacccccgccccgccgcgctccgggcagcgtcccgcgcggagaagggggcgggcggcggagaggtgaggagcgagcctgcagcgagcgaggccttcgaagttgagcagcggagtgcggggagaccctccgctgccccctctttaaagccgcgcgcgcacacaccgatcctccacacagatatccttcctccgcgcgccgaggagtcccgacgccgccgccggcttcgcaggcgctgagggtgagaggcacgctaaactgctcggctccgccacataacgaagcgacaataaagccggcggagcgtttccgtccgaccaggccctggcggaggtcgaatggcaaatgaacaacggaccgtgcgcccacaatgcaccgggactggaccaggcggtgcctttcacgcgaagaggttacgaccacggacacaacctcctttgatgcattgtgcgaggcagcacctcgggccccggacagtagtcatttcacagaaaatgcaccgccccgagtgtcttattgctgtgatgaaatggaaatttaaataaaaggtcgaacacgtgcgttcactgggaagtattgacatgggtgttacatcaccagcagccaatcagataactccagtcgtgtttatacttctacaaccaccttgtgagtattacagtatgtcataacgttataaatattaggcagggttttccccaggagcggggaggagtctgcttctacggacgttgtgagcggctccgaagattgtgtgtttaaagtcaacaattcatttttaagacttttttcgaactgtttacattacatggactttagattgattctgacagaatgaactggaaatgaaatcccacagttatgatcgtagtagagtttttttttccaatttagggcccttatactccttttaaaaatttttaatatgctaaatttagcaaatactaaagtgttaagactcatctgacaatgtgagaatttaagcctatttcaggttaagaaaaaaaagatgttttcaagttatggaggggctttttactcttaagcgacatatgtattagaagttgaatcacgaactgataaaatgctccagataattgttgactaaaaaaaatacggcaggacaaattttttacattaatacatatgtgcagaaaatgagaaatatacatgaactctttacagttatagattaatgggaagggttatgttaaaggcttgaacctcctaaataatgtattaatgtaaataaagttatatatgttttatgaagaacaggtgttacaatttttagacctagttttatgattcttattctcttcaaaagttctttttctatttcaaaactaagagcaatatgtaaagctttgtataatatggaatatggtatgtatttcaaggttactttaaaaagcaagctttggctggtcccaaggtagtgaattgtctcaattggttattcacagttggttgcccgttgtaccactctttccccacttccacttgactagtcttttaaaaataaataaatatttaaataaacaagtcttctcaaacattataaaagaccgtttttcttaatattttttaaatggactaacatgaatccacatccagactcatattaattgtatacatttattcaaagcaacattcacttcattcattgtaatttttagtacctgttgatgagcagtgttgtatatcaaacaaaaaacattggttttatcttgtagattacatgtaattttaatgtaaagaatgacagtactaccctgccacaaaaggattttggctttgagttatttttccggtaataaacatattgtcacctggccaccagtgaccaagagcttgaaattctgatatagttcttcaggtgggtacagttgtagggtgtttttgtttgtttgtttgtttgttttgtcctgctttgttttagttgctgggaagcttaagacagtggagtctgatcttgacctaattcgtacccttaagaaataagagaactctgccaagtgaggctgtataatatgtgccacatatggaagaatgccataataatacttgtgctctgtttttaatgcgtgtttttttttcattctaggcattttgaaaataaatacatttattatatgttaatcaccacagcctccacccccataaaaagagggaagagttactgaagttaattacttatctaggatcaaggtgatgggaaatgaaaatggacttaaaaatttttattttgctgggcacggtggctcacgcctgtaatcccagcactttgggggccgagacgggcggatcatgaggtctggagttcaagaccagcctgaccaacatggtgaaaccccgtctctactaaaaattcaaaaaattagccaggtgtggtggcgctcgcctataatcccagctactcaggaggctgaggtagaagaatcacttgaaccagagaggcggaggttgcagtgagctgagatcatgccattgcactccagcctgggcgacagagcgagattccatctgaaaaaaaaaaaaattttatttcagctctaaagcttgttttcattcaaaaactgttaaattcaaatatttgctacttcttatctcgtatcctactacatagtaggcactatataaatttatgtattatttttgctaatagtgccagaatcaaccaaaaacgtttaaatccataattgtgtcagacctgcctttttctcagacatatatcttaccttatgttttataaaatcctcattgtcttctatctgaagttatgtttaaacatggactaattaggaatgaatgacactagagtcaagtggtacaaataaatgacttaaattctaggaccactgaactaacagtatcagggtgatgtgtgtgtgtttg

SEQ ID NO: 2318 - DNA, 2206 bp, Homo sapiens
atttaacacacagcagcttcatgggaaaacaactgtattttaaatgaagaacaggcctcctcagtgataactctaaaatttctcaacaatgtacagacacagactaatcatgaaagaagataatgacgatgctgggcagtgtctggaggtagccttttctcctggcattcactctagatgctcaaacttgggagtgcagcgctctggcagagttgggagatgttctctggagggctctggcggtgcttatttatcagccagtattgaaatttgtcaatatatcaaaaacgatttagtagctatatcagaccttatcacctgaatgcagcctttggcccacattctaaaggtggtgacacacatagataaggaatgagatgtctcaagacttataagacatgttattttaataaatgattatattttttgataaagtgaattcaaatattaccaacccaagtgctttattgatttaacaagatgatttcaaataatgcattaagttagcctgctgtgttaatttcataaagctattctttttcattttattttttcaagttttcattcacttttcaaaataatggtagcatataatcacatgcaatgccaatgaatccccatattaagcttcgtacttctgtccaaatgtattgtagttgcctaatttcaaggttctaatttggaaatctgatttattttgtatgtttttatatacataccaattttaagcattatcttgcaaagtagacataggtggtgtttgatttgccataattaacttgaatttgattttgtaaccaaaatgtggctgtccacataattggagatcagtgtctttgggcttttaatggagaacaaatcacattgtggtgttgctggtttttctgtttcacatttacttttgctctagaagtatttccgtgagtctgatgactccataagttatgatcctcagtgttaagtaacttagacggttggcattactttaatattcacttaagcttctgtatcatttttttctgtatttttcccttaggaatttaattcgggtcttcctcaaattttacagctttaaaaaaattccatgaatgggttttcctcaacctcagaatatcataataaattacaagatatgaccccctggttcctattaccttgattaaagtggcggcaattaatttactgatgttttgtcagtgaaataaataatagcatcttatgaagtttgtgtatctctgatgaaaatgagtcatgtcagattccctctctgaagggaagttaaataaacaacatttttaaaattctttgaattctaaataaatatgctttgaaaagtgagttagggttttgtctaattgcactgaggcgagctagcttcggtgccatttttctctgtgcccttttccctccatggattcatttctatctattgcactctagcgtaaaggacccagccaagaaattgtaaaatagattcaacaacaaaataaacaggtcttgagttaattatcaatctctatgcacttaattaatatttcccaagcccatcttaaaggtgtaataaggtagaaaaataaaagtacactgttaaaatagccagaaatgtttttataaataatcctgctaaataaatctgaggccctttgttaatttacaattatgattcattttattaataaacttgtttgaattgtaccacaaatttaactgaattgtatcatcaaaataaataaaacagggtaataaaaataacaattagggtgactgatgtcagacactcatatcaactcatcattttcttgtagcctctgattctgtactttcttgtgtattattaaagaggtaaatgctctcttaaaatgcctctagttcctcagaggtaggaaaaataaactcaacctgctttggacttgtgtatttacttgggttggtttccagaatctccttattcctgaaacagtatgatcatgtagttaaactactcctttatatctgtaagtactgtgcagccaacatgttcttttttgtccccaacttctgccatctttccaacctctgaggcatgctattttatagtggtttgctctttgaaaaattgtttttgtgccctctcttaatagtcacagatactgacacaaaacttaaaaatgaccagaaaacaatgtataaattatttaaaataaaacattctttttatatcacatta

SEQ ID NO: 2319 - DNA, 1779 bp, Homo sapiens
gtgtccaagtcattccagcagtcatctcccagtagggactaacagggtcatgggtgtgacctgtctgcggcaggcataggccttcctgctgctgttacccagtctttaagtatgccagcatctcttaggaaggatgaaccagggtactgcacgccttgctagttgaatgaatcttggaacgaattcttcattgaatcaaaaaggagctcatagtgcacggtcttctgctagtacttcttcctataatttacagtctatatttaacattggaagtagaggtccactccctttatcttctcaacactgtggagatgcagaccaggccagtaacattttggccagctttggtctgtctcctagagacttagatgaactgagtcgttatccagaggacaagatgactcctgagaattttccccaaatccttctacagcttaaaaggaggagaactgaagaaggccctactttgagtaatggtagagatgacagatctgctgcataggagccaccatacagagtacctagggatgattcagaagaaaaaaaggcactttagaagagatagttttgatgatcatggtcctagtctcaacctggtgcttgattatgatcatggaagtcattctcgagaatctggctattatgacagaatggattatgaagatgacagattacgagatggaaaaaaggtgtagggatgattctttttttggtgagacctcgcgtaactatcataaatttgacagtgagtatgaaagaatgggacttggtcatggtcctgaccctttacaagagagatctctctttgagaaaaagaggggcgctcctccaagcagcaatattgaagactttcatggactcttactgaaaggttatacccatctgtgctctatatgtgatttgccagttcattctaatgaggagttgagtcaacatatcaatagagcaagccacagtcgtcgatgccagcttcttcttgaaatctacccagaatgggatcctgacaatgatacaaaacacacaatgggtgatccattcatgtctcagcagtctacaaacccagcaccaggaattctgggatctccacctccctcgtttcatcttggaggaccagcaattggaccaagaggaaatctgggtgctggaaatggaaacctgcaaagaactagacacatacaaaatggcagagtggaaacgagcagagttgttcacatcatggattttcagtgagggaaaaacttgagataccagctattacagctggtagaaccatttggagtcatttcaaatcatctgattctaaataaaattaatgaggcatttattgaaagggcaaccacagaggatgctcaggctgcagtggattattatacaaccacaccagcattagtattaggcaagccagtgagagttcatttatcccagaagtataaaagaataaagaaacctgaaggaaagccagatcagaagtttgatcgaaggcaagagcttggatgtgtgatacatcgcagcaatttgccccattctgcctattctgatagtgctgttctcaagcttgctgagccttatgggaaaataaagaattacatattgatgaggatgaaaagtcaggcttttattgagatggagacaagagaagatgcaatggcaatggttgaccattgtttgaaaaaagccctttagtttcaggggagatgtgtgaaggtagacctgtctgagaaatataaaaatctagtactgaggattccaaacagaggcattgatttactgaaaaaagat

SEQ ID NO: 2320 - DNA, 976 bp, Homo sapiens
tccccaatatggatatgtatttttatatttgactgcttgtatttttttgttagatgcaaatagtacggtattccgaacagacactaaaaatagctgtcatctcaaagaatccagtgcttgtgtcacagtatgagaaagtagatgctggggaacagcgtttaatgaatgaagcattccagccagccagtgatctctttggaccttgcattctccatcagattggatcacctcccaccctgaggccccccaagactttgaacagttcttcagtcatccttacagaaagataccctctccagacaaacgcagtatttatatacggtccattggatctctatgaagcaccagaattatcagtgaagaatatattaaatggctcacgggctactgtaaagcatatttctatcgcttgagagtaaaactgctagaaccagttcctgtttctacaacaaggtgttcctttagagtcaatgagaacacacaaaacctacaaattcatgcaggggacatcctgaagttcttgaaaaagaagaaacctgaagatgccttctgtgttgtgggaataacaatgattgatctttacccaagagacttgtggaattttgtctttggacaggcctctttgacagatggcactggtgaggtggattgatgatgaatcttctggcacacctggagcaactccagaacacagtcgtgaggataatgggaatttactgaaacccgtggaaggaagcctttaaggaatggaaagagtggataataaaatgcctgactgttctccaaaaataaggaccttcaaataggagtgattgaaataaatgactacttgcatgttatgctttcatttgggtggaatacttcatcagaataaactattgatcttgtgctgtgtcaaagtaacagactagaaccttctttcaagtacctgaattgaaatgaaactcattttgaataataaaaactctagaaactc

SEQ ID NO: 2321 - DNA, 2096 bp, Homo sapiens
ttttgctgttgttgttgtttgtttttgtgattgctcttatgtcggtaggtaatgtcaggaaaagtgactgtttcagatccccagtacaaacatcagaactaggatcaaatgacttgacttttaagctgttccattttctaagaagttacaattacaaaaagtaagcattttctacattcttacttctaagtaatgaccttctcattaatctttccttggcttaaaatgacaaataagaatccaaagtttttccactcctcctgtgggagataggaatagttgtgaagagtctgatggaataaaatgactccagagatttacacagccaccatttgatcccagcctttgtccttgtgttatttaaacaatggcttcctgctttctcaggggtcaggaaaatgatttaaaaatttgtcttcttgacaaggcctgaaaacgaagggaggtgtcgtggagaaatggtgatttttctggttacatcacttgattcaagcactccctggagctttcaaagccttttttatctgctcagagttgacacccaactcagagtcagaactcaccagaagatgaggaacacccccgaaatcaatgtttcctttctccatgggatttttttcaatcttggtacagctgcatatctcccaaactcggatgctcttgtgaaatgacagccacatcagtgtggttactccccacaaataacactagggggaaatgaccttttttatttaaaaaaaaaaaaaaggctaatgctatagaatgatcatgtaaagaatgttgaataaaatttggcccatgttttaattgactctaggcacctctattgaaataagtctgaggcatagtttgtgaaacatgtttcaaaagtgtttgatgtataataaatgctagaaatttacagtacagaaatagtaaaaaaataaaataaaaataaacctgtagattacagctctgttcctaagaacctcagcctttattgtgtcttagtaaagttgatctgctttatttttagtttattgaatttctggtgtactagcctcttaagatagaacttttaatacatatgtactggttaatgcctgtttacgcagaaaatggcactttgttctttcagtgtgtttccctcagtgtcacagggtatatcaatttgatagatcatttgacatttgtcaaaaatacgtttcccattttaaaaatatgtataattggttgcatagacatatgtcactttttgcagtgtcttcatcttgatcatagttttagacatcaactatgtctcactttccaactgccatagaaatttggtacatttgcaaattctggtggaatctagtgagctgaatgtattggtagatcaaatgatccaaaggacttgggtgttatccttcagtctgtgttgaaccattcagatattgggaatggtccttacacaagggaagtcttttgagaatatttgttctcttattttttgtttgtttgttgctggcaaaaaaaaaagtaactttaaaaactcagaaaagccactgaactgtattttgtgaccttatgattagttttatctttcaactgatttttattgttacttttactcaatatcaacagtacttcaatagatatttattagttatgttcaatctaatgacttaaaacagttgaaaaggaggaaaatcaactccagtccacacatacagtcatgttacattaagatgtcatgttgtatgtcacacagtttctagattgatttctcttgtgtataagttataacatcaaaaatgccaaagggtatataaaataagctacaataatattcaacagaacttaacctggaccttatgttgtaataatttattcatattagctgtagtcttctgtatttatattttcagtatttattatgaatgacatggaaattcgtgtatttattgtggctttttattgcagtgtgtatatatatataacaaataagcatttttaagtcttatccttaagtttcttttattagtggcacttgtattatgctgtactttttattacatattgtacaatatcttgtccatttgtttgcagcagagtaaaaccggtttctaagttgt

SEQ ID NO: 2322 - DNA, 6894 bp, Homo sapiens
cagggacatgtctaacctcggaggccgtaggaacgggcctgtcgaagtgcgcctgacagggacatgccacccccgttttaggagaacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgacaactccgtgagggtggagattatacatctctcatcatttcagcaacaaggaaataaattagtggcagagtaagggtgacttgagatctcttggaagcgaggatcctttaaaaatcctggaatatacactgcagtaaaagaacaaagcatacctcagccttaaacgactgaagaagaatgtcaagtggggaagtggctttggttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaagaaaaaaggaaagaacaattaaaaaaagagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatgggttagcggaatttcaaactgatcacctggggatgagagcaatgggtaactgaagcttttgggctcgggggacaggtcagtgcccacgttgttgtattcccattttgtctcagtttgtttaacagttggctctaagttgaatgcagtcctagtgggaatctgcctcaggaagatgattgtagtttgtgttttcagagatggtgccttctggcatagtagtgttttccataaaaacgttttcttcagaggcatttcttgcagttgtgttttttacagtagtgttttctataaaacattctgaaggagcaaatacttctggaaaagggttttcttgaggactcaggtctcctgaggatgaaaaagccccttgtgaaggggaatttatgaggctcttcactgcagagaacggcggcctctttgcgagcatcagtctattgagataacttttctttctcaattttctaatctttttggccttgggtgttctgtgggccacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccacagctgtatgccccagtcacacaaagtaggagtcagcaaacattagagtgccattcagagaggagaaacacacacccaagcctaaatctatgaaatggcaacaacaaaaggaggaaaagacatcttttgaaaatatggctacttacttggaacattcctagtgtgacatagagtaactctgcttaggattatttcgttgatccccaggggccaattgcccagtgctcagtcaaagcccaaggtggaagacaagtgcttccctgatgagctgtcctctctgcagactgctccgtaccctgtgctgtcctgcctcagatgcagagagagcacaagcctccctcctcatcctcagtgtgcctgtgttcttactaccatcacagctgaatgcaatgaaaggctatcctctgagaggagcagggtggagatgctaaagtggaggccccctcccattgctgatagatcctcatctggcatgcactccacccacccaccccattctctgctaccacatatcgtagccccattaaagaagaagtgacatggaaaaaacactgtgcccaccctagtccttttcttaaatttgggcagagatccagggtataggttaagagatttttaatttgccagatggtatgcctatgttgttaaatatacaatgaatctatggtatgatagcagtttctggataaacattacttgaggtcctaaaatgcagaagggaaaaagcagcttttgtcagatgcttactttgctttcatttcatctctaatattttggatggggaaccatccaaagcttctggccgcatgaaggtcaagtgtgccagtgtgcagctgggtttcttttccagaattaaaagtattttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaatgcttttctgcccacctcttggggagaagggaataatttagttggtaaaaaaaaaacttttgaataataagcaactctgtctttatataagtagccaagcattattaattatccaccccatatcactggtagatacctgtattcaagctatgtggacataaaagcagtcacattttagaagtcatgaagttggtgctaataaacctaatctacagaaaaactcttgaaagcacttgagcatttgttctgtgaatagaaaggtttgagattcagagcaagttcagagttggatggtctaagaatggaaaagccctccattccattagaagagccagggagcaatttctggttatggaaccagaagctctcaggcttcaaataaaacagcatcacttgtactcttataaaattgtaaaaacaaaaacaaaactggatctacatttgtcctaaaaggcagagagtacttgagacctcatgcatataaaaccagcttacaaactacatcgcactatatgaagaaattatcactgggggcaaatcaccaagtagggagcacaatacacagggtgtggatgttaatgtcattccctagccttctcattcccttctcttggtcctttatgcatatggaacagttccattattaaattttgtaataataactgagaacctgactcccagcaagggagtagttcagaagttgagggagtttaaatctgaatgagtaaataaagcaattatatcattagcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggattgtcattgatggacacagctgggtgagaagacatttgagaacaggatctttactgatctcaaagtaccaccacacagatattttattaattaccaaagggaaaaattattttttatttttttatgagacaaagtctcactctgtcacccaggctgaaatacagtggcaaaatcgtagctcacaacagcctcgacccccaccctgggctcaagtgagtctccaaattcagccccccaagtatatgggactatagtcttgtaccaccacacccagctaatttttttttttttttttttttttttttgtatttttagtagagacagggtttcaccttgttgctcaggctggtctaaaactcctggactcaagcgatctgcccgtctcggccttccaaagtgctgggattataagcatgagccaccacacccagcaaaataactacaatggagagatctggaagatcaccttaaacaagtgatcaaacttagcattatgagccacctgcaatcacgaggcaggaaggatatatcacctatgcagtatttttcccaaaaatgcttaccttgaatctcatcatgtggaaacagacaaatccagattatgggacaatttacaaaacaactatctttgactcttaaaaaatgccatgtcatgaaagatcaaaaaaagtagaggaatgttttagattaaaggaaatgaagacatgacatgcagtgcctaatctttgattggattctgtgctattctttcatctttctggtatgtttgaattttttttgaaatataaacttgggcaaaagagataaccaagataattgattaatttattgttatggctcattgggggcagtttcagagaaataaaaacaatctttgtaactggagtaaattctcaaggttaatcttaagcaatatagcatggtcattaagaatacagattccacagccagactaggcttaaatcccagctctgtgaataatgtgaatttgggcacattgattaatctctgttccttggccttgtcattataatagtacctacctctaatgagttttgaggattagatgaatcagtacctgaaaaatgcctgaca

SEQ ID NO: 2323 - DNA, 2211 bp, Homo sapiens
aaaagccatggctgcttgttatccggtcaatggaacgggttatgtacgtcatgttgataatccaaatggagacggaagacgtgtgaaatgtattacattacgttaaagaacgggatgccaagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctggattttccaatccataggcccaaagtgaactcccacgtggagtaggatgaaaacccacagcatctagatcttcaaattctggagaaaaagagagtgtgaaagactgctcagtggctggggtgagagtcaagtctggccaggtgctaatctggagaaaagccaagacctggagcgagctggagtggcaggccctggaggatgagaaggtggcaggagtgcactggggatacaaagaaaccaagatttttctgggaattctcagaggcctggatccacgaaaaactccgcacctgccatcgaaaccaccaggtgtaccggattatggctgagcagctgtgagaacatggcttcctgtggaccctggagcaatgttgctatcggttcaaaaacctcctgaccgactactgcaaagccaggagcacctacacaccaggcaccagtgtcttctatgatgagatggatgccctgttgagtcttggggcactttctaacacctttgatgccttagaggtggtaggaggccttctttgggattgagaggattccaaagggaaccagggcatagcactagaagatgtggcgggatggtaatgaaatagtggaggagtctcaagaggaatcctggaggcttggtccccaggccttgaggtggaatcccagtggcaactctcccccacaatggacctcagagcagtgggagcgacgcagtcctgtgggaagcattcaggctcagaatcaggagatgtgattattgtcctggctctgttatgactaatttgggtctggaatggcctcatcgggggaaaaattggtgacaactttaagaaatactgtttatatcccgtcctcaaatattgcttgactcaaccctctactgaaccagtagtccagggtggctcacaaagaccactttgaggctcttgctctgctctttagccaaggagtctcccttcctgccttcagtaacaacattacaggaagagaggagagaaaggtaggagttaaagatccagtcatttgtttccatctaaagtgccctataagccgggcatggtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtgaaccctgcgtagattatacacaccagtctgccatttaaaaggtttgttgttcttgggcaacctctttaaatacccttagcctccattttctcatctggacagtggacattgtgatggtttctacctccctgggctgttatgaggatcctgacacagtattagcacttggcaaacgttagttttcattatcatcatcattataattattatgaaaatagataagggcattatcctgtaccctcaaaggagtaaaagggggaaaatgagtcattaaactttctcttctgggaactagaccttcttgagaggcactatcattctcatttcacctgtcacttccagacatgggagcagaaagtgaatttcagaactccatgtcccctcctgcttttctctgagcaggacttccagttccccagccagatggggtcacaatgctgcagaaaagtgaagagctttggaatgaagatctcccggacttcaaggagattcagaaaacgtccagtgcaggtgggaaatgaatgggagctagcattccaccaacaaagtcagccctgggattctaaactcggacaagccagcactggttaagggctgaggggaaccaggcactcagtgcacccagtttactattctgtggtgtggaaagcacaggacttgagaagcaggtggcacccaggaaagcctg

SEQ ID NO: 2324 - DNA, 516 bp, Homo sapiens
ggaccgtttttaactgttgccttattaacccctccctctcccacctcatcttcgtgtccttcctgcccccagctcaccccactcccttctgccccttttttgtctctgaaatttgcactacgtcttggacgggaatcactggggcagagggcgcctgaagtagggtcccgccccccccccccccattcagacacatggatgttgggtctctgtgcggacggtgacaatgtttacaagcaccacatttacacatccacacacgcacacgggcactcgcgaggcgacttctcaagcttttgaatggtctgtggtgatgctgtctgtctgtctgagtctcgtggccgcccctggaccagtgatgactgatgaatcttatgagcttctgattgatctcggggtccatctgtgatatttctttgtgccaaaaagaaaaaaaaagagtggatcagtttgctaaatgaacattgaaattgaaatgctttatctgtgttttctgtaaataaaagagtgcaataa

SEQ ID NO: 2325 - DNA, 1488 bp, Homo sapiens
attaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggggagaagcacagtccctgccaggttgcctgaactaaagatgccatggagcaggagtgtcttggtgcattgttccccgcttaggagtacctttaaaaagggggtgaaataaatttggcttaataattgt

SEQ ID NO: 2326 - DNA, 2116 bp, Homo sapiens
gtaccagaaaaagctgaggaatgagacccatgcaaagtaatatagaaacataacaatccactcctgatgttcttctgtggaaagaggggagaaataatcccaaagcattgtatcaagtgggcagaagtgagatgggcagagtctcttcctgccactgcctgagggagagatctccacttgcagagcatccgaagttgatgaacagcatggcactttgaagagccttcacttactgtggaaactcagagaaattgctttaccctcacagacttcagttttaccatatgtatggtaattggtatgtttgagatttaaaatcagttcatttaagtaacactcccaatggagtaagtcatgttaactttttaaaatcacaaatctgtaagtttggaaaaggagagaggaaactattacttcttaagagttatagcctgtcaggttatcttgcaagctgggaagcacagcctcctctagcagaagcccagagacaggcacttcaaaggaggaggggttggcttggagctttatgctgaaaaagttatctaaatatgcatattcagtaggttacaggaagagctgtgaatgttcataaaggtggtcctgatgaatgcatattaaacaagtatgttacatatgacccatgttcatctcacagagaagactcgacatttaaatattacaatcaggcccagtacatcaaaaggtttttcaggacaggaaggcactcaagtacgcaatctctgtaaacccactagaaccagtccatggtcggtgggcttcttaacaggagaaagttactgaaatcactctcttgtccagtcaaagctatagttatggctggtagagttcagttagtcagcatctggtagggctgcaagtgttttattagtgtttatggtgaggccactgcttgtttagctgctagagagaaagagaatccttgttgcagttagaacctagtttattctttaagcgtaggggtgcataacttaacccttgcctggcatggtaatttgttatgttgctgccacaaagaatctgttctgtcaatcttaggatctctattttaactttaatgcgggtcaattgtctgtaaaccagaaaagggaggggagtataacaagtcgtgtctaacctgctgtcctgtcatggctgggaactccgtttttaagaattttctggggtccccttggccaagagggggtccattcaatctgtaggggaggagtcttaggattttatttttagtttacattctccccttttagccaagatgtgccagaggcaacactgatgaccaaacatttattttgtctcatgtcactgccagggtggtgtcgttacctgccccaggctcattttgttctttggtgggatccctgtggccaagggacttggaaccaaaagacttaaaactaattaaacattggaggccagatgaagatggaggttcacaggcacgcattaacccttaaaaaccttttgagcaacataaccaaaaagcagtgttacaaaagtgacttgtctatgagttctgtgtgttgagccatgagctgtttggtaatctgtatgcccatctttaatttggagggtctgaactaattttatctgttgaaactggcccttacaatctcatgtgcccaccccttctgtgatagtccatgggcctactgggagggtgcttgatactgtattgctttagcagtagtgccttggcaatggaaagcagattggcctagggggattgaatagttttcaaattctagagatactaggtagagagaaaggtaatcttcaatgttttacccaatttctgtaagctgtaaatagtttaaaagaaaaaaggttttattgactctgaaaagcaaaacatgaagaattagcaatgtttatttgattttgaggacatttgtcaaagatgttcaaaggctcaaagcttttaatcaaaatggaattacaggtcattgtaatagttattcattaaaccaagagtaataatcaaaagactttaaatgcaatatggaaagtcacatggatgtaaaaaccttaacccttttaaagcttagttttcctaagtaataaaaaatctaataaagaaaacatgggaattatcttg

SEQ ID NO: 2327 - DNA, 677 bp, Homo sapiens
caatgatgaattgcaaaacgttattaatgaagggaaaaggttcaagccaatattcacactgcagtcaatgaaagagtaagggggcttctgaggaagggttgaagatgacatgggagagtagcaggaacaacccccttcgctgactgtttgctcctgaggcttttccagttttatgtcactcatgtcttctctgcttccgtcctgtgtgctttccattcccggcaaagctgctgctacacgtcgaaagagctgctttacattgtatccagcttttgccctagtttcaataaacgtaacattcagccctttggctttcctctctccctcctcaattgacacttgcctcttgtcagcaagatctgttttatttcctactagcgtgatgataacatcacttcctccttctgttctgacatcatcaatccactttgtagtttgctggaatgagttaacatttgtgatatcgtaaactactacagctgcagcagaatcacggatgtacctgggaatgaggctacggagacgttcctgacccgccgtatcccacagccgaagcccgattgttccatcctccaagaacaccagcttgaatttcctcagcggattcccgaagtctccgcccgcggacatggtggaactagaggagctgtcgccgcctcagcccagagacctcccgg

SEQ ID NO: 2328 - DNA, 1396 bp, Homo sapiens
ccggaagcctggcgcaaggttggtctgcaggtggcctccaggtgcaaagtgggaagtgtgagtcctcagtcttgggctattcggccacgtgcctgccggacatgggacgctggagggtcagcagcgtggagtcctggccttttgcgtccacgggtgggaaattggccattgccacggcgggaactgggactcaggctgccccccggccgtttctcatccgtccaccggactcgtgggcgctcgcactggcgctgatgtagtttcctgacctctgacccgtattgtctccagattaaaggtacgacatttggaggccccagcgagaaacgtcaccgggagaaacgtcaccgggcgagagccgggcccgctgtgtgctcccccggaaggacagccagcttgtaggggggagtgccacctgaaaaaaaaatttccaggtccccaaagggtgaccgtcttccggaggacagcggatcgactaccatgtgggtgcccacaaaaattccacctctgagtcctcaactgctgaccccggggtcagttccagagagaaggactccctcctgcttggaagagacctcacaccgtcatcacgatgccaacggctctgaaggtggatggcattcctgcgtggattcatcactcccgcatcaaaaaggccaacggagcccaactagaaacatgggtccccagggctgggtcaggccccttaaaactgcacctaagttgggtgaagccattagattaattctttttcttaattttgtaaaacaatgcatagcttctgtcaaacttatgtatcttaagactcaatataacccccttgttataactgaggaatcaatgatttgattccccaaaaacacaagtggggaatgtagtgtccaacctggtttttactaaccctgtttttagactctccctttcctttaatcactcagccttgtttccacctgaattgactctcccttagctaagagcgccagatggactccatcttggctctttcactggcagccgcttcctcaaggacttaacttgtgcaagctgactcccagcacatccaagaatgcaattaactgataagatactgtggcaagctatatccgcagttcccaggaattcgtccaattgattacacccaaaagccccgcgtctatcaccttgtaataatcttaaagcccctgcacctggaactattaacgttcctgtaaccatttatccttttaacttttttgcctactttatttctgtaaaattgttttaactagaccccccctctcctttctaaaccaaagtataaaagcaaatctagccccttcttcaggccgagagaatttcgagcgttagccgtctcttggccaccagctaaataaacggattcttcatgtgtctcaaa

SEQ ID NO: 2329 - DNA, 1470 bp, Homo sapiens
aagaattgaagaacagagcaagctaagtctccagattgagagggcccaatacaatctacatctagacacaatattgtaaaattttggaatattaaggatagaaggaagatattaaagtggccagggagaaaacaaatgaggtcatcacgattagctcaacacaaaaatggatgagaaatagactgctaacagatttgtcatcagcaacactgaatgccagaagtcaatggatcaacatcttcagagcttaaggaaaatttttgtacctagaatttcatagtaaggcagactgtcaagaagaacatcaaagtgaagacattttctgtcaggcaaattttcagaaagtctcctttgcacccttactgaggaagtatcttgaggaaattctccagcaaaatgaggatgaaaaccaggaaagaagaagaaatgggatccataaaacagtggaccttacttaggatgtctcattctagagtgacagccaaaagggtatctcaccctagagtgacagctatccagcagactaatttcagatgagagcatactgtctcgggctttctgggaagaatgtgcattcagtgccatagatagtatcattgaagagctgggatgcttgagaagattatttagtcaagaaaaaagaaagacaaatcaacaatatgtcaaaaaattcaggtccaattatagagcaaaataaaatgaggcatgattttgagttattcatgaagaataagaagaggcttgataggtacatttccttttctatggcacaggcatgatgatattgggtgtgtagggaagaaaatatcctagcttatactaggctcccagtaagaagtatttaaatagccaaaataatgtggatatcatttattagtattcaatgttcagatcagcctattaacaaagtgtgaaaggtttcattttttattcagaactgaagttgaaagtaattaatgctgacaaagggaaagaaagcagaaagagattgagaattagaggaagagaagtggaatcaaaggtagagatacttatatattcaaagtggggatgaaaagatcttcagttaatggaacaagaactagaggattagtgtattgttcaaagctataaaatcaaaccaatagatgtattaaaaagtgatgtaactatcagacatttggagagagatggacaaaggaaagtggcgatagtgtaagttaaatccttatcttttgtaatggggaattattaaagatgttgtaaagtcagtaagtcaagaaattattgctcaaacatattatttaaagttagaaagttaccagacgatctaaaataaatattgttaaaagcattacctctagggaatgggatttagatttaaaaagggtgggatgggaaactgtgtttttcattttaagtccttctgtactatttaattttttaccttgtgcatgtattactttgaaaaaatttttaataaacccaaat

SEQ ID NO: 2330 - DNA, 959 bp, Homo sapiens
tttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaaagtacctgttaatataagggatttgtagtatcagcttgttgagcaatgactttgaatctagttttcagtgatcagaagcagcatttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgttactgtcacaactgttatgttttccagtaaactagaagtacgatatttgataattatatttgtatcctaaatttcaccacctaaatgtaatgttgattcctcaagaatgaaatgaaggcactacattgaaatatgttttgtataaatttgtcatgttgaacaacattttagcatggtaagttcccttagctatatgaattttggcatgtttcagagagatcagtaaataaaatattagataaaatataaaaaaaaaaaaaaaaa

SEQ ID NO: 2331 - DNA, 6818 bp, Homo sapiens
cgcggcagcccggcctcgcgcccactcctcgcccggcacacggaccccctccacccccgcgccctcccccactccggagctgtcaaagaagaaaacgccgtgcacacaccttggaatggacgggcgcttcagtcactgactcgccaaactcttagaaggtgtccattggtctgcagggaggtttgagcctggagtaggagccgctttcttattatttaataatgttggaagtgccgggtccgctgccagagttgtgggtcatgtgggcacagcagaggctggctgctgccagtaccagggtttcctgaggatcctgaaactatgatctcatcctcctcatccgcctcccccgcccctctctccgcgggcgcgcacgcacagcacacacacacacactcacacacacactcatgctgaatgcactatcttccttcctggaccgaaatattcctctagggaaatagtgggcacgctcgtcattgaaaaaaaaaaaaatccttcagatagagatttttctcttccaaagcttgatttatgtgctttgtttatttcctacagttttccctcacacgtgcaggagattggaacagagaatcaggtttaaaattaaaaataattattctcttatgttgacccagattttggtcagaacccaagaacttaaacagtacaatttcaatttaaaacagaggcaaaatatacaaggcttgaatatggaatattcttagatgtatgcagtgggtttctttcccaagctgcaaacattccccaaacattacctcatttatttgcagagcatctttgcagaggaggtggatgaaaaggcaaatagtattgtcacttcagagacacagaagcataagtaagataacatgacctatccaagtacacataataagtcagtatctcactataaatattaattgcatagctactcacaggttgctttttcactatgatcaattcccagatacttagtttactgaaaataatgaaaacattgttgattatttttaagttaccaagattgaaaattattttatcttactatatgtatgttttcatataattttctcttgtattatatttccaatttcacgttttcatataattttctttctttttggaggaatgtggcatgtatatgcatacatttatatccaattgcattgtttaaatccttagatagtaatttcaagcaattttagccaatgtttctgaagtagtcaccaatttcataatttgtatatgtcattcaaacccctttcacctggtgtatgtgaagagctacgctacattttgaaggatagaaagaagtttaatataagtatctgtctttagtttacatctagttgttgaaacaagatacatatactgaatgactgcagataaaaacctttattattttggtggtgtgagttatcacaaagaaagtacaaaatacacttattttctttttacttaatttctgttccatgttcaaatcatctcatttgcctatgtgccctatatttcaatctgtcattaaccctcctaccttctaaatggccaaggtaattatgtctaaccttgcccttctcttacactggcaccatactcacataaacagtaaatggggattgttttatgtcgtaaaatttcccagaaggaacactcttgggtagcttctgttcagtgtagataaggaactccagcagctaactagccttctaataacccaaaaagaaaacaaatagtatgaaagagagaatggtcagagaaaaggcagaagagaaagcagtcaagaggggggaaaaggagggggaattaagttacaagataagaaagaagagaaggaaacaaaaggagaagaaaaagaggatcaactttcgtgtgaaagctaaaattttccaaattttggtgcatggaaaacaaattcaggaaattgtagactttcttattgaatttttttttcctaaacaaacttacaggaatttggtggcaatgacaccaggtgttggttctgcagaggatgtgctgaaagatctcaagtttttaaaaagtataggatccgctaaaagaaatatgtagacctattagtatagtgtaataataaaaatgacaatgggatcaaatagccatggtatataaatttttaagaagaaattaacactgaaattaagggagatagatgggaaagcaaaggcactggtataataaagtaggcaatgaagagataagtttgcaatatttaaagcaaaataatattaataatatattttaaagcactttcagatttttccagatcttttcatacatttttatggagtctaataataatcagaagtagtcccctttatggacttcatttttaaagagtgataattgtccctaattttttgtaatacatgttgaatggagaagtactcaaaattttcattcattgttttgaaactattatattttctgatcagtcaactctaaatgttacttagtatatcgtcttccaatacttctcctaaacaataagtctagatggatttctgggcgtagattgtaacagtgatttataatccaggattttacacatgcttttggagttaaactagaagctttagtatgcagcagactctaatggctttgcagcattcctgggagatttctgcaaaagaggtggagggctaaattgaacagcaatatatcaagagcactttccttttgatcagcatactcatagcaggatttgttttaattagagatatatttaggtttgatgattattacatgtgtttcagaagtgcattacaacttcggtggctcaacaattactagcagtttgtgtcagaattccttcatttggggaaaaatatttttaatgtggttatgcacaaacatttatggtttgtactaatttaagctatcattatcaacgaaaatacattcctgatgtttattgttttgctcttacaatttcttgctttttaaaattataattgatatgagaatggccatgggtaaaatcagaatgttcactatattatgttaatagtaaaactctatgtgtgtacctatggtttaatatgtaatgatatatagagtatacatgtgctttgggtcaaatggggatggttactattatctataaactgataatagtttgggggcatgaggaattaacaattttggagtatttaaatgattcaaaagagttgaaaaaataaagacactgctattttatcaattagaagctcttaccccttggatgtagactgtttcagggaagaatggggtcttgaaaaacacaaaatatacataaattttgcttccccaaccgactggttagctttcaagaatgagaagtatgttagcagtcccacacgggtcaagaaaatagatcaactgagctgtggcgtggggaattcatggttagtttttttcttatgagcactaccaaattttgaggctaaggtgggccctaggcagaattatgaagtagatgaattttgtctccctccatttttcccccaatgtctccttcttcctgcagaagccctgactgcctttgggctcccagggatagtcagcaaccccttgctgttctctcgcttttccgaatacccgcattgtggaactcatcagcagtgtaaaacagatatcatgttctgacctcccctgaaatgtgtaaatggtgtcctaagtattcatgaaacctgaggggatgtgagtatgtgttcatattaaaaaacaccaagggtgtctgtctattcagtctccttctgcatcacttcaagatgtatatttatataagtttaatatgtattcgcctatgaaactcagcattaagacatggccctgtcagctgttagggggtaattgctaagtctaagagagccgaggtagtcttcctttcatcccacctatgctctgtctccttagctagactgaagccccctgcatatgagcagggcctccgagctcggcagtccctggcagtgcctattatggtgctctgttgtgatgtctcctttgtcgatcttcctgtctggctgacaacctcagaagaaatgttgtttccattctccacggtcttctcaaactgaaggagagaacctagcttcagaactggtgtaagcggtcaagtgtattttgtttcttagtgttagaatgaacaaatctgttgacattctaaatggctgtaagtccaccttataatggcaattcattaaatacatattatggtgattcacatctctcaatggcatcataccagcatgccctttactcctgggagaatttattttctcaatggaccataaacaaaatacaaatgttttagatgaaactttaatgcactgtcacggtgaagccacagcaggaaaaagccacctggagaatagcttttgagaaggtgcttataatctactcactttactgctaaaactgtttttaactctactttaaattgctttttggctgaatgtgtgtgtgtgtgtgtgtgtgtgtgtgtgtgtgtgtgtgtctgcccaagaatacagaatatcttgatacatgtaaccatggattgtactgaataaatcagaaatatcaatggcaaatactggcaaataaatctgttcaacatagatgacttatccaaataattaaagaccagaaaacccctactacttattgcacattaattatctgaatagctgtctacttatttcaggaaaatgtcaaaattttctttgatgttttctgaagaaaacctaatgtttttaaaaaataccaaagaaactgttacaaagtgaaaagcttagtcaaaacaattttatttatgaaaaatcagcttgactgatttaattttttcctgctgaaatgattctttacatatcaggtagatacagcccaaatctcttgtagaccatcaggaactatgttaacaagcacacattttaatttgaaagttaattgctacagcaaataccatataatttatttgatgttgagaagccttatgtgttatgaaaaactaaatgaaaaataaaggagggaggatgaagctaaactaaccaatttgtcatctttaaaattgtgtagtaaatatgtgggtagatccataattaaaacttattgttgggaaatagaatattttagcctttaggggatacattttgagatagttcaaagtgtatttatatgtgtaatgatttttctaataatatgcaaattttctttgttaatcaagatgcttgtattttatatgtgccacaaatatcacacaagattatcttgatctttcctcctttttgtccctgacctgcatcaccagatcagcttgaacattccaccttgtttcagtgctttctcatttacatattgctttaacttcccccttttttatgtcaatcaggtagtctgaaagaaacagggatagcagggattttacatgttttatcataaccaaaaaccaaaagctttaatttgtacccagttcttagtctgtggtcagcattgtctttgctgctcagtagacatatctgaacatttcctgatattgaaattgttgctattttcatttgcacatatctcaagaagcattttaagattctcaaggacagtgcttataatgaaaaacattctattacttttttcttccctagagaatcaagcatgtttatatcatgtagaaggttcttggaaaatgtttataagattaggatgatagaaatatttttaaaaattacttctggcattacacagcatatggaaataattttttgagcttgtgaattcctttgacagatcatgtttttatgttttatatgaacaagatgaactggataccttgtttggtttgcttttgccattggggtaccttttggtttgtatgtttaaaacacatcaaaaaaattttggatggcagaattatgtatatggaaaggttttcatttaaattgtgtgatcaataccacagccgtctacttcatactgtaatgacagtaatttaatgaaggaaaagaattgtaacttccctcatttatatctgtgtcttaaacgattacggtaaaagactgtgagcatttaaaaaatattttatatagccagtcatggtgttgcatgcctgtagtattggctgcctgggaagccgaggccagggatcacttgaactcaggagttcaaagttacagtgagctatgatcgcaccactgcactccagtctgggtgacagagcaagaacctatgctaggatatatataaaagaaatagtggatagtttacgatcttttgttttttatttcaaagaaaataaaaacaatttacttattttatagtagaagtggagtgaatactttaaggattatggtacataaagtattccataataaatattccctctcattttcttaccatcattcaaagtgcatccttcagcctggtgttattcattttctttgagctcgtatcaaagacttactcatggaaacactatcttaaaacctattcatataatgtgccgtattgttgtctaaccatttcatgtgtattagacatcaagattgtaaacttctaatccaatatatcaactgtacatttcacagcatcttgcagttattctacaaatacttgctgatagctttgttgattaactgaaaatagactgctattttgacatgacactgccccaaaattggaaagagtaatttcttctctatttattattaatctctatgagtttccaaatatttaaatatattcctagtacagcattaaagttgtttataataatgtcataaaattgataacaagttttgtatctgtatttatacataagtgaataaataaaaattaaaccaaaa

SEQ ID NO: 2332 - DNA, 539 bp, Homo sapiens
gcgagatagtccagtgggcccacagataacgaccatcagagattaaagaaggaaagtcagcgagcttgaacacaggcgtcccgtgtggaaatgtccaaggagaccgccagaagtgcgcaagccggagtcggctagagtttccttctcaccgagagggggagcccggcgttcccggccgggagcgacccggagtccccagccccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcctctctcagtgagcagcaagaattgaagacttaagggtttgagcagatggttttctacctaaattgaataattcaattacgtattctcagct

SEQ ID NO: 2333 - DNA, 623 bp, Homo sapiens
atactgatagcaaaatgggtctcaccttcaagggttttggtagaactgagggcaaaggtttcctctttctcaaaggtatctcccacctcttcccaagcagcagcaaagttaggcttcagtactttctgaatatggtcagacacagtcacttcgagatcttccagctagtgggtaataagcagtcagtaaagaaaagtcctttctgttatagggcaaagataaaggaactagtcaatatggtcctccggagcctagagaaaactctaccaccaaaatagtttaagttctgtagtctggataaatctaatgttgtagcccttagcaaaggaaagcaagaaaacagaacatctggcaagagcctcagatcaacatctgtagccctgaggtacagagtagtcatgttgcacccacacttgaccactgagttctgggcacacggtaccctctgatcattcactaagaggttgatattttttaaaaaaagttttccctccattctgtgaaggctttttaatccatgatctggctataaactaacagctgctgaagcaaaaacaaaaaaccaaaaaacaaaaccaaccccctccccaaatcattttaaataaaactgatctcaatgaaaa

SEQ ID NO: 2334 - DNA, 4060 bp, Homo sapiens
ccgccttcaggcgtttggactcagtggaggttgtgagtgcccagcagtgtggcctgaatctccgtggggtttagggagacgaaaggaccccagatcgacgtcccctcgttcccactttggggatcggcgctctggctgtttcgtgaaggagagagaggtgggtctgaactcagagtggttttccagatgggaatcacattgctctctgtccctgagatcttgctggagacagggctactcagtccctctttgccaggtaatctgttccagaagaaacatgtgtcgttctgactgagcccctgcctgtctgtcaccttaagagccagtcaattcatatggtccccatatcaaagtctcctgtgcccagagagaggatttcatttcaaccatcaccatcaccaccatcatcatcatcaccaagagatgttgttgaattgatactggaaaagcagtttctattgagcccccaaatgaagagtgagtgcagatgaagaggaggcaggactcacaagcccttgaactttattccagatctgttagcacctacaggaccctgcaccaggatttcatctgtactatcagcttcttcaaagagagagaggttgttgagtaatattttcagtccaagattggttgcattcatgtatgcagaatccacagatacaaaaggtcaactgtacttatttatttaattctcaccacaacctatgagaaggatctattgttgcctgactttagaaaaaaggaaactgaggtacagtgaagacagagttagcaagtgccaaggcttagatgtgaacacaggctgtgtggctcctgagtaaattcatctatccagtgtgtgctgctgcctctcaaatgatgagaaaaatcttgctttttcaggccgggcacagtggctcacgcctgtaatcccagttacagggatcacctcgtgatctcagtgatagataacaccaggtattgatattggaaaagcagtttcccattgagtctcaaatgaagagagtgcagatgaagaggaggtctcttcatgtggatgtctgagctcatatcaggtgtctgaaagaggcagattctgaggatttgggtcatgatggctgccaaagcttctactcctgacttaaagggcaacaatcctaggagaccaccagcacttacatccctggtaggacatgacacctgcttatgggctcagaagtgacaaaagagaattatcaggatggcagtccttataaccagatgcttatcaacattcttcactacattctgaagatgaatttctacaagggaaattgtttatgtatttgttgttggggatagataaggaaagaagaaaaaggctctggtgagaaacccattgtaccttctggatatgatcactacccaattttatcagtgtcattgatcactaacccagtgcctcgtatggtgccaggcacagagttactccaagaatgtacaataatggctggattctctttctccctgtgcaactcttcatgcatgtgactgaacttatattaagtgtctgaaggaggttcgttctgaggatctgggacatgatgggtgctgaagcttctactcaagatttgaagggcagctgtcctcaggagacccctggcacttccctccatggtgggatgtgatgcctgattccagtgagttcatagagctgaacaaaagtacgttgtggaatagctcctgtgaggttcacaacatagtccggaagatgagaaactactttttttagtaacctggattcccatctaagagatgccttactttatcgtaaagcaatgagttgttcacttgaggagggaacttcatgtttaacatgtatttgcaacaaatttacatacattttctgcctgtatgaatagttgtcagtgatgcccatgaatttctcagatggatgttgaagtatacagttagaagggaggcagcagatggctgaaattctgatccgatgtggctggttaatgcatgatctgaaaacccctgcactggtgattttgggacagatctagaatataccaataaatatattaacataccaagtagtctaggagcagccactgggcgaacaccaaaccttgcatccctgctgctgtctctgagctcagcagacacgtctttgcagaagagttctataatggtggtacaatggtgccccctcgtgacagaagcttgaactacagcttgaacatcggtagatgaaaatatactgtctacgttgttcaacacaatagctaatggcaactgtggcagttgaacacccgaaacgtgatgaatgtgactgaggaactgaacttttagtttcattgtgacatgatgaatgaatttattgagccccaggaagaaggaaaattaaagaagagcaaagaataatagctggacagaagatgggggtcattgaacctatatcctagttgccagaccagtaaactgaccatgggacctggggtggaggcagcagatgaccgaaaacctggagtgatgtggctgaataccgcatgatctgaagactgcactggtggctgcggtataaatgcatgggggcaagatggcagataggaggcaggaccagcttgcagctcctgctgagatggacagagcagcatgtggagactcgtactgtaaacctttgctccaagaagtactgcaggaacataccaggaaagctgagagaatccacagaccctttgaagaaactggatcactgttgcaggccccctgagatgccgaaaaactgtgagtctgcttgctttgtcagtggggaagctggtggtctgggacaagttctcagccctggtcactggttgccctgaaatagactcggtgctgttgtagggcacagtgggaatgacaccagcctttagggctgcaggctgcatgggagcagggtgaggcccatgaccgctgactttcccccacttgctggcaaactgtatggttcagcagaagcagccataatccccctgggaatataactccattggaccagacaccacacccccatcccccacagcagtcacagcaagccacacccaaggagaggctgagctcagccatgcctatccctgcccctaccgggtggtctttctctacacaccctggtagacaaagaccaaggtcataatctcttgggagttctatggccctgcccaccgcctgagaaatctgaatacttaaccagctgtccctagggaaagttggcatcctctctgcaggaccacaactgatgcactcttgaaatcaccacctcctagctggaggccaaccaacacaaaactagcacactaaaccaaaatacaaccaaggacccttacagagtccacttcactcccctgctacctccactggctgcaaaacctgaagatggatcacatcacaggactctttgcagacactccccagtaccagcccggagcccagtagctccactgggtggctagacccagaagagcaaaaacaatcatgacactttggccctcaggaagccgcatttataggggaagggggagaacaccacatcaagggagcaccccatgggacaaaagaatctgaacagcagctcttgaattccagatcttccctctgacatagtctacccaaatgagaaagagcgagaaaaaaatttctgctaatacgacaaaacaagtttctttaacacccccgaaacattgcactagctcaccagcaatggatccaaactaagatgaaatcttggaatagccagaaaaagaattcagaaggttgattattaagctaataaaagaggcagcagagaaagatgaagtccaacttaaataaatcaaaaacgtgatgcaggatatgaaaggaaaattattcagtgaaacagcataaattaaaaaaaaaacaattacaatttcgagaaatcggggaacatatagagaaatgcaaaacgcactggaaagtctcagcaatcaatcgaacaagcagaagaaagaacttcagagctcaaagacaggctttcaaattaacccaatccatcaaagacaaagaaaaaagaattttaggctgggtgtggtggctc

SEQ ID NO: 2335 - DNA, 5034 bp, Homo sapiens
gtttcttcatctctttgtataacactttaccatcaggatcttctaatcgacaatctacatcatagtgaccaccagtaatcacctgtaagagattaaaaaagaaaaatcactgtgaaaagtgtgaaaaattaatcagatttaatcagatttcctattaaaatggcaataaggtgatgggcaaaggacttttactatctttttaaattttcaccagtggatggaacttgggagattttacttcaactaaactttacagaaactgaacaagtattctccaacttttattcactttgaactagccagacaactgtgctaattaatggagatctattagatcacttaattctcccagcaaccctacaatatacttttttccttccatttgacagactgaaaaactgatgttaaataagcgaactattcaagactgttcatctaaattaagtgggaaaggcagaacttgaactccaaagtcatattcttaacctctaagcttactgcctgcaatattttccttctgaaaattttctaacccactttcctattagcatcatccaagcacacacacagtgaagtaacaaggtaggccaatccttaggattacaccccattcatacttctatcatagaacttaagctcattttactgccaaattacaaatagattacatttattaagttcttttatagtcagttatatggaatttgatatacattttgttttgaactacactataagttgagtaacggagtgggctattctaaaagtatataatcatttacaaccttgttttgaggagagacacgtaactgattaaataaaatattgttgaaactcttgtgattaaagcaaaaacaaaataacatgaaggacaacaagtctgtttatctagaaagccagtacttaatggcaaacatactgaatggaagcctggaggtaggtgatatgagtctgaacagaactgtggaactactttccacggcttatgcttaatcagttacaattccagccatttgggttgtacagaggagggagagatttttcctgcggtaactggataagtattgtaagagacaaaagggggaaaggattaaagagaaaggcttccttacatgagaaagaactgagtaggaagaaagagggagtgcagagaggtgaacagagtgaacgtatacacattgggttgaatgaagggttcccaaaccaccatgtgattggggagcacaagattgttattttcaaccttgaactctcttggttagcatcctgacattctaggtcaaactttggatttaaaagaaggatctgtgtgaccttttctcacttgagagaagatgactaatgaactatgttacatatcattttgataatctaatgaaaataattatgcacttatgaaactgtaaaaatatgtaaatgttaatatacagataaaatgttttgatataaaagtgtcttatcaattggggatttaccaatccccatcctcaccaaaaagtcagtaactttttctccaggtgaaaataacttcattttgctatactgaattatacgtatttgaccattgtattctgaataatcaaacacatacatacaaaccgaatagcaccagaacttatcatcaccccacttctcttccatcaaacttaaaacaagtaatctcacttaacagtatccctttaaacctgtccaatcacctactattgaaactgaggatcatcccaaactaactgtccctatctatccatatgatcacacaaatctctcaatctttttgcccctctcaaattcatcgcattccgaaaccacaatccagacaggactattgccacaacttcctaaaaggtcttcccactacccaatatcttctccctcgaactcagggtttctcaacctcgcattattcccattttgaactgaataattctgtgttgtaggaggctgtatggtcctgtgcactgtgacacgttaaacagcatacctggtctctaactactagatgcaggtagctgcccttctcctaaaatgatgccgaatgtctcctgggaagaaggggtgcccatctccccatctttcctcattccccattgagcaatcacttaaaaactttttgataattacctgtggcctgcagacaaatctaaacctcttaacaatggtatactattcacatgttcttcctcccaggtagcttcagaacctcttttattcacacccttactcgttctatgttcctaaaataccagactaccagaaattctctgaacaagtctttgctttacatctgcactgacagtgcagttcaacagggtttgctaaagaatcacacggatcaaaatgacagtgtttgcaaatctacagtttattactgtaggttatgttataaatctacagtttataacattatacgactatatatgtctatgtaagctctctgaggtcagagtcagtctctgggaggtagtataataaagtggctaagaatttaacttgggactgaaaagagccccaaaaggaaaagaatataaaacattacagccaaaggctgcctcacagcaagagatctgaaaaggtcaggtgtgggctccttcggcttccctttgttaggtgtgtggccagacatatactctctcagatctggaaccacccaagtgtgcaaagaaaacaccctggaaccaagcaacccaaaatagagtcctgattgcatttttaaatattttgctggtcacataggcatattcctgctacgcagctagtctcaacaacagagctctgggttgggggtgtggtctcatgaagaccaggagcaaatcatcaatctcattgttaccaataaataatgttgacaaactggtacaaactgcccccaaagcccttggactcacagtcacaaagctattataatagcttcatattaaagctaataataatagttttgtgactattaataaatataactatagtcacaaaactattattattcagtgtattttcaatgccatgcacaaatgttagcaatatagctcaggctaatttcaggcctgctggaactgtcatgaacatatctgcctggggccccttcttctctcctctgccgccttgtagagcaacggctacttatcttgcagactcacctctaacatcagctcctcagctaaatgtcccctgatgatccttctgtctcctgccagcactatacctagtgtgtacctttattgtcacatttaacattttatgactatatatgtctgtgtaagctctctgagatcaaagtcagtctctgggaggtagtataataaagtggttaagaatttaacttgggactgcgttactgatttagctacttctacgttttatgcccttggttcttagcctatctaaacctcagtttcatcagtaaaaaaggagtaagagctataacaatttcatatcgggctttcctgagaacatacctgaaatgcttaacatactgtctacacataacagatgctaatttgttagccattgtagtagtatccttagcactaatcactgagtctgcatacacaaaaatccaggaaatgtttattaaattcaaacaaagaaaatgtcggcttatactttttatcacaattcctgctatcttcttttctgtcccctggtgctaatccatgaaggtaagtaagcctaagggtcatccttggcctcccctccctgacccactatagccaaatcattaccaagtcctgttgattctacctactaccttctctccaatcctttcacttttcatttaccccactgctatcactctactctaagccactatcatttcttgtctagaccaccataataacctcctaatcagccttccacatccgctctgcaacatcttaccatcacttctctacctgcacaagttattattaatgcagctaccaagaatattctcgtcatatcactgaactgcttataaccctctgatggcttcctacactttcaggaaaaacaaatccttaacatggtcagcaagacactatctggcctgcccctgctgacccccttgctctggctccttattcccaaccatattggacctctctctatggccctgaaattctcagtgttcactactaccacaggctattccccctcctcccttaccaaggtgtttatagctcatcctttaaagttcagcttaaaataattttccaaaggaagtcttccttcatggatcctacttactgctcttaaggcacagttctgatgaatgagcagataccagttaagaaaagcagggtgagaggggaatcatgaatgatggcagtgaccctatctgtttcgaccacttctgtaccactggcacctagtattcaatagctactcaaatgttaaatgcgcctaccaaccaaaattgaagctcagtaaagactgttctaaccaaccgaataaaccacattctgttaaagtttcttttttatataatcccaaatatcagaaggggcctctcatttatcacagcaattctttctacaactcccttggcaaatggccgttcaacctgtaatggagctcttccaatgacaaggaccgtattaaccaacagtcctaatattggtaaaactgaaaagcaatgaagttagacattggcagcactccaaatccaattaaattggaggtgtggattagagagtagagggttgacactgggtactacagagtataaatgattttctttaagggaatcttttaaggaagaaagttcaataggccttaaaaatgagatggaaagaaatgctaaagggagcatttctggaattcatatattttaacacccggtcttaacatctctcacccaaggtttattagaggaaagtcaaatgctgggcatcagctacctagaagcgatttttgaattagcctaagaacggggaaacacggacaggaaagtgccatccctcaagttacacccccaatcctggagccgcgagttggggcccagggactgctaggcccctgatacctggaactccagggtgcacttggtgccctgag

SEQ ID NO: 2336 - DNA, 8150 bp, Homo sapiens
gtcagtctggaggaggcagccatgtgtccatgaatgcttatttagtacggtgaggacagatggcctggaattgctgaagaagaccttaagatatatttaaaagaggaaagggaaagaaacaataagggaggaaataaattagagaagaggcaaatgtgtggcaaagaaaagtacacacacacataaacacacacacatgcaagccacatgcacacaaatgcagacagactataaagtggattataggactgtgtatgtcctacacacacattatatgtcctacacgcacagtgatgaggagtgacaaaatgaagactccagaatcctctttatcagatcctgaatgtgcactttctgaagtgaagtccactatgtgctgggcacacagagaatagagcatgaaacaaaagcaacatgaccctgccctcaccaagactacagggagtgatggagcatacaactttgtttcagaatgcaattcagatcttccctttcgcttggcttcttaaaacttcttttgaggatggtaaaatttcgtgttatattaaatttcatcctgtaactgatactctgggatgatgttggccaataactagcaagactttaaataatcaactagtttaggcattgcttagcacgctccagctgacttcacaagtaaaaccatgtgaagaaagaaggttttcaggtaacacagatggaggtgatgatctttctcattttgtggaaaatattaatttctcattttttattcactgacaattagtaaaattccttactctacctaatatgtagacttctgaactatgtgaggaaactgaagcacagacagagtacataactttcctcaggtcacagagctagtaagtacggaagtcaaacactgccaggctggcttgatcaatcgtgactaagtatgtcttgcaaatatttcccaaactttacactttctgttctatttggtttattattacatgtattacaaactaggtttcatataatcaaatccattgattttaaaatactttcttttcggtatacagattatttctcaaggccaggtgtggtggctcatgcctgtaatcccagcactttgggaggccaaggcgggtggatcacaaggtcaggagatagagatcatcctagccaacatggtgaaaccccgtctctactaaaaatacaaaaattaactgggaatggtggcatgtgcctgtagtcccagctactcaggaggctgaggcaggggaattgcttgaacccggaaggcggaggttgtggtgagccgagatcacaccactgcaccccagcctgggcgacaaagtgagactctgtctcaaaaaaaaaaaacaaaaaaacaaaaaaactacttctttatatgggaaggtaagcaaacaactacacaaagacattttgtcaggtatggtttatgtcattattgtttagaatagcaaaacattcagaagcaacttaaatgtccatccactgaggtgtgattaaatatatcatgatacattcatacacagatcttatgcagtcacaaggatgagaaagctgaatatatatttctattgacacaatttagtcactgcatattgataaaaaggaatgcttttgaaatagaagctcacctatgttttaaaaacatatgtgttgtaaatacatgtttacctcaatctattcatatatgagtagaagttcgtgcttggctgcttatctctttttgaaaacatttttaacagagaatggattactggtgaaaaaatactttttccaaaaaatttaagggctgaattctagccctaactttcactaatgcacatggctctttgattaaaatcaagaaacactcttatttttttaagaaaaggctttctttactaagagatcaaataaatattcactttctggctgatagtttttctgaaatacacatgattgctattttaaaaatatctttttgtgtctctttagatatctcttaatgcactctaggtgtcaaatatgagcaatctgtttgtaggagagaatggctccttgctccaataggtagatctctctaagaatcctcctaacacactattgttaacttataaatatgctcaggcacataataggtacttagtaaatatatgttgactcttgaatgaagagctgattggagtaatgaaaacagcctgtgttagtaccctgaccgaagtttagacttaatccccatatagataatttcagaaatacattcttagggccaggcttggtgactcacacctgtaatcccagcactttgggaggccgaggtgggtggatcacgaggtcaggagtccaagaccatcctggctaacacagtggaatcctgtctgtactaaaaatatgaaaaattagccaggtgtggtggcgggtacctgtagtcccagacactcgggaggctgaggcaggagaatcacttgaacttgggaagcggaggttgcagtgagcggagatcgtgccattgcactccagcccgggcgatagtgagagactctgtctcaaaataaaaaattaaaaaaaaatatatatatatataattggaataattatgaaacatgtacatacatgcaccaaaatgtaagcttgatggtaaagatatttattgattagtcactgctgtatcattaggaccgaggtcactgtctgacaatagatactcaataaatattgtttaaaaaagtaaattaatagtttacatgctatataaaataacccgcttatgtaaaataaaccattttttcaaattactagaaagtaaggttagttttattataattatctcacaggttactaaactaaaactgatagaatttaagtaacttgcccaagcttttacagttgggaaatgctagatctgggatctaaagctcctgggatctaagtgtgatcttagagttcatgtaagcaagctgtacatcctttctttacataccactctggggctgtgaggaaaaagagactataataaatattttgcactgttttattgctactcaaatgtcctttcattcattcatttagcaaatcttcatggaatgcttaccatgtgtcttttttagaaactgggattggattacaatggttgaaaaaaaaaataggtgaagttccccattctaatggggaaggaaagaaacaacaaatgtgccaactagggactaaaaaaggtaatttaaaaatctgatgattgttctgaggaacctttaaatgggttgatcaaggatggctccaagaagggaaaattctccactggaagctctgggacagactgttagaggcaggaccaaatagcaagggcaataaacccagtgtgtttgagtattttgaaatggctggtgtgcctggaacatagtgaaccgggggaagtgggagccagatggcaagtccttcaaagtcatttttatttatttgcaatacttaaagcttccagagaatgggtgtttgatttgggcattttaagctgatttaagcctactgagcaacaattaaaaatcatttaacctctctacccaaacatttgagttatttcaattttcaatgatgctttaaaatatgaagaggaaaaatagagatagtataagttaacattatgaaccctgtgaaagaagaattcaaaataaatcactagggatgttagactggctaaagaaaaggttgcttaatactggcattggctttcaagagaaatcatggaatctcccctctggagatagtttaaaataggattagatatattcactcagtgcagccttgcctgaaagctccattgacctcccaaggtcttgccagtcctgtgattctgtgataaaattagaccctttcattggacaaaaacaacccagggttcaccatgccagctgcaacctggaataattggaaggaactgattttggagtagtatacctcctagagttgagacaagatgcaattaacagatccccaaacctctcctatttcatgctgtactgagtactctgctggttctcagccaataatggctggtatcaatgatacaagcaaagtcaaatggtctgatccatgattaaatagtagatgtctttattagctgctgaccttgctttgaacagtatggcttcaagaattgtgtgcctattagctgattctttaatccctgaaaatagaaaccagatgaatccaataatgcatttttatttggcctcttttccaccattctcaagacgaaataactcaagttcctatgccatgagccttaacctcattaagcaactcagctcaacagttcagatacttaatctgcaatatttacccattgcattttctcatttaacaatcactgctttgaagaaaaattcaagtaaatatatatatatatatatatatatatttcttttttgttttttcctgacattctcatttagaggcaaataggcagtgactagagcacaactctggagtgaggcagacctggggttaaagctgtctccttgtgacctagaatgtaattattaacttgaagaagtttccaatctctgaggcttgctttatttatctatgtattagggataatcttattacccacctcatggacttgatattaggattaaattagctaatatataataacatacttctctttcttcatcttctacattcttctttatcccatctctgatgattatgttttcttgcttactgttttttctttcacttcccaccttcaccatctgctaacacacacacacaaatacacacaaatccagatgtgagtccatgacaacagggaccctctgacagtgcctacaaagagttacacataaatatcccttgacatacatttgtggggtaaaggaaagcatcaaacattttgcacactggtacctggtatatgatgagcattctatgaaaggttaactgatttttttttcttagaaataacagattcagctatatctatcagtttattttgtcatctgaagcagcctgctgtcaagaggaaagtgagaggaacatgcacagtggacagaacttggttctggctttgtaacaataacgttactgtattttatttattttttgagacagagtcagtcggtcgctcaggctggagtgacatcatggcttactgcagcctcaacctcctgggctcaagtgatcctcccatctcaaccctatgagtatctgagactacaagcatgcaccaccatgccttgctaattaaaaaaaaaattatttgtagatagggggtttccttttattgcccaggctgttcttcaactccttgaacttctcttgcctcagactcccagagtactggcattagaggcatgagccaccatgctcagccacaataatgtaattttggacaagccattgcatctctttggtttccttccatatgtgagatttcatattcttattactattgcaactgatttttatgcaactgcacattataatccttagtaaaaggggtataagagactaaagaaaacatgtagttatgctattaaatgctctcagaaccatcccctcacattctgagtatcctcagttaacttcattgtagaatgaggaaatcaggaaacagagagattgaagaatgcataagtatatgaaacattcccagtgagtattttcactactttcctatttacctagtcacaatccacaaaacacaaaagaggagaaccctcaagcttggatcagcagggagaactgagcagctttgtgttcgttcttggatatatttgtctttcttgcaagccaaaatacctccatgtttgtgttctagagcaaatgtttctttagtctctttcatagagttcccttttcttctttatttactttacttattcatcatgtccataatgtacattcagacctcaagtattggctaggacaaggctggggaggaaagcacttcgtggcatgaggttcacatttttgaaaggaggatcataggaccctggagatttagacgttaacacagctcctttccattttaaattgtaaatatttatgcaaattcaagatgaaagaatatatgctagtttgtctttaaacaagtaaatatctgaaaagcttaagaaggtgggatggatgctcatgaaagggaaaggaaaaaggcaaaagggcggaagaaagacgagaaaatgaaagacagaaagaatgtgtaaaacaggaagaatgtgaaagacaaaatgaaaagacttctcaaactcaaaatggcaagcaatatgatcaacaggtagaactaataactagaaaagctgctttaagggcaaagtttttaatactttttatttatttatttattgttatttatttttgagatggaatctcactctgtcaccaggctagagtgcagtggcatgatctcagctcactgcaacctccgactcactggttcaagcgattcttctgcctcatcctctcaagtagctgggattacagtcacgtgtcaccatgcccagctaatttttgtatttttaatagagaaggggtttcaccaggttggccaggatagtcttgatctcctgacctcgtgatctgcctacctcagccttccaaagtgctgggattacaggcgtgagccaccacgactggcccaagtttttaataattttttgaaactttttttttttcagaatttagaacttggatggtgatttgattggggagatgttttgaaaagggaaaaaaaaatgaatagtagaaatgtctaaagatgctgattaagaggaacaacaaagccagatggcataaatggcatctttaggaattttgtggcataagaagctatgctaaaaagttcccctctgtcctgaatgtggtgcagtcacacactgagcatgctctgtgtccttagttagccacatgaactcacttaatgtgctcgaccttaaaacctctacctttgtcttagcgatttagactgtttgttttttagctgttttcagtacttcatcaagctgattttgttgcccttttagaaatcttaatcagtaaaagttgtcttctttgtaaaacagttatggcatatctatactctagaattttaagcagccattaaaaagaatgaggatatctacatgtattgaacttagattaggttaaaatatcaacttgcagaataattggtacaaacctattttggttactaacagtaacatgtatatatttgtatcattatagcaagaggtagaaaaaaatacacataaactactagctttagttttctgcaagacagagagggtgtagaaagcaaagggattattaatttttttcttcatatttctacattgtttatttgttataataatcatgcatcgcttttgttgttaagataataatgtggaaaactatttaaagacttccttacagttattatgtaggactatccctttataagaactaatattttatgggaattatttggaatatcattcatagttattccctaaataattatcatgctagatatttactccatgcatgctttaaacactgagtcagatgctgcaaactgtctattcaataaccattctgccattttccttactatatgaaagcttataatagtctcagaggcaacatggccagcataaaagtagaacaacagaacagaatgaaacataagaaaacagaaacaaacaagtagaagctcaaatatccacacaactaaaagtggcgatgataataaaatctggctctggtgacataagcggaagttgttgtgtggaacgtgcaggaggactccttcaaaaggaatatggacagggagtgcacacttttccagccttcttgtctcattccttcttgctgccaggaacaatgacatgagaactggagcgctaacagccattcagatcatgaggcaacattaaggatgaaaaccacacactgaggatgatggagcagaaaaaacggagagaaggagattttctgaccatcccatggtgccagttgacacacctggactgcctacttctgactctcttgtatttgaaataatacattttgttgtgtttaatcactactattttggattttctgttgtatgcagctgaatttagttctaattgatgtagacaagtctgtctgtaactagatgcatgtggaaaataaaacttttatgggaaaaatac

SEQ ID NO: 2337 - DNA, 606 bp, Homo sapiens
cgaaattactggaattttatttgcctcaggcttatgacttgcaaccaaagacattgtgcaaagaaagcaaagattaagtacactttagggagaaggagacgatacacattggtaacataggagatcagggtgacaaaagaagccatccaatacactatatagattgcaatattcaatagcgctttcaacaaaacttttttttaaatcaagagcaaaaaaattaagcaatgtttacagtagacataaatcttatacaattcaaaaagcttttgttcagatcatagagcataaaatggaaaaatgtatatgcaggtgaaatctaactactgtacatttatcacctattaaagttgcttatatgtaccacagtgtaaaaaaacaataccgaacaaataaaaacctcgaaaattgcctgatgaaaaataaaataaccagtggcttttaatggcttctcctggttatcagtgctacaaaagacaaaaatcttctcatctgaacaggtgataaaaccaggcacaatcaaaccgttaccaaattagacccacccatagaaatatactatccacccacatattttccatcaaaagctttttgtttgtttcaatc

SEQ ID NO: 2338 - DNA, 2635 bp, Homo sapiens
acgccacggcccgccgggccccgcagggagttcgaaggcttcgaggctgctcccatacgcactggtggaaggagaggccgcgctcccggctgagcacggtgtcacgggtgctgcagcccactgcggagcaacttcgggtcatcttcttgttacgtggggccccaccttcggggttcccgcgacagcatgaatcacgaccactttagctccgcccgttgactctgcggctacgacctttatttgtcacgaaaggcgggctttagaggcgcgggacttccacacttcctctccgaaggccctgcgccggtgccgtagccaatgacaggccacgttgtgtcccagcagccaatcggaagggcctgagcctgaagacgtgcatttgaccgctcctccctccgcgttggaggcggaatagtgggttttgctgcaaccggtttattttccttctgttttcacccattctggcacaatctggcgccatcgtccttcttgtgaggccaagcctgaaaatgcgaagcagagaggcaggaccaaaattgaggcgaatccaggaacctgccaatgggtctccgggtgcggtctctgaaactggaggatatcgggaggaaaggctctccgatgcggagataatggggaagctcttggcatggttggctgtaggtatgtgataccggaggagcaggagtcaaataggatacgccgacttttaattcaaggaacccttttctgaaacactttgccacaatgaaggaaataaggtaaggttcttggggctcctcagtagtaataggggcaggggacaaggggcaattaagtggttttggttgggaatgaggcattatgaatagctttcaggagatagagcttagaacaatgtcttagttataagctcttatgtttgaggaagagatttcaatttgcttagagaaggaaacgggccagtgggtttttgtctctgagaaggagatccttagcatacagaaaacagagaagggtttgcaacttttccgtttctttgtatagcacacaaaaataattccaaatatccaggcctaacaagattgcttctttttcccctttgtgtttactttgtccagattacagccgaagatacatattaaggtattacttattcacaccagttttccattataatatgcttgtatcttctctgaatggaattaatagcttttggttatggttccttaaaagtcacatggcctaaggatagatggtcaaggaactttggaaaaattggtccctgggggatgtgcagggcaaatactttttggctgtaaggtgtgtgcagagagtaagaactggatttaaatactgtaagttggttgggctgttagagccttttcctgctcaaccaattaagacccgagtgaggctgaataaaaataacattgtttttagctatctttaaggaaaaaattagttgccttatatttttgtaacagttttactcagatataattctcataccacacaactaattggtttaaagtgtacaattcagtgggttttagtatatgcacagaattgtggaacagtcacaatcaatattagaacattttcatcactccagaaagaaacctcattcttactagcagcacctccaaatattcccccaccccgctcagcaaacactaatttagtttccgtgtgcctctgcctgctctgtacacttcatgtaagtggaattatgaactaatatatggtctttgtgactggcttctttcacttggaatgttttcagagttcatccatcttatagcacgtatcagtactttattttttattgctgaatcgtactccattttatggatgtagcagattttgtttatccgttcaacagttggtggacatttgggttttccaatttttttttttactattatgaacatttgtgtacaagtttttgtgtggacaaatgttttcattttcctgattacacacctaagagtggaattggtgagtcataagataactgtgtttagcttcttgaggaagtgccagattattttccctagtggctgcaccattttacattcccaccagcagtggatgaggctgccagtttctccacatttttgtgcatgtgaagtggctgtctcatcgtggtgtttgccttttcttaaggactcaaaagtttgcagatacaggcattcacttgccattttcttaaggaattgtactctcagagatgttgagaaaagatacatgggtcttggaagataattactcaaaatatgcagggaaggtagtatatctttctattttaaatgtattaagtattcctggaactatagcagtgagttggaaatggaggattgtccaagtaaaaaacatttattaaggctttaatgaaatctacctattttatggtatataatctcattaattgtccacttggaaagaataataacagatatttatttattggccagttactatgggccacaaattatgctgagctttttttaatttcatttcattttattttattttttgagatggggtctcactctgtcacccaggctggagtgcagtggcgcaatctcagcttattgcaacctctgtcttccaggcccaagcaatcttcccacctcagcttcctaagtagctggga

SEQ ID NO: 2339 - DNA, 2487 bp, Homo sapiens
gcaaaactaaaaggtagatatctggaatgaatgtatatgttgtaattgaggcagatatttgccttaattggaaggatctaactgctttacaaatattaaacaagtgcttgggcatgattgggagaggaggcagcttagctggaagctgtgcccatcttactgtcactggagaataggatgtcagagctgggcaggactggtacccatcatttgcagtttgcatgtggggaaaccaaagccctaagaaacaacagttcctggcccaaaaaatccatagaaagaggtaactagtggcagatttggggcgccaacctgattttatggattttgagttagattctctaccctctatcaatactaaaaatagattaggagggtttttttttctgtttatcatgttgaatttcattgacttaattagtctttaaatttgaaaacatgttttagggagtttagttctagaaatttctcttagattgaagtgacagaatctgaaagaaaagaatatgattgagctatttgttttcctgaacacctcaccttttatgatgcaataagttactctgagtttcttggcagagtttttgacagctgttgctttcaatggattccattcctgtattccttatgggaggttgtttttaaaatagactactgcgattgaaatgaactcaatatgtagttaagttatagttttcttcaatgtatttttagttacttgggtcacaaatgttcaatttcagcatattttagggtgagtaatcaaaaatgtgaatttgcctttgatttcctaccactgtctgagctatcataaagcattctctttagttgtgatttgattctatagtctgtttctaaatgacatttgtctgtttcttaaatgatctcacagccatggtaataatagatgtgtactcagaagatcaataaggtaatattggaattcatgtgttttttgcaattaaggcaggcatttgccaatgtcttcttttaagcagtagttggaaacatctcaattacagtgtaacaccttagagctaaaaacatttgttcaacacaaactagaatcacaccttctcactagatatcaccaagggaatgtggttttaaaaataaaaagaaaacaatataacgtatcatggcaaccagagcttcccatattattgacaagtagggatcattaggttctggtttgaacattctgaatgtgaacaaaatgaaatagtagttaagaggtgttttcccactgtgtttaaagagaacactagtaattctggtttttctttctaactgctttactgtttcaagggtattcttttaaaactctgatttcaaaggatcagttgaatttatactttagttatgggtgttttgttactttttttttttttgtatcatgactcagtatggttcaatttcctagtaagaagtggggatttgtgtttttggagtcctcagctcacatgtcttgttcctccttcagcacaagctaggggagatcctaccaacactgataggtcagtcattgatggcaatttgaatgtgggtattactctgtgagccaccctgcttcgcttgtttgtaaggagaaatgcatctggttatgtgaatttcccgagagcagcagacatggagggccagactttaaaagcaacgcaagcagattcgaagagctgttgccctcttctaaaaaaggcttttggaggctgtgttacatgcatgccctaaagcagtcagtctgttagtatgagcaagacatctgaagtacacagttgcttttaggcttgtatagttattttctacacatgccaacacacatgatgataaaggaaccttttctaggaggcattgcagggtttcaatacacaggacatgttctagttacagaagccttgctctgctgtcaacaattgggaaatgctcattttttcatgttttgtgaatactctggtcttgctgtaagctaatgtcatggctgtgggatattagagaagtgggtttatgactctgaagaccagcagacaccagactttaaaagtgcttaaattggaatttggaaactacagtaaagaaaccttcagataccagttccatcctgaagccctctgttgaacaacagggccagatcctaaagctctttcagggagctcttctctggggctggaacagttgattatgcaaccccattgtgtggagattggatcaactgagttgtgttatttttgttttaagtcaccttgtgcgagaacctcaaccgcacctatcttgggaaccgggtatacccttttctttagcactgctatcctttttgtcttcagcacaaataagatgttcaagtgagccagaagcaagaagagccattttagtcttcatagctattggctaagagagataatgagctgatggtctattttaaccttgaaagtaaaaatgtatattttttcactacaagtacattgaacagtaaaaagtgtaacagcaaagtat

SEQ ID NO: 2340 - DNA, 1192 bp, Homo sapiens
tctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtggagaaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccaggagcagcttgttgctatataccattgaaaagccttcagagctgagaggtactactaaccaataacctgcttggctcaaagggccagcaccttctctctaaagcccaagaggagtttgaggaaaactaggtgtctgtgttcactccaggctgaagttacaggtctgagcaaataaggtgtataaaaaatggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttg

SEQ ID NO: 2341 - DNA, 2568 bp, Homo sapiens
gccagccggcccacagccagagccatgcaagcgcagttctcttcggacagttaccaaagacgttggaagaggtggctatggacatcacctgggagaagtggaagcaaatggacactgttcagaagtccatatacagaaacatgttggaaaaatatagaaacctggttttgctagatgggaagcttgaacgtggggccaagacatcaagagtagagcagcaggacatttcaaaagaagattaatctcaaagattagagatggaagaacttgcaaagagaaagtctgtaccggaagaaatctggaaatctagaggccagtttaagaatcagcagctaaacaaggagaataatctagggcaagagatagctacctgcacaaaaattcctaccagaaaaagagacatagaatctaatgaatttgtgaaaaattttactgtaagatcaatacttgttgcagaacagatagatcctatggaagagaattgtcataaatatggtacatgttgaaagatgctcaaacaaaactcagatttaattatacaaagaaagtatgatggaaaaaaaaaaaccttgtaaatatagtgaatgtgggagaaccttcagaggccacatcactcttgttcagcatcaaataactcattgtggagagagaccctgtaaatgtactgagtgtagaaagggatttaatcagagttcccacttaagaaataatcagaaaactctttcaggagaaaagccctacaaatgcagtgagtgtgggaaggccttcagttattgcttagttcttaatcaacaccagagaattcacagtggagagaaaccttatgagggtactgaatgtggcaagacattcagtcgtagtacataccttactcagcatcaaagaattcacactggtgagaagccctatacatgtcttgaatgtggaaaggcttttagtcagaacacacatcttactctacatcagagaatccatactggagagaaaccttatgaatgcaatgaatgtggtaggtcctttagtcagagtgcacatcttactcaacatcaaagaatgtatacaggagaaaaactctatgaatgtaatgaatgtgagaaagccttccatgatcactcagctcttattcaacatcatattgtccatactgcagagaaaccctatgaatatcatgactgggaaaactttcagttactgttcagacctcattcaacatcagagaatgcacactggagagaaaccatacaaatgcaatgaatgtgggaatgcctttagtgattgttcatcccttattcagcatcaaagaactcacaccggagaagagccttatgaatgtaagcaatgtggaaaagcctttagcagaagcacataccttactcaacatcagagaagtcacgcaggagagaaacagtataaatgcaatgaatgtgagaaaactttcagcctgagttcattccttacacagcatatgagggttcagactggagaaaaaccctacaaatataatgaatatggaaaagcttttagtgactgctcaggacattttcagagaactcacactggagagaagccctgtgaatgtaatgactgtgggaaacctttcagtttctgttcagccctaattcaacataagagaattcataccagaaagaagccctgactgtaccttcataccagtaaatgcactgactgtggaaaagccttcagtgattggttagcacttgttcaacatcagataactcaacactggagaaaaaccgtataaatgtactgaatgtggaaaagccttcagttggagtacagacctcaaaaatcaccagaaaactcatactagtgaaaaatcctataaatgtaatgaatgtagaaaggcctttagttactgctctggtcttattcaatgtcaggtcattcatactatagaaaaaccttatgaatacggtaaatgtggcaaagcctttaggcagaggacagaccttaaaaaacatcagaaaatgcataccgaagagaaaccctatgaatgtaatgaatgtgggaaagcctttagccagagcacatatcttacaaaacaccaaaaaattcatagtgaagagaaatcaaatatacatactgagtgtggggaaaccattagacaaaactcttcttttttacaacaataaaaacctcacactggagagattctctgaatgccttaagaatttggttaatatggagacccttcccagggaaacagaaggaggatcgtgaaaactgttgactacttagaatgatcacatggtttagtggagagagcatgattctgggttttaaaagtcatggatctcaatctcagctcctattactaactagatcttttactttggggtaagtcacttcatatctttaggccttaatttcctcatctgaaaaactggaaggcctgacttgttgagctttaagatcctcaattattatatttactaggaattcaagtttctatagatgtggttcagaattgtgacttatttattgtacatcaggtgtgattcacaagtgagcttgtagtagttattaaggagtcaataaagatatgat

SEQ ID NO: 2342 - DNA, 4838 bp, Homo sapiens
agagcagcgggagcgcggcgcaagggcaaaatggatcgttggtacccggaagcccgttcaaactgtataagggtgatcagctatcacggagaaggctttagcaagtcggggccagtggcgcaatggataacgcgtctgactacggatcagaagattctaggttcgactcctggctggctcgcgatgtctgttttgccacacttgacccatgtactactgggtcttgtaaagatgtatattcacaatgtgaaagtattacaagaccttggaaaggtgtatggttagaatgtgaaagttaaatatctgaaattttgatgccgctttgctcacaatgtcatcctttatcctttaaacctggagttgtctgaggtggtttgcaaactgcaaagcgccctgttcccaatgatgcacctgagaagtctgtaaatggggtaaatttaggcaaacacacctggaaaagtggcattttggagtggggaatgctgtggccggaggttagcaaccggatgatgcaaaagcgtatttaaggcagcagttctggcctttccccgccacggagcagaagcccccatagtgatgtgagaagcggcgctgtcccagtttactaggatgggatgggctttggatctaaccagcagcgaagaaaacctgcggtgcggctgcgctcggtagtaggggtccacaaagcgtcagaatctgcagcagccccggcctttgcgagctccagctccgaagtcaacccggcccccaaattccactgggaaaccttaagacaccggtgtttttaccgtaagaagacctcagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccccattacagttctatttggctaataatttacagaacatttaaaataccgggtaggtgaacatctcttcatggcttttgtgtaagggcctgaagcgaagagaaaaacaactgattggagattcctatctggcgccttctccagggaaactgacaaccagagaaatctgttgctaggatttctaggacatctggaaattccctttttgttctttctcaacaatataaaatggtatattcgcaaacctatctgaatcacctcaatctaggccactttgaaaatttcatttaaaaatgtaatcacagatttttaaactaattacccaatttgcaaacaaatcccagctacttctggtcttgaacatggagcaaaggtgtgtcagtaaggccaacattcttaggttgacagagacaggttaacacattggctggcttcatttacccccctgccacgccccacactgagctggatgatttgatgggaagagagggtccccacctcagggttcacttccccagccccagcgttcatgggttttcaggaggctcagcctgtgaaaaagaaccaatgatgatgcacaccctggctgaagtgacatctggccaaaggattccaacagaatgaattccatcaacatggaaaagataatccatggcaccaattctgtgctgcttacaggcaatggttaccaaatgagtcaaaacatggcctagaagtggagccgggcccaatgaaaagcctgagttcacacgtgctaggggctccactgaccggcctctgcagcccagcacccagtcctcttgctctgggtgcaaggtgaggaggcagagtgcacacaccggctcctgtgtccccggcctggctggcaatggtaaaatgggctgcctttcttttgcagcttcttctaatcgaaataccaaagggtactgacctctggcctcagggatgtgacttgcagtgcaaattttacctcttcagtgcagagagtggtcttgaaatcttgccagtgtgtggccctccctcagctcctgccaccctggggagccaggatgctgaaatgcataaggcaaaagcactgaatcggatctattccccactgacctttagttacgatcactctgccctgaccagctggagttgggcctgtgtgaagccagtgatttccaacacactgaagaaggtatctgagtccagtgtgaaagccaaattcctcctgaatctgtgatttggtgaagctctgtgaggtattttttgtgtgtggaagactgaaagtgaagggaaacaactaaaaaaattaaacagacaaaagcagtgtaccttatcctggtttcttcaaacataatgcctgtgccaagaattgggcaggagagaaaccaacgaaatgaatataataacttatcctgaggcgctccctcccacgctggcttagagatctcgcacacacaaaaactctccttgtttataagaagctgtctctcagtatgcgggcagctcttcccaaaagcccgtcattaaataagctaaaaacaggtgcaagcgatgtacctgcatgggttcctgagacttgccttgcagaagcggccttccaagtcaccaactcttgagaactccagagaaaaacagcgcaaacacgtgggcaaaaaaaaaaatcctggtgcctgcaccaagttcttctcccaaagtatgttttactcacatagggcaaatttctgtcgcggactcagctgcctttaggagagtaaggatttgaaggggtacagagaatgctgtcagtgtctaaggaggaaaccctgcctcacctatttcaaatcttgactctggttttctaagcaaatttatcttaggatacaaagcacacattagagcttccttcttgccttaatgcaattaaatttgcagccattctgcagaagaactgaagctctcaggtgaaaagaagccttaaatcatgccatgatatatgtcgggggagggaacatttgggtataggtattttcctgaaggaagagaaagggttgaatgtattggcagctgagctgtcccttcaaggggatattgtgaaacaagctcaataaaaacctctccctctgaagcatgaaatgttcccagaggggacaggaggattcctttggtgctatgatgcaacctcaggtcatgtgctcgcacatgctggagcattttcctgagtaacctgaggaaaatgtggcaacagagaaaagcacttggaaaatacacgcaggaggcaggtagtgttcacctccctggttaaaggaaaggcaccccccacatgctcacaggaactctccctcctgcccctcctcttcccctaccccacttccaccccaggggccaccggaagcagcagcagcaaccccggctcctcatcccctgccgtgatgtctgcaagtggctctggctagaagtggtgctggtgaagggctgtagatgagggtctcttctccagcctcttcacgtggcaggagtgacagaacaggtggtcctccagcggataacagcggtggccatcttcatcattgagctccagaccacagtcctgtggggaggcagacatgtccaggggaagcaaaacaaaacagactgcaagactgacctgaaggccacagtccccaaaatcagcagagggtgctgtgtgtttctgtataggcaggaaatgccagtgcagaaacacagctcctgccccgtggaggcctgtccaacacaggagacactgccacaaggcacttgctgtgaaccacttaaaatgtgctgtcagtgtaaatgcagattccgaagacttaggacaaaaagaggatgtaaaaatatctcatgggaaaaaggaatgagatcatgtcctttgcagggacatggatgaagctggaagccatcattctcagcaaactaacaaaggaacagaaaactaaacaccacatgttctcactcataagtgggagttgaacaatgagaacacatggacacagggaggggaacaacacacaccagggcctgttgggaggtgggggtgaggggagggaacttagaggatgggacaataggtgcagcaaaccaccctggcacacgtacaacatatatctatgtaataaatcttcacacgtatcccttttttttttttagaagaaataaaataaattgtggagttacaaaaaaaatctcatgggtaacttttttatattgattacatgttcaaaagataacatttggatttttttttcttttttgagacagtctccctctgttttctaggctggagtgcagtggtgcgatctcagctcactgcaacatccacctcccccgttcaaggaattctcctgtctcagcctcccaagtagctgggattatgcacgcgccaacacatctggctaatttttgtatttttagtagagacagggtttcaccatgttggccaggctggtcttgaac

SEQ ID NO: 2343 - DNA, 1493 bp, Homo sapiens
cctcttttttaaatatatttttattattatttttgagatggggactcactctgttgcccaggctggagtgcagcggcacgatcttggctcactgcaactgccacctcccaggttcaagcggttctcctgcctcagcctcccgagtagctgggattacaggcatacaccaccatgcccagctaatttttttgtattttcagtagagatggggtttcaccatgttggccaggctggtcttgaactcctgacctcaggtgatcagcccaccttggcctctcaaagtgctgaaattacagatgtgagccacacacctggcctattttggtcctctttagaaggtggttttataatcagctgtaaaactccaacaggtgctcttacatgcaggtttctgataactttggagattgtgacatcagaatagagggaaaagtttcaggactcatggagagctaaaatgttcatgagtatcaagcagaacaggaattaactgcatagactgaaccaatctttttgactttttgcttaaaatgtttgctgatcctttgttttgtgtttcagtcttaaaacttttcttttgagctattgacagcttttaacaatttagtatactcctatgacaaaatttggagcatatttgtttctctctacctgatttctccagaattcagaaactatttgtaagtattcttaacttatggtgatacagttatttgcataagtgcaataagaatctgttctaatttgtaacaggacacgattggagaaattggttgttttactaagactttgactggaatggtgtgcttttctttaaggaatcaaacttgacttatggaaccaataaagtccttggaaaaactggccccatattttgtgtacacagtctccgtacaagatttctgacctgtagaactcttgcaagaagaaaggactatgagttcaactttagagggagccatggggactaaacaaaattctgaggccccctcaaccatctaaatggacttccttctgggccaggacactcgaaaattaaacctgaaagactggttcaggccatgatgggaagtgggagtcgaacatgcctcatcataccctccagcattaacatcaacacagaccttaaggctgataagaagcatttacaatctattctctctgaagtcttctacctggaggcttcatctgcatgataaaactttggtctccacaacctcttacaacccaggcattcctttctatcgataattactctttcaaccaattgccaatcagaaaattgttatatctacctataatctagaagcccccacatcaagttgttttgcctttctggacaggaccaatgtatatcttaaatgtatttgattgatctctcatgtctccctaaaatgtataaaaccacgctgttccccgaccacctggagcacatgttctcagggtctcctgagggctgtgtcacaggccatgttcacttacatttggctcag

SEQ ID NO: 2344 - DNA, 1627 bp, Homo sapiens
tcactccctaaagccctcttcaggggtcacctcctccaagaagccctccttgccaccccccgccggcaggggcccctcctctgtgctccctcggtcacctgtgctacctctaacaccacactgaccacactgtatcgtgagtgtccgttgacgtgaccaattgccctgccaggctgtcagcgcctcaagggtagggtctgcgtgtgatttgtctctgagccccctgtgcccacccagggcccggcacagagtcgatgctcaataaatgtgtgttgactgcatgaatgacctggaaccaggccatgcgctctcgcctcagcttgctcgtctgtgaaaagggggagatgcggaggctggcacagctttggaagccaccagcccgcagatgccccgcagatgccctgacaacgctgccttgggagagactgccccaggttaccagcgttgagacatggctgcccttgctggtgcgttttgtaagtgcgtgtgctgggaagttgttcccccgtctttatcacctcccccaatgccctgcagcttctgattctcaccaagacattcagctgggtgagctgacagatccctggtgtccccaaaaggcccccaagtacttggctctccaagtacctctctctgcctgaagtcaaggatggttttccaagcatagggcctgcaaacattagtggggccacccaactgctcactcaattctccctggcatcccagaacccagacagcaccccagctttttgcgcccacccccccccagacctcacagtgggcccctcaccagggaccagggcagcgtccaccttctcttcctgtcccagccacccccagctctcacctcagtttctcctagaaggcctcgccccccaatttatgccatcccagtccccaaggaggtcgcactgctctctgaggtgggggggcctggcgtggtgtcccttccctggatttcagggcagacaagtgctggaaagggtatgagatgcctggagtggccctgggatatgggaacacctctgagatgacctggtgaatcgtgccaacgtggccccctgccctgctcgtaggagtcccgagctgttggatgctacaggcctgtctaggggcagtgggagcctttggtgctgagtgacccagggcagccctccttcgtgtgtgacctcagagaggttaagtattagccatccacaggccagcacacggctctggacacatgtcccgagttctgacatcaagtaccccccacctcagcccctgtgaagggctgggcctgcctgggtctctctgagggtccaagccagactccatgccctgtgccttctgggtgcctgcacatagggtggtggcagggcatgagtccctgaggagcaagaggtggttttatgtgacgtcagtggttgccaaggctggaggcagcaagtggcctgggttttcactgggtttatggttactggccagttcatcccttggggatagggagccagtgaaggctctggagctggggatggagaaggtacatggcttgcttcagtgcagtgggtggaggaattggaaggaggatctggaggcccagaggccaaggaggaggctggtgagatggtcctggggagaaagggtg

SEQ ID NO: 2345 - DNA, 539 bp, Homo sapiens
ttgcttggttaccatagtatcctctgcctccaagtctctcctgatgatgtcagtatgcatacaggggttgttcagatcatctacgtggggatgattcaccccacaataaagcccctctctctcgttgctcgctttccagtgtgatttcagacatctgtagcaatggaaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtg

SEQ ID NO: 2346 - DNA, 2449 bp, Homo sapiens
attattattattattattatcattattattattgtagagacagtctcactatgttgctggactggtctcaaactcctggctccaagcagttctcccacctcagtctcccagtatgctgcgattacagacatgagccaccgtgtctggccaggaacagcctgttatattacgtcagctttatgacagactcccacatttatctttacttttcccagttcactatgtgccagtgaaatttcatggcgtgttagtgatctgtggattaacttttgagaaacactcttttaagtatccctttaataaatcagaataaaatatagtacagccttttactctagccctttatatggctagaagaggtagaaattaaaatgttgcttctcatttctagaagaaaaaatgttaaagggagttttctagcattgatagataacttactgtacacgagatgcttatttatattttatggttttatatagagcaagaattggcaaactttctgtaaagggccagatagtaaatacgttaggtgttgtgggccatgtggtccctgtcacacctattcaacttccccattttagtacaaaacagccagagacaatatataaactacagtatctgaaccttggcactaccaatattttggaccggataatactttgctataggaagctgcccagtgcatcctgggatgtttaggggaatccttggcttctacccacaagatgccagcattcaatgctgatagctgcccctcccccagttgtgacagtcaaaaatgtctccagacatggccaggtgtacctagaggccaaaattgtccctggttgagacccactgatgaatgtgtgcaatagtggttcccataaactgcatttaaaaaacagctgttaggtttcgtttggctcaagggctgtcatttttcactcctccccccatagagtatgtaaaatgattagaaatgacaacagactatcatttagtatcagattagtgtgtgtatatgccataaattatttccttagcaattcctttagtatttttgttgcaataattctttaaacgctacatttgtaatgctgtcttggagcctaggaattatttttggagatatttatgcagacttccctctataatgatcggttttttattatggttaatccataaatattttgagatgtatctctaaaaaacgagcactctttgaaaacataaccacaatgccattattatacctacaaaaattaaccacaattccttaaaacataatgatgcctttttgaagagagatatattgagacttcattctggggagaaacctttcagataactttatttaccttttcctttgccaagcatacaacattagatttgaaatatgctttgtatcaagtggaagtgtctcttaagatagcccctagaacaacacatcaagaggcccaccaaagaggaccagagaaaggtgactgaaggagccatactcaggcagggaaatacggagagaaagcagaggaattggctcctaatgcttcactgtacttaatgaaatagatactccatccttacagacataattggaagtaagtcaagttcaacttctttgttttatatggagatagaacagtttcaatcacgtgagtattataagtgtgaattatctaaagtaaagctataaatccagaatatataccagtatctctagaatttttcatattactacatttacttaaaaaaaaagctggcctctaactcttaagtcctgtatgactgatgggcagaaaaagagtgaggtatacactgtttcttaaaattgttctaccatgtttctatggtcttagatttcccaagaatttgaatttctccaattgcttatttccctgaaagacatgactatgacttttctctgtagttcctgcctcagtgatctcatacagtctttggcttaaaataccgtctctgtttaacagctgccagattcacatctccagcccagacctctcccgaactccagccttgttctaacctttgggccgtttcactagctgttgcagatgccctatacccttaccttctcatctttgctcaattgttgccttcttactgaagcctatcctgtccatactatttaatactgcagctgtctaccttccagatcgagaaatcccatacccctttcacctgctctatgtttttcatatcacctatcaccctagatacttcacatatttgtgtttattgtttactgttgtttcccctggctataatgtaagctccatgtgggcaggggcctttgtttttttcactgatatatcacaagtgcctaaaacagtgcctgacacgcagaagggactcagtaaatatgtattgaatggttttgatttgaactgaattgaactatgtatccatgatgcaagtaaagaaatgtaatccatatactttcctacctaca

SEQ ID NO: 2347 - DNA, 2446 bp, Homo sapiens
attattattattattattatcattattattattgtagagacagtctcactatgttgctggactggtctcaaactcctggctccaagcagttctcccacctcagtctcccagtatgctgcgattacagacatgagccaccgtgtctggccaggaacagcctgttatattacgtcagctttatgacagactcccacatttatctttacttttcccagttcactatgtgccagtgaaatttcatggcgtgttagtgatctgtggattaacttttgagaaacactcttttaagtatccctttaataaatcagaataaaatatagtacagccttttactctagccctttatatggctagaagaggtagaaattaaaatgttgcttctcatttctagaagaaaaaatgttaaagggagttttctagcattgatagataacttactgtacacgagatgcttatttatattttatggttttatatagagcaagaattggcaaactttctgtaaagggccagatagtaaatacgttaggtgttgtgggccatgtggtccctgtcacacctattcaacttccccattttagtacaaaacagccagagacaatatataaactacagtatctgaaccttggcactaccaatattttggaccggataatactttgctataggaagctgcccagtgcatcctgggatgtttaggggaatccttggcttctacccacaagatgccagcattcaatgctgatagctgcccctcccccagttgtgacagtcaaaaatgtctccagacatggccaggtgtacctagaggccaaaattgtccctggttgagacccactgatgaatgtgtgcaatagtggttcccataaactgcatttaaaaaacagctgttaggtttcgtttggctcaagggctgtcatttttcactcctccccccatagagtatgtaaaatgattagaaatgacaacagactatcatttagtatcagattagtgtgtgtatatgccataaattatttccttagcaattcctttagtatttttgttgcaataattctttaaacgctacatttgtaatgctgtcttggagcctaggaattatttttggagatatttatgcagacttccctctataatgatcggttttttattatggttaatccataaatattttgagatgtatctctaaaaaacgagcactctttgaaaacataaccacaatgccattattatacctacaaaaattaaccacaattccttaaaacataatgatgcctttttgaagagagatatattgagacttcattctggggagaaacctttcagataactttatttaccttttcctttgccaagcatacaacattagatttgaaatatgctttgtatcaagtggaagtgtctcttaagatagcccctagaacaacacatcaagaggcccaccaaagaggaccagagaaaggtgactgaaggagccatactcaggcagggaaatacggagagaaagcagaggaattggctcctaatgcttcactgtacttaatgaaatagatactccatccttacagacataattggaagtaagtcaagttcaacttctttgttttatatggagatagaacagtttcaatcacgtgagtattataagtgtgaattatctaaagtaaagctataaatccagaatatataccagtatctctagaatttttcatattactacatttacttaaaaaaaaagctggcctctaactcttaagtcctgtatgactgatgggcagaaaaagagtgaggtatacactgtttcttaaaattgttctaccatgtttctatggtcttagatttcccaagaatttgaatttctccaattgcttatttccctgaaagacatgactatgacttttctctgtagttcctgcctcagtgatctcatacagtctttggcttaaaataccgtctctgtttaacagctgccagattcacatctccagcccagacctctcccgaactccagccttgttctaacctttgggccgtttcactagctgttgcagatgccctatacccttaccttctcatctttgctcaattgttgccttcttactgaagcctatcctgtccatactatttaatactgcagctgtctaccttccagatcgagaaatcccatacccctttcacctgctctatgtttttcatatcacctatcaccctagatacttcacatatttgtgtttattgtttactgttgtttcccctggctataatgtaagctccatgtgggcaggggcctttgtttttttcactgatatatcacaagtgcctaaaacagtgcctgacacgcagaagggactcagtaaatatgtattgaatggttttgatttgaactgaattgaactatgtatccatgatgcaagtaaagaaatgtaatccatatactttcctacct

SEQ ID NO: 2348 - DNA, 4951 bp, Homo sapiens
gcagcaagctttcgtcaccttcagagctctagcataatgataaaggagcactagtgacagccttgctgtatgcaccaagctccaccctgggcagtgcctttccctaatgtctgtcctggtgtgaaatggagacttgaagaccggtacccacatgtaagagaggttaacgaagggagggtggcagagagaggagtcatgtgaaggaaagctacctttagtcctccatcgcaatactgtccagtgtctccagcgtgctagaaactgtgctgaatgctgggcacatggcaggggtcaaagcagacagaaatccctgcctcatgaacccactttctattaggggagacagactagaaacacaaaaaggacattgaatagtacgattgagagatgagtgctatggagaaaaatccagccagaaagggagatgcagaagatagcaccagatcttctcaatgttgttttcatcatggacaggtgcgttccttagaagatgaagtgttagtgattcctgagtttttctcaccttcacgtcgattgatctgaatttggagagtctgttttctgtgtctggctctgcactcaactttgtaggggaccctgtcgaggtccccacactgtggcttcaggtagacagagcagatgggagcccatttcagttcattgtcttgctgaccaatggggaactgtggtcaggtgagaggaggcagcttttacaatcagacttcattgaatagtgtgggctgctgtttccttgtaacaaaaccccataatgatggcagtttccggatgtgtctttttaggacttcagaacttattatttgaatagaagtttaaagcatctggatgatgatgctgtagctaaaacagctgcttgtcagaagagaccctatttaacacttctaaacttgtttcagaggtggaggaaaggataatctgggaaggcctccctctcaagtccacaggttggtatcagctgtgttcatcccccaaaaggaaaataaaatgacaacaatattttggtcacagaattcctgagaaacctctgtttctatcttcatgtctttaagatagggacatgaattccccatgatctgggtgatagggttagggtggccaggacactgttactttgtgtgtgacacaggtggctcctcatgacagttcctccatgccttagaacatgttgtctgtctggtcatccctgggggtagagctgagtgacccagcagtgggagatttaacaactggagaagaagatgggatgtgtttaattatccccagaggtagggccaatttgtcaccctttaaatagacttatttgcatataaactaaagcaccttagggcatcattaccgaaagtgtctaagcaaatgtctgatatagttacgtgcctgcattaaaagaaagcagcccccttatcttgccttaatatccttacagtgttttaataagttcataatgcatcctgtatgtgcattttttggtataaaacaccgaaaggtggagaattgacttcagttctctccatcctttccccttaagtgttggtggcgctgcaggggcaacgtgcctcccattggaagtggtgacttcctctttgatagaggtttgcctgtctcttgaaaatgaaaagaagcggagattgatctctggagtcccatggtccagtttggactattgggaatattttttatgggatgttaaaaacaatattagagacgtgagatagtaaatttgtggtaataccggatccaggaagcttacagtgaagagtatgaacttaacctgaaaagtatttctctgttctataaatctctcagtgacatttggattaatcaagcataattaaatgtagttagatttttgtcagattgtagttcaaaataatattcatctatggagagggtaatatattatgtagaaattttattaagcactttagttaagcaaacactaaggagaacaaaatcaacctcaggaaggttaattactaaaaaaatcacaaagtatagtagattatgtaaatcattttaattttgaataccatggcttgagctttaatttacatagagacgtattttggatttgtttttcacattatattttctagtacaggattgcaattgcattcttgaaaagttctactcattttaggattccattaagtttgcttaacttttttcatgttataatttccaaaagcaaagaattacaattgtattctagctaattattttaatgtttcactaactttgtgtgtattgtaagaccatatttttatttctatacaaatgatgattttaagagaagtatcaggagagagaatgtatatgaaagcatcgcgtccacgcctggctttgcaataagtgttcatttaaaagaaagacatttacaaaggtaaaacataagagtttagactatagcgataaatctttttattttagtaatttctttaaagggaaaagtaaagagatcaaaatgattttatatgtattttttttgtactcagagaattacattttcactacccccgcctgtctcagggaatagcctttgataagaatcccatggagatctctggaactctattacagtgtgttcagatttgttagttcatatgtaaatttcagagctagagcttcaaaactagagtattgtaatctcaggaacataagattatccaagaagcctgaaccttgctcttttcatgataaatgacatccaaatttcctttgtctaggagataagcatagatcccttttatcatgcttctctgagattttcacagaacaaccctgcaatttgattttgtttgataattttgctttttggcttttcagtgaggactctattttccattggaactgactcctttggggataataagctttcacttaaaagaacattccattagatagttctaacttcaatgaacctaaaagtggcttcttaatttgaataatctggataacttttgcaaatgggtcaaaacagcacaagtatcaacaatcacgtatgtactgagtaatatttgccctccagttagcaaagtcaagaaatgtctaactctggcacacagcactggttttaactactctttagttcatctttgccttccaaattggttgaaaatggcaagcttagaatggaatgcatattaataacagaaccacttaatgttttaaaatattcataccttgagattctttttgagagaaaaaagaaatcttaacatccaattctagttgttttggcttttcacatatgctagacatgaaaaaggcagttacaaaagtgaaatccgattggaagtcagtggtgtccgccattgagccgtgctaaatgtcgtgtcacaaaaggagtttgtgaaaacaggatgagtagaaaatgttatactgttgtttctatcgtggcaccgctttcttataaattccatttgctttttgtcatctgaactgttacaaccatgggaaacctcagtccatatttttaaaagcactatatacttacaggaaaaaccgacttatgccttcattgaaaaaatgttgaagttaatatcccaaatgtttaatgagcatgttttagaatatttacagctaaagtctgtcactttagggatttgacaaaacttgagactgcctgccaccgaagagggaccaggcagaatcttctcagccttgtaaccagcgttaaaaaaatataaggggcttgatgagatcctagatctgctccttttctcctaggtgcctgggtaactcctggggaaagcatcatattaagtccttttcaagcaaggtgtgtgattttgaccaatgaattgagctgatatgtgattttgaccaatgaattgtgcatctatttaaaaattaccaagtgtatcttgactcttgagtggacagtcaaggcaaagtttacttaggaaatgtaaagtatggagtgttttaaaaaattcaaattgagtttattcactgttggaggaattgaattctattgcctccctcatttccattatgttcattgttacaattgtgctgctctgttctcattgtgatgcttagttctcgtgtagaactgagtgctacattgtgattagaaactggagttgtgcttgagtcagtcctggaaaacaggacccatttttaagaagaacggaacataccactttggcattctggctgaccctaatttctgcagagttccttggtgttaaaatcatttgaggtcatagttgctgcttatggtttatatacacaccatctgctgctctaagttcacatcctctcaaaagcatgcaagtgcttgaaatttaaatatttcccagatctaaaacaacttgtgactacctaagaaatgcttgaaccaaataagaaacagcactgtggaataaaatataccattgtgaacatatctgatgctgcaatgaaatgtaaagttccttactttgctgatttttcatcataactccttgactcataaaagcggtgtctaaactgggaacagctgctaatagggtaaaagtattatacatcaaataaaagttcattacaatatttgtactcataagtcaaaatctgacctggttcgctttgtgcctctgtcagcctacttacagtgataaatgtacacacaagtccagtgttgccaaggagctttgtttatagaaagaagcttggtcccctcagttctatgctgttgtgtggcctggttggtacatgccgtcatgatgaaggatgactttggtttgagataatttgtcactccacattccatggagaaaagtgtttcattttgatgttggaaaaacatgaccagagaagcatgtgactcagataatgttccccggaagttgcagagcaatctgtggtgtctgtcatagcccaactagtcctggagcacatggacaattctgtaccccaataatcagaacaataaaatggtagttgtgattca

SEQ ID NO: 2349 - DNA, 1736 bp, Homo sapiens
ctgcagtagcggcttctgcggctccaagccagcgggtcctgtgaaggcgagcagacgcggagaaaggacgcgggagtgagagaggctgtacagttttggtgttcatcttagaggattcttcagcagaagtgatatttctttactgttttgtgaggtaatactgattttgaaaatatatataagctaaaaacagtatttcgttgatatcagtagtcattgtgttaactataaagtcaagtgccagcaaagaactttaaaactgtaaagctgtgtatagaactgttttgtgtagcatggaaatattctgtcagctttttaaagtcactaaatgttcttgattatcagcttgaaggtatttttgtattacaagttgacagttgctgggtgtagtggctcatgcctgtaatcctagcaactcggggctgaggtgggaggattgcttcagcccaggagtttgagaccagcctgggcaacatagcaaaaccccatctctacaaaaataaaaaatatgtctgggcatggtggcccaagtctgagtcccagttacttgggaggatcacttgaatgtaggatcacttgagtctaggagttcggggctgcagctatcatctgcagctataatcatagctcactgcagctatgatcatgtctcagcactccagctttggcaacagaacgagatcccatctcttagaaaaacaaagttgatagttaaagaacataagtggatgatggcatttgaggccactagtgaaagtatgttttctctaaaatatttctctaatagtgatataaatggctattttattatgatgtttgtatgtgttttgtatttctctgtaaaccatgctccagtctttgtttttctgttaccataatgtaagagaaggtcctggaacagagactaaatcccacgaaactgacattgttaaacacactaaaacagaagtacttacctcttgaagatttaatatataatggttgacatgatacatgtacatgatgaatgaccagatgcttatggtctacattttcctttatcctgttagtattaccttccttaatctttgttcattaacatgctaattcctcttcagtgtttattttctagtgacagaatgctaacatttcttacaccctggcagaagggagagaaatgtgttttggggtgggtaactaaatttttgagtgaaatatcataagatgagaatggaaagagggagacacaaagagttataacaaaaaaacaatggtttttttagccatttgactggctctttaaatagtctacaagacattcacgtttaacatcacttttagtgaaataaaatgtgccatactagtatgtgcttcaaaagggcaaatgtgctttagtgccctaaggctaaattttggtcatttgacatcagagatgttgtaagtattgcacttaatacgcacctatttctcaatagtgttattttttggctagcattttctttaccactatcttgttgatagctttttgttctctaaggttgaaacatgacagtgcttatctcaaacagattacccatctgcagaactaaggaaagcaatttatgtatgaaagaaattcttgaattcgtcattctcaacctttgaattaaagcttagactaaatagtaatatatcgtgggaaggattttggttttgtgatatttctgtgaattaaggaatagatgttaaccattattttgtagaaaagtgatttgtat

SEQ ID NO: 2350 - DNA, 6250 bp, Homo sapiens
gttttaattgacaagtaaaacttctatatatttatggtgtataacataatgtgtgtgtgtatatatatgtatgtatatatacacacccacattttagagtgactaaatcaagctatttagctcatgcgttacctcacttacttgtcatttttgcatttttggtggcgaattggaaagctatttttataggccttttgttcataccctattgaaatgatcactaatgctgatttagagaaatctgaattactgagattatatatggtaggtaagaagtggaggacagggccaccatttttaaatggctcatcctcctgagtgacagtagctgtgattaaataaacctccctacctagcaaaatcatcaaatgtggtgaccacattaactttggtagaggacagcttctgaaagacctttgctttctaaaggaatacatattaatggtctctgaaattttaaagtattttaagcctgtaggattaaaggtaaatggacagctaaatgtgtgttttcaggtgaaatgacagtaaatccttgtgctccagctcataaactgaaccttccagggggcatagtatggtcctgctaaataaatctcttgctcattctgtaattagcaatgactataacaacttttatttctccatttaacatttgtgagatagcttcagtctgtttcatttcatcattcatctttttggaaatctcgctgctgccacaacagccatgcatataaattcctcaccatgcctctgcaaatcaaacaaaatgtactttaagcctgcctcacaatcaaaggctctatgtgatttatttccaaacggttcttagagctgggcctaaatgcgacacagctacatgcaaaagcacaatgttttggacagggtcagagtccacttagagagagagagacctagcatagcacaagacacacagtagccattctgcattctgtaaatttgttttcgaatgagatctatgtagagaaatttgctccactctgtcttccttgtctaaaggaggaggcttttcatccttttcgggagacatttccaggcacgttcaggtggactgtctgcaggtcaggttcacatctagtcatgtcttgatcacccccgtgcatccctagctagggggaagcttatagaatcagaggtccatcataaggcacaatgaattacaggatgccacaagcatatttgtctatgaaaatcttcaccaggtggaaatggccaaaacaaagatcaccaacccccaggggaaagggttcaacctctgctgagcttccgaaatacttcaagccctgcaaccagacacaggcccataaggacaggacctgagtgaaaccaagcagtttctggggaaggaaatattttcattgacatttttgggttactgttgcactaccactagttgtctcggagctctaggaaaatggtgatcatttttcacaggctgctagtttttgtgagcttctggttgggttggttttaagttatcagagcaatagaacttccctgacaagtcaaagtaccacctattggaagagtgtcagtgctactcaaaatatggcttgagaattgatgccatctatgtcacctgggagtttgttaaaaaatgcagattcttcagaccccaccccagattccaaatccccagaatccgaatctctggggatggggccttgaagagtgagttttaacatctttctgggtgattctgatgcacgcaaaagtttaagaagcactaatccacctatcctttctggcttttgtccttcgagccaagaccctcaatttggaggaggggcagcaatgttcccagtaaataccgcatttccctgcctcctctgcagcaaagggaggctggatcggctgcaaggcacagcccctttgcccattgcccttccttctgcttcctgcctgaattgtggatgtgaggttcagtgcttcaacagccatctcagcccatgaggcagcctcagtgatggaaactgcactaaaaatcaaggagtctgaaggcagaaggagcgtgcttccaacaatcaggcagaaggagcgtgctcccaacgatcaggcagaaggaacgtgcgcccatgatcaggcaggagtgtgctcccaacgatcaggcagaaggagtgtgctcccaatgatcgggcagaaggagtgtgctcccatgatcaaaggcagccactccagccctggctttccttcctccagattcccttcacatgagagtaaaacaaacctttaacttactataaacttattataaattggtttctttgaatttgcagtcatatgccatccaacataatcccaggtcagttagcacagatgccccctagaaaagccagatgtggaagtggagacacctttcccagggctacggggattcttaccccactcaccaatgtccctcttgcattcctggcccctatctcttcttccatgtaaccctttctgtaaaactgattaggtaaaaatcgattaggtctgtagaaaatgggcaagggcatcatttcccttacctggtttataaagataaaaaattggtacactcctcaaagaaaaaaaaataagagggagccaccacatttggaaatccacagctgacaagtaaagtagtagcaatccttttacacatgaaaggtgcagtttgcggattgtaaggtcatcgtactcggtgtttatggccaatttaatatccgctcactgcaagtggaatgaggcaggaagcagaaactgtggccagttttttcatcactgtgtccccagggcttggcagagagactggcccatggtcagggctcaataaggatttgctgaatgaataaatggatggataaatactaatctttttatgtttaaactgatgcttcctctcattatagtaaagccatcaagggaatagtcaatgaatggtctcagggaatggcgagtatttgtcacattgtcccattccccaaactgcaggcttccccagaactgtcatgagagcatcaccttaggccttctcgcccactcctcacattacatgtaatctgggccacatcgtttaacctctcaaggtccccatgttgcaaaataaaagttgaaggaagcgattctcaatgtttctcccagctgattcaatcaattttggaatacagaagagaccttagtgcctgaaaataatctctaaccccagtccttaaggttttcttacagttatttttattatttagttttaatgaactaacacaacgtaggagggaacgctgggttggggtttacttgttacatgacctcaggatgatgtactacaaacttcacagataggcacacctctttcactaattatttttaataaaacaaaagatcaaaaatcagcatcaggagatgacacaatacagttgagactatggaaagcaactatttccaagctgggcatcataaaatacatcatcaagaactgtgaacagatttgctaaacaaaggaaagcctcatccctttaaccctccacagccgacatcgggagtctcttggggtagaacatgaagtgaaaaagaagtggatggccagaatgctgtacattgtcccccagtgacctgccacagagactatttttaaagacgcatttatctcagcaggagtgacggcatttaagaagtagcccggtactcaggctagacaatcctgcaaaagtctgcagagcttggctgcaccctttacaaagacctgagtgatggatgagatgggaattgcccttgattggctaggtggctggtttaaagagccataaagataatgcagaagtgagatcttggaaaccaaatggagttagcccccaaattattgcagccaccccagcactccaatgttaatccaattttaaatttacaagatccatcttaactagaaatgcaggctctaactgtcctgcaagttttttaagtggtagctgctcaatgaattgtattatcccattaaagaataatgttttagatgtggtaatcccagactcacacaattctcttttatgaacctagccactgtattcatatggaaagtaaattacagctatattacatcgagcctttcattattgacagagcaataaatgttagtactcctataaaacactgagagaaagattaatacacagtggtatatatatttggaggaatcagggtgtccagtcagagtcaatatgtcttctctccctgtacagaaaaaaagggaggggtgtaaataaaaaggtgagggttgacagaaggagagtaaacattttaaccattaaaactgatctcaaatcgacggtggaaaggtgtcataagatttacccctaccaacccgttaattgaggaaaattacagaaagatgtcccgaagctatcataggacctaagcatttctccaatactgagaaaacactcgatatagccattattattctgttttaaatttttggagatctctgccagggaaaatgtggcacttgcccattgagagcactgcaaatcaactcaaacaactagttcttgcaggctgatgttcatccggcctgggcaggtgcaagttcacctccgctggcagttgtgcgtagctcactgtcccctccattgtcagacagttctgatgtttttcctcttccatgcagtcaagacttcagtctattgctgaccttcatcagagaggtttgtcctaagctcctcccccaacccacacccctgtttatgttcaaagctggacttcaggaaacagttctcttaagcactgaagaaaaacatatttggcatccactacactccctaactcccactccaatggactctgtttcaaaagctctggacacatagcatagatttctcatgagacctgaccatcctaacaaatatggattgcatttgcattttaccactagaacaaacaaaaagtatttacatttggaagaactgtggctacacttccccatccttccctcagtccccatgttgtttgattcttgcctgcaaagagtaccagaggccactgaacacatctcacattgtttttgggtagtggcaaagtaaaatgccagcactgaagatggtgagcttgagtttcacaagtcatctgtgtaagggagagaagtaactactcactacacctgcacaaagaaaagtgcctggattaagcagactgcacaatgtgagtttgttaattcatcctcccaacagaaagttaaatggctgtaagaaattgtgcttgcatttcatttgatcagacctcatttcctgggacctcaaacaccaagttctcccaaaatatggctaaaatgctggcaatatttgcagataccagttgtggaaattaaacccaaataaagttatatacaaacttagtttacagaataactatcccattccgtttctttgaatagagcaaaacagaaataaatatccttcttaaatgtattacctaattatcatggaaagcctaggagacataggagaaaagtagatctctatagatgttgctcaaatacttggctttctagatcagagtatcctcaatgctactatgtcaattttcgagtggaaaatatgataggtgatacttttaaatgcaaaaatatatacttcaagcccaatcttcatataatgactctaacttccagccaagttgatttgttaagttgttgggctccaaggagctttctggaggaacctgggtgtttctgaccctctaattccttttcaaacgcaagttaagtccttgcacttgacttagagaaatgcttgctcctcgcatagtgtgtgcactcactggagaatcctctccctgccttggactgggaagacttgaagttaaacacgcagctctgtgattctaagggtggctcagggcacccccaaatcagtcacctgagttacaaacatattgacagctgaagtgggtcctaaactaggggtcacaaagtcaacttctcctcccgtgctatccaaggtgtcctccggaccgtgataggcaggaagtgtggatgcatttcagtgtcctggacaagattctctcgacctttccttttcccataggttgttcacatcaggacctgttctcgagtctctggcagtcgaagggcaatcaggccacccccaaccagagaagcagcagccagaaggatggggaccactttggttatcccaacaaaagaagcaaagatggtgtttcccaggatggcgccaaatttgcataatccattgagaatgccgaaggctgttgctctgta

SEQ ID NO: 2351 - DNA, 867 bp, Homo sapiens
cccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctc

SEQ ID NO: 2352 - DNA, 435 bp, Homo sapiens
acatgagatgctctcttcagtccggggcttggttgaacggactcaccaggaaacgtgactttcgtgtccgacctctgctgtatcaggattcgattcttggtgttaaacaagacaacgctgaaggctcggtgcagcagccctggaaaggtaatcttagcatctgatctttgctgtagcagaagcttattttcggtgttgaataagaagacactaaaagctcgatgcaataatcctttctcaatgttctcgttcaggtgacaattcttcttggtctcagctccaattttattgtcattttcatcaataaggatacacatctctgccaggagttgaacctgttgcttgtcgaggtggttagtgtttatttcaggcatcattacaaaatgtctgatctgttctagaacactaatattaaaggaaaagagaaagaaaggc

SEQ ID NO: 2353 - DNA, 1734 bp, Homo sapiens
cttaacccagtctttttgcacccatagcctcttcaagttccttcaaaattttgcctgggtggcttcagctgaaagcagaaatggcaggaagtaattgggggagattcccaaatctatgcccaactgggaatcaaatttttctcttgccaagagatgagctgaggagtcctgtgcacttatcttgggggaaacattgttccattcttagtaacatgcctgtttggcctgtggtctgaggtacttacaacttgctgcagtgtggtaaatgtgtcccttttgaaacactgttctggggacttcagagatgacggactgcaacctaccacctcataaatgagggatctgaggtacaaactggaacccgggtcttctgggctcagagaactctcctcactacagcagactgcctgtttccatttaggggaatgagatgctctttcataaatgataccaagtgcaagagaacttaaggcagctccaatcgaagactgtcttggctgcttctggaaactacagatcactactcccgaagtcaaaaacgactagaacacagcttaaaaatcaagccatttaattgtatctttgaaggtaaacaatatatggagctggatcacaacccctgaggatgccagagctatgggtccagaacatggtgtggtattatcaacagagttcagaagggtctgaactctacgtgttaccagagaacataatgcaattcatgcattccacttagcaattttgtaaaataccagaaacagaccccaagagtctttcaagatgaggaaaattcaactcctggttttagagataaatgaatgaagagtaccaaaatatttgttgacttctcttcatttttctcatacaatctgaagcctgagctgactatcatatccccaactcacagcagcgaaagctgcagttcagatttgagatcagtctccattcacttccacgtagcaccacagcaagagtgaccggaggcagagagctcttgttgggtcagctttctaataagcatgtcaagtgaaaaagaaccctctagcagcacactgatttagtttgtaagattttaatttacaaattaaaaaagctatttaatacatgttttactttttctcctttttctcctctttctttacatcactcttttccttatctttatctttctccttgtcctctttcctatcctttttgctctcttctttctcctgcccttctttcttctctgcatcccggttggcaatcttgttgttgatgaggttgtgcagggcgaccacggaacggatcagcgaggccaagtacactaccaccatctggtcattggtcttcaggtaaaaggccttgacgaactcctgcaggctgacatctggcagcaggttgaagacgtcctgcagctggtagatgatctggtggttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcat

SEQ ID NO: 2354 - DNA, 553 bp, Homo sapiens
ctgacatcctgcagcacaatcacccggttgtgggcctccttcaggttggaagtgaacatggatcggaagaagcagctctgagctgagaggaccagccgatggagctgaaactcccggccttccaccgaaatggtgacatcagcaaagagctcctcctctagacacagtttcatgatgccttgagccacacggcctgaatgtgaccgatctttgaaagtgtagttcacaaagtagttctcatccatggatgctccaggctcctctggtgattccatgctagccaacttctctctctgccagctgtctgcaaagcaacaccatcttgagtaacctgaggaattcacagccatagtctgtgaatccaactgtccaactcagggagggaaaaggaagaagtgagagcaaagtgggtccagattggccttagtcctggccctgtccatgatgtccctgacgctatcctttaaccaaatctgggttcgttatccccagtggcgcccctccgctaatgatataaataaaagttccaactctgggtgttttcctgagaaaa

SEQ ID NO: 2355 - DNA, 3018 bp, Homo sapiens
agcacacgtggagttctgggtggggcgctgggcagagggactcggcttctagggctctgagccaggccgagggacagactgctgggaagtccccaaaagggcagcagcactgaggggcaggattccagggtcctggaggcggaagctcggccgactgactcccagttcgagagaacggggcgggggcagcccaccagtgctggaacccgaggggccgggcgaggaacgctggactgggagcaggacccttctcgcctcggacaagactccttgtctggggacccagcccgacttcattgtagctgggtcctcgagaaagcgaaaggagccctccttccccattggcctctccatcgctgcatcccaagaagaaagacaactcgggctccacttgcttgctttttaataacagagcagagagaatacaaggccaggagcggggcctggaggaaaacaggacttggggtgctcctgtgagagcggtgggttgagatgggagcccacgggggctgttaatgcctagttcagaggatgggaaaggcagttggagagacgaaggaaggggaaacgccttcatgtcagcaatgagggtgactctagtgacggaactagtcttgggtccctggggcaccactagcctctcggcatcggtggtttctccttactcttcagacgctgccaactccatcccccagggattgtgaagggggttccttctggctgtgacagtgctgaacgaggccagagagtgcagctgcctggaggcacaagcctcctcctgatccagggggctccagggagaccaaagcagctgtcaagatgagagaaattgaaaaagaaaatggaaaactctccagcctggctctcagcttctgcatctccatgcaagaccagagacccacatcactccctcactccacccagttccactccaacaatacctgggccctgccaggagtgagaaaacggtcctcttcctgtggataggttgctctctcctcttccagatcagggtattcattggtgctggggaatccacagccctcttcgccaagcaccactggctcagatgcagccccagagctgccccactgggccttcttcagtctgtggagactttaggctgaggagagaagtgcctggaggccaggcttcctgtctctccattcttcacctttctgttctgaaatacttcctgctgggactccagggagttgtcatttgacctttaaccctccactcccaattttctgctcccctcagactgaagcatattgtctaggaacccagaggtgaccccaacctccccactgtcctccagttctatggtttgctttcctgtcttcagtgatctagtttccactccttccagctcatgtggctcatcctccttactgcagttccctccttctttccatattacagaaatctgtttcaatcacaccaaagcccacagcttccttccaagcaacctcccctcaaagctcccctcaaacctcccctcaaagctgtcaaccccttccttagctcaaactgttctgcccccaaatcctgcatgactcccagaacccagatgtctcccttccttactcgttgatgatgctctgacgccttcttaggtcctccaggtggtaagtgacagccctcacccgggcggggactcccccaaggccctgctgctgcattccttccaaacatggcctcctcttctttcttctccaaagcatttcagggggtgggagctgctcaggaggatacagaccaagctgggagcaaccagtggctctctgtgccagagaatggggaaaaagagctagaaagaagaactggctctctcaagggagcttggattgaactaggtagggagtctggggtcttgggaagacccctgtgatctcgaaaacatgatgactgattcatagaaaggaaggcctggtcagtgcactggttggggaataacagagggaagcggtaataaggagagcttgggacaggacagcagtgggtgcaattttaacagagaaatgttaaacggcagagggtctgtcttaccagcatgggtggaatgtgctgctcctccagccaagtggggctgtgaagaacaaaaagggggctataagtgcagaggggacatgtccatccatattgcttctttaataatctctcccgacctcctttctgtcattaggagctacaatgtccaccagccagtgggaaattaaccgcagactagggcctattgctatatgggtttatggtagtttaatccagttaagaccacatccagttagtttccattttctcctctactcacgtgggcctttgattaaggttcttccagaagacatctccataacgctggggcatgggtctgaggctctgggaaggcaaccttgggggtggagatcggctgaccaccctggaacacctgaggtgatctcacccagtaccatgctgtcaataagctgatgactcccaaatctatatatccagccctggttcctctctgggctccactcaacatctcctccccaaccttcctcctctcaatgaaaagcactcaaatgcccagttgctaagaccaaaaacatggtatgtctcactttccctcacctcccacatctaatccatcagcagttcctgtcagttttacatctaaaatactgtgtacctgaatttgaccactcctcatcattcccactcctaccaccatatatttcaggtcatcttccccttcctggactgttgcaatggtctcttccccccgtctctgcttccattcccatcccccaacaatatattctgcacagaactgtgagagatgatcatacgaaataatataaggtttgagatgtacttcaaaagaatttgagaaatagggggctagatgggtatagagatgaaaagattatccatacaatgataattattgaagctgactgaaaagggtacatggggttcatgatactattttctctactgtgtttgtttgaaattttccataataaaaaaagttga

SEQ ID NO: 2356 - DNA, 16260 bp, Homo sapiens
gttttagctgacgacactcgagagcgccaattttcctagattcgattttgtggtttggaactgtggttttggaatccagagtagtcgcctcgttctagtatccaattgctccagcaccaactggtgaaaagaccatcattcttctactcagttgcatttgaagctttgtcaaaaaccagacacaattggagacacaggttcttctatcaaggccttgactggaatggcatattttcagatatgaccacattgctttgaggaaatgaggctgatgttgcagagctgataaaacccccacagaaaggccagcctacctctggcagttgcaactatgatttccctatgagcactacttttgctgcatcctgtaagttttgccatgagaggatacagtgagaagagggtgatctgtaaacccagaagagtgccctccccagacactggaacttctaacactttgatcttgaatttcccaacctccagaactatgagaaataaatgtttgttctttatgccacccaacatttgatattcttgtacagcagcctgaattaagatagtcacagtgcgtaatgttttgttattttattcagtttgctaatattttgtggaggacctttgaatctatgttcatgaaagctattggtatgtagttttttgtttttttgttgttgtttttatttttttgtactggttttgatatttgggtgatactagcctcacagtgagttggggactgttctttctttctggaaaagattgtgaaaatgcattgttatctctttgaatgttttgtagaattctgcagtgaaaccatctgggcctgggattttttaggagattttttaaaataaattcagtttctttaatggttaatatagggctacctaaattatctatttcatcttggttgtgtttggtagtttgtggttcctcaaaaggcttcattacttctaagttttcagtaaaaaaactgttttagagtataaaactttgtgtaatattttcttattatcttagtggctacaggatatgaagtgacatcccctgttttattcctcatattggtgatatctgttttctcttaatttttgtgactcttgaaagaagtttgtacattttattgatttaaaaaagaaacaggccgggtgcggtggctcatgcctgtaattccagcactttgggaggccgaggcaggcagataacgaggtcaggagatcaagaccatcctggctaacacggtgaaaccccgtctctactaaaaatacaaaaaattagccaggcatggtggcgggcgcctgtagtcccagctactcgggaggctgaggcaggagaatggtgtgaccctgggaggcggagcttgcagtgagccaagatcgtgccactccattccagtctgggcgacacagtgagactccgtctcaaaaaaaaaaaagaaaagaaaaaaaagaaagaaatcgtcttttacttcattaaattttcttctctgctatttcttatttctaattttattaattattgttctgatctctatattatttccttccttttttttaagaaagagagactctcactctgtcacccaggccggagtgcagtggtgcgatcatagctcactgcagtcttgaactcctgggctcaagcagttctcctatctcagagtagctgggactacaggacacaccaccatgcctaatttttaaaatgttttgtagaaatgaggtctcgctatgctgcccaagctggtcttgaaatcctggctcaagtgatcctccctgccttggctttcctaagtgctgggataataggtgtgagccaccaagcctgacctccttcttcttgattgctttgggtttattttcctctgctttctctagtgccttatggtaggagcttagattgacttgagtccttttctcatgtttaatgtaaacatttaatgctacagttttgctctcaaaaatcctttagctgtatccaacatgttttggtatgttgtattttcatattccttaagtttcatttttaacttgagattttcctctttgtcccagcaatgatttaaaatttatgttgttcaatttctctgtgtttagagagtttcctgttgtcttcgttattgattatctgtttgattccaatattgtcaggaaacatgctacgtatactttcatttattttgcatttgttgaagttgttgtatggctcaggacatggtctatcttgatgaatcttccatgaacaattgaaaaaaaagtgtactctgcttattgggtggagtgatgtgtcactccatgattggttgattatattagtcagatcttctatattctcgctaatttactgtcagtagctttgtcacttgctgaaagatcatgttgcattttccaataataattgtggagttgtctgtttttccttttaagtctatcagttttgcttcatgtattttaagactgttttttggtttatacacatttgagatcattaagttttccttgtcaattgaatttttcattaacatgtattatctctctctgtcatctctaccctagtaggttttttttttttgcttttatttatttatttatctatttttaaatttttttttgagatggagtcttgctctgtttcctaggctggagtgcagtggtgtgatctcggctcattgcaacctccgcctcctgggttcaagcgattctcctgtctcagcctcctgagtagctgggactacaggtgcccactaccatgcccggctagtttttgtatttttagtagagatgggctttcaccatattggccaggctggtctcgaactcctgacctcgtgatccgcccacctcagcctcccaaagtgctgggattacaggcgtgagccaccgagccccaccccatgcatattttttagacagtagggagaaaccttttacagataagttacaaacaaagaaaaggcaaataaacaattttgtacaagaaatttaacacattctgtacaagttgttcactttgctgtcatcatttgtacaaactcttcatagatcatttgaccatcaccatcaatatgtggttacctgatcatttcatcaacctcgtcatctgttaaattctctccaaggtttgtcatcacatggtgaagttctgttgcactaatatagccattgccatccttatcaaacacacagaatgcatctctaatttcttcttcactgtctgtgtctttcatttttcttgccatcattgttagaaattcagggaagtcaactgtgccattaccatcagcatctacttcattaatcatgtcctgtaactctgcttctgtgggattctgcccaagagacctcattacagttcctgattccttgttgttatagttccatcaccatctttgttaaatagtgaaaaagcttctttgaattctgcagtctgcctttcagtcagttggtcagccatgctgcaagcgctaccagtttctgagatgtgaccacgcagccactcagcttgctcactcgctcgctccactcggactaattcctatacattattttttttgagtcggagttttgctcttgttgcacaggctggagtgcagtggtgcaatctcagctcactgcaatctctgcctctcaggttcaagcaattctcctgcttcagcctccccaagtagctgggattacaggcatgtgccatcatgccaggctaattttgtatttttttagtagagatggggtttcaccaggttggtcaagttggtctcgaaccctgacctcaggtaatccacctgcctcagcctcccaaagtgctgggattataggcgtgagccaccgtgcctggcctataatttttgtttcaataatcaaatatgatttataaaattcatggtttatgaaacataccattgtatgatttataaaacatgcttttgtatatgtttgtatttctgctctttctgttgttcctttttccttcctaatcctctgagatatttgatcatttattttctatttaaagaactttctgtagccaatctttaaggataagtctgcaagcaacaaattcttttatttttcattcatctgagaattcattcctagagaataattttggtaaatgtgaacttttcagtagaaagttattttcttttagcaattaaaaaatgctgtaccagctggacgaggtggctcaggcctgtaatcccagtgactccacagtccaaggtgggaaaatcatttaaggccaggagtttgaggccagcctgtgcaacatagcaagatcccgtctcagggagggggagagggaaacttagttgggcatggtggtgctcacctgtagtcccagctactcaggaagctgaggtgggaggatcacttgagcccagaagttggaggctgcagtgaggcatgattgagccacttcactccagcctgggtgacagggtgagacccactttgtttaaaaaaaaaaaatagctgtgccacttccttctggtctccatggtttcagatgagaaattgtcattcaaatagatattaccctatagataatgtgtcatttttctttggtttttaagatcttttctttaagaagtttaactgattaaatttgcacttagtttttaagaagtaattttttttttttttttttttttttttgagatggagtcttgctctgtcaccaaggctggaatgtggtggcgggatctcggctccactgcaagctccgcctcctgggttcataccattctcctgcctcagcctcccaagtagctgggactacaggtgcccgccacccatgcccggctaattttttgtatttttagtagagacggggtttcaccatgttagccaggatggtcttgatctcctgacctcgtgatctgcccgccttggcctcccaaagtgttgggattacaggcgtgagccactgctcctggcaaagaagttaattttgatgtgtcttggaatggatttctttgggcttaacctgttgggatttgctcagattcttgaatctgtagttttctgtttttcaacaaatttgggaagtttcagcaattattttttcaagtactccttcagtttcactctcttccaccaccactctcatggaactttggtgatgcaaatgttggctattttgttattatcctacaagtctctgagcctctgttcattttttcctgtttttctctctgttgttcaatttgagtgaattccactgattgtcctgaaagactctgatgctatcctctgttttgtccattctactattgctgttttatttctgttagtttatcttttggttttggttttgttttagagatgaggtctcactatgttgcccaggctggagtgtagtggctattcacaggcatgattatagtacactacagcttcaaactcctgggttaaaatgatcctcctgcatcagcctcctgaatagctaggacacaggtgcatgccaccacacccagctctatttttcagcgttataggttccacttagttcttttttattatttcaatttatttgctgagatttttcgctttttttcccatcgtttttagagaatttttaataggctattaaagcatttttatgaaggctgttttgaagtgcttgccaaataattccaatacctgattcatctgtattggtatcagttgattgcctttttctcattcaagttgtgactttcttggttcttggtatgactgatactttatattatatgttggacattttctttgtaatattaggagacagtaatattttttgatcatctagtttatgctaaacattgtattatgtgctatcttacattattttaatgaaactaagatctctgaaaatatattttgctgagatttgcacaattactgcatttctacaaaaataataatttttggtttacacttttctaccaacagtgtgttttaggatttccatttaatatagaactgagcatattagttaatcattcaataattacatgttccaagcatgagaagtataggacagaatccattactgaattgttcgacttggtgcaatggctcacatatctgttttccttgagttcttttttgaataaaatatcctcatgtgaaacttaagagcctttgagaaatactgagcaaaatgaaatttggaaagtaatatatgatattatagtagaaattatgttcaatatttcattacatttataataaaaataacatagttgatcatcctcaaatctatgaaattcatcataaacacatcataaatgtcttttctgtgctctctgcacattgtcatttcataaaaatgaacaatacttagacgtccacaccagtgatacatagttaatgatatgctgacagtttaaagacacagtagggctgggcatggtggctcacgcctataatcccagcactttgggaggccaaggtgagaggatcacctgaggtcgggagttcgagatcagcctgaccaacatggagaaaacctgtctctactaaaaatacaaaattagccgggcatggtggtgcatgcctataatcccagctactcgggaggctcaggcaggagaatcgcttgaacccaggaggcagacgttgcggtgagctgagatcatgccactgcacaccagcctgggcaacaagagtgaaactctgtctcaaaataaataaataaataaagacacagtagtacatggaggccagaggcacatgcagatccccaccaaatacacacaaaattaaacattggaatatgtatgacagcctttaaaaaattcatttccaaagaaaataaatacaaatcagagcagatatgtaatctttttttttcttctagagacagggtcttgctctgttgcccaaactggaatgcagtgatggaatcatagctcagtgtaatctctacctcctgggatcaagagatccttccacctcagcctccagactagttgggactacaggcatgcaccaccatgcccggctaattttaagttttgttatagacatggggtcttgctgtattgcctaggctggtcttgcactcctaccctcatgtgatcctcctgccttgggctcctaaaatgctgggattgcaggcatgagccactgtgcctagctgagatatgtaatcttgaaaaggaaaaatgggttccactttatattaatctgattgaagaaatgatataaccacagaaataatgcaaaggagaaaagggtacaagaaagtatgtagcaaccagaggagggtaggaggagctccagcacagaagcctaggaaagacttggccatgcaattatggacctttagatctggctctgtccagaaaaactgtccattcgggtctccccctacagtgaagacaaatgaaccagcttctcacaccaccttgacagtggtcattaagatcatccaaattgctctgtgaattctatgtccatgtccaccaagcaagcttctgacagtaattcatctctcatgaaaattaggccacaagaatatgtgctaatcagggatcaccagtatctagctaattgatatgaaagttatattttataattgtaaattaatatatcagtatcatattttttgtatatttgattcttattgatttggttaatatcgggggaaccagcccctgataattcaatgtaagttcttttctgttttccctaggtgttggccagattgagaaataaagggaaagagtacgaaagagagaaattttaaagctgggtgtccgggggagacatcatatgtcagcaggttccgtgatgcccctcaagccacaaaaccagcaagtttttattagtgattttcaaaggggagggagtgtatgggtcacagagatcacatgcttcacaaggcaataaaatatcacaaggcaaatgggggcagagcgagatcacaggaccagggcaaaattaaaattgctaatgaagttttgagcacgcattgtcattgataacatcttaccaggagacagggtttgagagcagaaaaccggtctgactaaaatttactaggcaggaatttcctcatcctaataggcctgggagtgctacgggagaccggggcttatttcatcccttatctgcaaccgtctaagacagacactcccagagtggccattttagagacctacccctgggaatgcattctctttctcagggctgttccttgctgagaaaaagaattcagcgatatttctcctatttgcttttgtaagaagagaaatatggctctgttccacccagctctcaggccgtcagacctaatggttatctcccttgttccctgaacatcactgttatcctgttcttttttcaaggtgcccagatttcatattgtttaaacacacatgctttacgaacaatttgtgcagttaacgcaatcatcacagggtcctgaggcgacatacatcctcagcttacaaaaatgacaggattaagagataaaagacaggcataggaaatcataagagtattgattagggaagtgataaatgtctatgaaatcttcacaatttatgttcagatattgcagtaaagacaggcataagaaattataaaagtattaatttggggaactaataaatgtccatgaaatcttcacaatttatgttcttctgccatggcttcagcctgtccctccattcggggtccctgacttcccgcaacaggttaacctgattccgtacccaaaccccatcacatcaagggtagcaatacctgaatatctaaacttctaaagcagagaaataaacctggaacatggtcactctaccaagaaattgttaccagacctgtgtggctggacacctgattctcccctggcaaatcttctatttcattcggtcatcatcaatatttttttcattttcaatttttaacagtaggcagatatctaagtttaactgtctcaaaggtttgatatatgacttagggttgtatattattcagtgtttatttaaaagaatagaaaagtccaaagacaggttcacaataagcaaaaatacatacatacataaataagcttggagacttttataagattaaaatgaagttcttacaaatacttaaatcaaaatgcagcaggagttatgacagcaaaatcttcagtcttatttttagagacagggtctcgctatgttgcccagactggacttgaacttctgggctcatgtgatcctcccacctcagcctcttgagtagctggaattatggatgcacaccaccatgcccatctgaaaatctgcagtattgacactgcactctataatgcccttccttattgttctcttgacagtatccccactgtatatttgtgaagatggctgaatgtattgaagtagatactgcttttataacgtcaaagccattataatgtcaaagccataaccataaggttatgggactgttaactggtgggtatcacaaccctgtttatgagaaaagcattcagaactgcataggggaaggtgtagtgaaatatttattataggatatatcttggagctggcatattccaagataggccatggaatatgactcttttttttgagatggagtcttgccctgtcacccaggctggaatggagtggcatgatctcggctcactgcaacttccacctcccgggttcaagcacttttctgcctcagcctacagagtagctgggattacaggcacctgccaccatgcctggctaatttttgtatttttagtagagacagggttccaccatcttggccaggctggtcttgaactcctgacctcgtgatccacccgcctcagcctcccaaagtgttgggattacaggtgtgacccaccacgcctggccaggaacgtgactcttagtagtgcttgtgaccaaaacctacagaagagaaaatgcagtgtaatatagaagtaacccttagaatgactaatccagttggataaaactcttctctgtttctgtacctacaatgtgaggggatgggaggtgggaaaagtttggaaagtaccttatactggaccttttctgtagaactctcaatttttgtactattatcatttgctaatttgacatgaaatttaagcaaccagcaatgaggaaatacttagactgtaacagagctcttcagagttctttgttttgcaacaatcacctttcaaaacttccctaacaacttggacagacaaacccagtcgaatttacagatgcttgtggaaaggttagagaatttgaaagaaataaaaaagagttgggagtgaatatgtgtgtcttactgcttcggttttgtttcctagcatttattggttcaaatagatttgttgctttgctgactctctgctatcttcataaaagataagaaaacctctcagcgtccctctatagtgtgagaaacatgatttataataacattatttcataattgaaagtattgtttcgttgtctgggaaaatgagcgcatcagaattaacttgtagttttagaggccagtgggttgctataacaaccagaaaaacaatggtgtaataacacctctccctgaaagctggagaactcactaaatgacgagagctacagatgcaagcgtttgtcatatgaattcaaacaagaaccaaatacattcatttatttctttcatgagcactgactccatgcctggcactatgctaggaactggtgaaatagacgtggtccctcctgtgatggagtgaacaatctaatggagaagaccgataataaacagtttaaaaaaaaagataaatggaataatttcagcatgtttaaggccctttggtagagaaagcattgttctctgatactggacaagcagagaagggttgctccagtatgggacatggagaagcacctggtcatatcataaatcttgcctttaaggctatatgagctctagtaaagtgaaggaaaaaaagaatggagtcttacagtctttattagtaaaaataatttaagggaagaaactgctaactgaagcatgatcattttttactagaagggtttaacacgtaaattcccagaattcttgaattaggaggattcaacattaaaataagagttatttgtgtgttttaaaacagtattgttttgggccaggcgcggtggctcacacctataatcccaacactttgggaggccgggaggccaaggcaagtggatcacctgaggtcaagagtccgagaccagcctggccaacatggtgaaaccccatctctactaaaaatacaaaaattagtcgagcgtggtggcacatgactgtagtcccagctactcggggggctgaggcggggcaatcgctttaacccaggaggcagaggttgcagtgagccgagattgcgtcactgcactccagcctgggtgacagaaaaaaaaaaaagtattgttttatttcagctttactcataatagccaaaaactggaaacaagcaaataaaaccaaatgtccttcagtggatgaatgattaaacaaactgtgttatatacataccatggaatactctggcaataaaaaggaaatgaacttttttttaagaataaaagctttattgagatataattcacataccataaagttcatctttttaaagtttaaagttcagttgtttttagaacactgacaatacaaacactacttagataattgtgcaaaaatcaccagtaattccaaaacactgtcattactcccaaaagaatctccatatctattagcattaccatatctattagcattactccccatttccaccttattgtccatatgttcacgccccagacctaagcaatccttaatctattctctgtctctatggatttgctgattctgaatctctcatataaatggaatcacacaatatgtttccttctgtttctggcttctttagcttaatatgctcaagagtcatctctgttatagcatgcatcagaactctatttttttatggataaataagattccattgcactgatattgaccttttgctcatctatttgtcagttgatgagcattcgggtttttcctcctttttgtcggttatgaataatgctgctatgaacattagtgtaccagttttttctgtacatatgtttccagttctcttggttatgtacctaggagtggaattgctgagtcatatggtatctctgttaactttctgaggaacagaaaactgttttccaaagccattgtaccattttacactcctaccagcaggtatgaggatttcagtttttccacatccttgccatccttgcttttgtctttttttgaattttcatgtcaaaggggtaatgttccaatgaggtcataacaaggcttggggaaggcacatttcacacatgcacgtgaaaccccagtcatcacgcttataaactacaaaaggatctgcttttgctttttattatagccatccaagtaggtgtaaagtggtatttccttgtggtttcatttgtatttccctaatgtgttgagtatcttttcatgtgcttgttggtcatttgtctatcttgtttgaagcaatgtctgttcaaatcttttctcaatttttcagttgggttatttgtctttttattgttgaattgtatcagttctttacatattctagacacatgtcccttatcagatatatgatttgcaaatattttctcccggtgtgtgagttgtttttttacttttttttcactcacattatgtatgttgatgttatgatttgaagcacaaaagtttcattttggttaagtctaatttcttttgttgaactactgattgttttttaagaaataaatgccctgtacatcaagctgtatacagagtgtactctgaaataggtcgaattaaaagaagtcctgattatggagattttcagtgagctgttaggtcaactcgtggttaattctctgggaatgagcctttttgggcttcaaatctgttcttttctctccagtggctgctaagctctactttccacaactactataaatgtgaagctattgagtttcaaggcttccatggaactggggagaggtgtataggattagagcaagttaaaacactataggctttccgttcttactgagattcagctgtttttcttaggtaaacattccttggaatgtggcaagcttttgttaatttccacaattctaataagtttatgtcaacagcttttgctaatgtcctcattgcttttatggaggagcagattctcggtgtgacattactgtaccatttggaatgtctactgatatacacgataacttggataaatctcaagagaattatgctgagtgaaaacatgatctcaaaagattaaatacagtatgattccatttatataacttttttttctttgagatagggtcttgctctgtcgcccaggctgcagtgcagcagcacagtcatagctcactgtaacctcaaactcctgggctcaagtgatccttctgtctcgacctcccgagtagctagaattacagccaccacacctggctaattaaaaaatttttttgtagagatgtggtcttgctatgttgcccaggctggtttgaaactcctgaccacacatgatcctgctgcctcaaccttccaaagcactgggattacaggcataagtcaccatgcccaccctatataacaaatttaaaatgacaaaattacagagatgaattacagattaggggttgactagggagatgaggagggaaaagcctgtggctataaaagcaaggcactggctgggcacagtggctcacgcctataatcccagcactttgggaggccaaggtgggcggatcacctgaggtcggaagttcgagaccagcctgaccaacacggagaaactctgtctctactgaaaatacaaaattagctgggcgtggtggagcatgcctgtgatcccagctacttgggaggctgaggcaaggagaatcacttgaacctgggaggtggaggttgtggtgagccgagatcgccccattgcactccagcctgggcaacaagagcaaaactctgtcttaaaaaaaaaaaaaaaaaaaaaaaaaaaagcatggcacaaaggatatttgtaatagaactattttatatcttgactgtgttgatgttctcatgaatctacatgttaataaacttcatagatttaaatatacacacaccaaacgcatgcatgtaaaagtggtaaaatgtgaattttaatgatttgtatcaatgtcattttcttggttgtgatattttactatagttgtgcaaagtgttaccattgggaaaaacaagtgaaggatatacaggatctctctgtattatttctcacaactgcatgtgaatttacaataatctcaaatttttgtttgtaaaacaaaaaggagtatcatagctcataatagaaattatataaggaaaattatattacataattgagagaagcaattcaaaatattctctggcagctgttttgaggtttttataaacacaaaatgatactgtaaatatatattgaatatattaatactaggattccctgattaagatagcacaagaactgagtgagcaactaagttctgaatagatgattatggctaatgaggtgggcttcaatagaagggcagataagtacattactccatataccactgcaaaaatgattcaggcacagaaaatgctctgtagcctaacttttgtgaggtaccccttcctaaaacattcatatatgtgattcatttaaaatagaattgcagaatcataggtgtttcaacaagtataggcatgaatgattctgtaataagctaaacaagacaaagctccaccaagatgcttggaacatgctagaactgagttaaaactgaatatggtatatttcttatccctcatataactaaaaaacattcataaatatatatatgtatatatacatatatatatattttttagagacagggtctcactctgtcactcaggcgggaatgcaatggcgtgatcatagctcattgcagcctcaaactcatgggctcaagtgatcatctctcctcagcctcccaagtagctaggacaacaggcatgcacaaccacacctaattttttttttttaatttttattttgtagaggcagggtctcactatgttgctgaggcttatcgtgaatgcctggcctcaagcaatcctgcctaggcctcccaaagtgctgggattacaggcataagccaccatgctcagcctaaaaatggcatattctggtgtctaatatctaatctgaagaaatttcaaggtaccactcataaaatgtgtccccagcatcctattattccaaagacttcaacttaattttgtcatatttactttcaaggcaaaatggaacccttctatgttgataaaatgttttatatatggtaagatttgaggactttacatatttagaggaattcttgttttagatatattattagtatgtcttcatcaaaaagatgtgaaatccgttaaagccccacctccacagatctcattttaaacactagggtatgcctcccctttctccaaatcttctaggtttcctgacaagttgtacagttggctgattctagttttctgtcatttctcccttcttttttttttttggagatggagtctcactctatcgcccaggctggagtgcagtggcgtgatcttggctcactgcaacctcctcctccccggttcaagcaattctcctgtctcagcctcccgagtagcaaggactacaggcgcacaccaccacacccggctaattttttgtattttagtggagatggggtttcattgtgttgcccaggctggtctcgaactcctgaccccaggcaatccacccaccttggcctcccaacatttctcccttctttaacattaacaaacagagctgacatgagaaaaagacacaaagttcttagaacattgtgaactggatacacagctattaagagtccttggtatttcagatatctcaagcattattatcagcatggtaactttaaggttgattccaggtataattaaatatctcatgatagtaaacgcacaaaggcttttgaaaagtttagattgcattttgaaataaatatgatgtgatatctttaaatttttactgtaatactgtgcaaattgtttagatttagaaatgattttattgctccttaagcattcattcaattcttattcagggaatacacagaacataggtagtatttgggaaggtacatcttattattaccttgatataattatatcataa

SEQ ID NO: 2357 - DNA, 2348 bp, Homo sapiens
taggacagaaatttaccctgcaagatactttcatatatgaaattattctcttttgaaccttccttaccaaaaatacatcttcatagctaacttttttcacatctctcctacttactggttttctaccttctttcataactaacctttaaataacatccaaattaaataaaattattctttttctccataagaacacatttatttggcacattttatatatagaattctatattaactaaaattcttactcttagtaaccttaaattttagtgaaaacctaggaggcaagaaatattgaattgtctgttctctatcagcactttaaagatgagaatcacgtcacaatttttagaaacgtgtttctggccaagcatggtagctcatgtctgtaatcccagcactttgggaggctgagtttacattctccccttttagccaagatgtgccagagatgacattggtgaccaaacatttattttttcccatatctttgccggggtggtgtggctacctgctgcaggttcattctgttctttggtgggatccttatggccaagggacttggagccaattaaacattctaggccagatgaggatggaggtgaacaggcactcattaacccttaaaaaccttttgagcaacagaagagccaaaaagcaaggttacaacagtgacttacctgtaagttctatgtgacgagtcatcagctgtttagtaacctgtatgacctgttaaccatttttgtagcctgtgaatatcagatgttcatttaagtcagaaccttaaacatgtggatatttttgccaacaactcagaagctaacaaaacagctaacaacttagctgttttcattgaaccaacaatattaaattagtcttatttgtcaaaaaattcacacaaagatcattctctttttgactgggtttatagtcttataatcttttgtgccaaatcctgataccttaaaacacctagcggaggcaaatataaaataatcagtaaacccagactaaaaaaaaaatgtatgctgacaattctgaagacatttctagttttattttaccaataattttaaaaccattttatttaccagattactaagttcacatgaatctgaaaagtatttggacttacttaatttatgagtataatttacttataaaccagtttggtaccatgctagatacaacacaacataatacatgttcatatacaaacatttaaacacatacacacaaagatcttacagcttttactctggaaccttagccatgagatggtaatacagactcaccacttaacaaaagacagctggatccaaattatttctgacaaaattgggacctgttcacatggctaaactttatttgtcccagtaggtaatccaatgaaggctatggaccaaagtcttgggaaaagtagttttcatggcagttttatttttaaaaaccttttaccccttttttttttcctgaagtttcaaatgagttttcagtgtttacattttagctacaattggctgaactgtaaagaaagctccaagtagccttgaattagtagtatcataaacaatgagttttatcttaacagcagtagcttaataacagcaaattcaaagcaggccgaaaacaaaaaagagatagctttagaaaactctacattttaattgtatagttgcaggttgggcatttgagctctgaattttccttgctgtaatttgcccgttcagttttaaaatgtgcacaagaacaggccacaatatgcagctagctgaagtgctggaaaacctggcatgcctttgaacttctacaggagttcctgcccctagtgggtaagttacctattgcactgactttatgaagatatctcttccagtgcccttagtgtgagcatccccacaaaccttatgaaccagttgaatccaacctgaatgcctctccataagcccggagcccacaaatgcattttctccagggcccttggatggagggaatcaggaaggcctcctccaaacccaaggctaggagagatgttccctccggggtccagggaggagaacagaaaggactgagaagaactaggaatgccctcccaaacccaaggccagcaggagggtctcctccggagttccacagatggaggaggcctaaaagaagaaatcaagtctgcaacctaaaagtgggagatcttggattttgatagcacttacccagatcctttcccagcatagtcaggaacaactggactttttcaaagggaccttggctgtacctggtgtcctgggtgacacaggaaaaggaattcaggggctgcttcagaatcccatctttgccagatacgttaactt

SEQ ID NO: 2358 - DNA, 695 bp, Homo sapiens
ttttttatttttttttatgtttttatttttttttaagacaaggtcttactctgttgcccaggttggagtgcagtgatgcaattacagctcactgcagctttgaattgggctcaagtgatcctcccacctcagcttcctgagcacctgggaccacagatgtgtgccacttcgcctggctaattttgaaaaactcttttttgtagagccggagtctccctatattgcacaagctggtcttgaactcctgggctcaggcaattctcccacctcagcctcccaaagtgctgagattatagctgtgagccaccgtgcccagcctgaagctagaggctgttttcaatatgtcattattctcatttggttaggataagattgaagggaggggtagaaagtttcaaaggcggagagtttcaaaggcatcatgttaacaggcagcaacacgatcaagccccacacgaaggaaccaccaagactggagtgtgcattctcattgtaggaagtcttctgctaacttgttgaattcatctgcaaaacgcaaatgcaggaaatgattacctaatggatcaaattggtccttcaatcacaaccattttgtaacaatgcactccaagattagatcttagctactctattttctcagtaattaaaaaaaaatgagattataaacataaacagctgtatgaaaataaactata

SEQ ID NO: 2359 - DNA, 8659 bp, Homo sapiens
gtgcgcaggcgcttgcggcttcgcggggctgaccgtgcgcttcgcctgcggggtcgtgctggggcggcgggtacgctatttgaagaacaggtttccatgctcttagaggagcatcagaaaatgaacaaaccccagaagtccagaaattaagagacctgataaagggaagccaggaaaatcgagatgcatatttgtggtacacttcagttctcagtaacaacacactgactaagaagagggaatacgtttttgggaaaaaccttaatctgggtgcaaacccagtttcttcaagaaaaatagcctgttagtatgactcatgtggaatgagtttgaatacgtttcagaatcaagtattagtgataaaaattatgccagtaataacactgatgaaattaatataagtgagaagttgccttttgatagtaatcaggaaaacactcatactgggaagaaatctgttgtatataaccaaagtgggaagtcaccaagtcatagtgaggaccttattaaggaacaggaaattcaagctttagcccacctttggaagctaatgaacatggaaatcccttccttgagaaggtagccaccatcacacaagagacagctcaaacaagagagaaaccctgtgattataaggagcatggggaaaatgtcagtgccacatcagctcccagagttcatcaagaaattcacacaaggaagaatcactctgaagttaacgagtgtgagaagtcaaccttcttcaaacatcagaaagttaatacaggggtgaaaacccagggagctaatgaaaatgagaatttcagtcacaagtcacatctcagtctgcctcatagaactcacacagtagagaaaacttttgaatgtagtcatggcaagaaatctttttgccaggagtcccacttcactgagcatcacaggacatgcacaagagagaaaccatgtgaaagtaataaatatgggaaaaccttccagaaatgacaacttaccaactctcagataatgcatcgagaagagaaaccccatgaatctggtaaaacccttgtgaagtcagccctcactgatcaccagataagtcaatcagaaaagaagctttatgtatgtagtgactgtaagaaacgtttttgtcatagctcagtcctaagagtccatcagagtattcacacagggagaaaccctatcagtgtaatgggaaatcctaagcaaaatcaaacttcagtcatcatcagagaactcacacaggggagaaaccatatgaatgtaaggaatgtaggaaatccttccatgtgaaaccaaacctcactaaacatcagaaaacacatataggggagaaacctttcaaatgtactgcgtgtggaagaactttcttccagcagtcacaatttgctgattattagagaaaacacacatgagagaaatcctgcaaatgtaatgaatttgttggccgggcgcggtggctcatgcctgtaatcccagcactttgggaggccaaggcgggcagatcacgaggtcaggagattgagaccatcctggctaacacagtgaaaccctgtctgtactaaaaatacaaaaaattagccgagtgtggtagcgggtgcctgtagtaccagctacttgggaggctgaggcaggagaatggcgtgaacccaggaggcagagcttgcagtgagccgagatcatgcctctgcactccagcctgggtgacagagcaagactccgtctcaaaaaaaaaaaaaaaaaaaaaaattaatgaatgtggaaaatcagtccttctactataagtcaaccctaaatgtccatcagggaaagcacacagaagagaaaccctataaatatactgagtgtgagaaatccttctataaatcagtgctaattatacatgaggaaacacagataagaaaccctatgcgtgtaatgaatgtgtgaaatccttttgtgtgaagtcaagtctcagtaaacaacaaaattcacaccagggaaaagccatatgaatgtagtgaatgtggaaaatatgaattcaatcctcattgtgtatcagagaactcacactggggagaaaccctgtggatgcaatgaatgtgagaagtccttctacaacaaggatgccctcactaaacataacagaactcacacgggagaggccacataaatgtaatgaacgtaggaagtccttacaaccctagttatacaccagagaactcacactggagagaaaccttacaaatgtaatgagtgtgaaaaatcctatctgaagtcacatctttttttttttttttttaattttttgagatggagtctcgctctgtcacccaggctggagtgcagtggcgtgatcttggctcgctgcagcctccacctcctgggtttaagcgattgtcatgcctcagcctcccaactagctgggattacaggtgcctgccaccatgcccagctaatttttgtatttttagtagagacaggctggtcttaaacccctgacctcaagtgatcagcctgccttggcctcccaaagtcctgggattacaggcatgagctactgcacttggcctgaagtcacatcttaatattcatctgagaaatcacacaggaaagagaccccatgtatgtaatgaatgtgggaaggccttttctatgaagtcaaacttcactgatcatcagagaacacactgagaagagaaatcctatgaatgtactgaatgtcagaaaacttttcaccataaatcaaccctaacagtacatcagagaactcatatggggagaagccttataaatgtaatgaatgtagaaaatctttctatatgaagtcagccctcagtcagcatcagaggatacatatatgggaggaacattgtgaatgtaaagaatgtgggaaaacctaccagaggtcacaccttgctaaacatcatcgaaaatacaccacacaagaaaccctatgaatgtaagcaatgtggaaaaaccttccagaagtcacacctcattgaacatcagaggacacacccaggggagataccccatgaatgtaataaatgtgggaaatccttctgttataagtcacccttgaccattcaccagagaactcacatagaagagaagccctataaatgtagcaaatctgttacttatttctgtatgaaatcacacctcactgtgcatcagagaccccataccaggaagaacccttttgagtgtaatgaatgcaggaaaatgttttatgtgaagtcaaacctcatcaatcatcagagaactcacacaggggagaaaccatatgaaggcaatacatgtgggaaatctgtatgaagtcatcctccacacaagagtgatactctgaattgtaacaaatatgggaaatcctcatgtgtaaagtcaatttgtttttcaaaccaaaattcatggtagaaaccttatgaatgtaaataatgtaggggtctccttctgtgtaaattaaatccttagttggcatcagaaaacacaagatatagggactggaggcctctccacaaatgaaatggatatgggaagattttgtgttatcttagaaaatactggccgggcatggtggctcacacctgtaatcccagcactttgggaggctgaggcagatggatcacctgaggtcaggagttcaagaccaacctggccaacatgaggaaaccccatctctactaaaaatacaaaaattagccaggcgtggtggcaaatgcctgtaatcctagctacttgggaggctgaggcaggagaattgcttgaacctcggaggcggaggttgcagtgagccaagatcatgccattgcactccagcctgggtgacaagaatgaaaactccatctcaaaaaaaacaacaacaacaaaaaaaaaaccagaaaactcaaatgaggagagacccctgagaacatcttgtatattagtatccaccaagaaatcaaatacagtatgtttcacataaatcacagggaaaaaccgatagaacagtaatataaaagcatttacaaagttccagcacatttgcacaacatatgattgatactggtgtaaaactatgttttctatgcatgaaagctttcaggaaaaattcaactataagcagacaattaatactgaggggacgtctatcagtttaggagatagagatactttatttttttgagatggagtcttgctctgtcgcccaggctggagtgcagtggcgtgatctcggctcactgcaagctccgcctcccgggttcacgccattctcatgcctcagcctcccaagaagctgggactacaggcacctgccaccacacccggctaatttttgtatttttagtagagatggggtttcaccatgttagccaggatggtctcgatctcctgaccttgtgatccatccgccttggcctcccaaagtgctgggattacaggcgtgagccactgcgcccggccgagatacttttttttccctacaaatactgtaatactagaagtcacatttcaggtaccaaatttagcaaatgtgatgtgtgatacatctaatgctaatgacattcattgttggaagatgaagtcttttgaaaaacaagttgcagcagcaagctgacagtattagatatttgagtacttgaggtaagatggccttacatttgttagtgggcagcatacaacatacatacatggcctgtgtttgatttacatagtggaactccaccgagtggtcagcaggaaatatctctccatagcttaagaactgttgtaacacatctaccacacaaaatgcctccagtgtatctttgtatctttttgtttgtttgtttttgggtcagagtctcgctctgttgcccaggctggagtgcatggcactatctcgcttcactgccacgtctgcctcccagtttcaagtgattcttcctgcttcagccttatgagtagctggattacaggtgcctggcaccgtgcccagctattttttgtatttttagtagagacagggtttctccatgttggccaggctggtctcaaaacttctgacctcagttgatctgcccgccttggcctcccaaagtgctgggattacaggcatgagccactgtgcccggcctctttgtatcttaatagtacagtatacttgatatgtgacatgtatgacatttgcagtatacaatatgttattgagaaatgcagagtacagaaaactatatggcttgctgccttttgtttgagaattgaggggaagaaataatacgtatgtacatagatattttgtatatatatttatctattatatatgtttatatatttttttaatttttaaattttttgtagagatggggctcgctatgttgcccaggctggtcacgaactcctgggctcaagcggtcttcctgcctcagtcttccaaagtgcttagattacaggcatgagctactgtgcttggccaatatattttatataatatatatattttgcaaataagtataaactacaaactacaaacctgaagagtaaattacaaactcaaaagtgaatgcctatggagataggagtgaacagggtggcagggctgaggatagagacaaggcttcttcacgtgtagctttttgtgaagttttgacttttggataaatatgagtaatttacgtactcaaaagcacattttgaaattgaaaccaaagaagaaatcaactgaagtttatatcaaattggtaacttcactaagtagaagagctcattctttcaagagacttttaaatgcagtatgatgagcatatccttagtgggatttgtttctgttttaggacaaaaagaacttaaaaaatgacatttagaagacacctggctaggtctcttcaaaaagctgacttttttttgagacggagtctcactctgttgcccaggctggagtgcagtggcgcgatctcggctcactgccagctctgcctcctgggttcacaccattctcctgcctcagcctcccgagtagctggggctacaggtgcctaccaccacacccggctaattttttgtattttagtagagatggggtttcactgtgttagccaggatggtctccatctcctgacctcgtgatctgcccgcctcggcctcccaaagtgctgggattacaggtgtgagccaccacacccacctgctgccatcatttttaaaaggagagaaaaggtggagggactatttttcaagggcaaacatgctgaatatagaaagatgaactggcttgatgtctgcagccttgaagtggctcaggaaaaagatgcatgcatcgataaagcaaaaatggcaaaatttaagcaagtgttgatctggcaggcacatgggtattgactgtttttcttacaagagttgtgtttgaaaaatttgataataaaaagttttggagaagtactgtaccacttagcaattctgttactgttctttggcgtatataaatagctctgcccgtgcttattgatctgcttgtcaataaagaagccaaacagtaacctttaaagtgttcagttgttttgggttttagtcacttcaataaaaacagaacataaccaaaggctggtcatggtggctcatgcctgtaatcccagcactttgggaaattgaggcaggaggattatttgagcccaagaattcaagaccagcctcggcaacacagcgagaccaccttgtctctgtaaaaagttgaaaaattagccagacatggtggtgtacacctgtggtcccagctacttgggaggctgaggcaggaggatctttgagccagggagtttggctttgcagtgagctgtggttgtgccactgcaccccagtctgggcaacagagcaagaccccatcacaaaaaaaagaaataatgcaaaggcagcgtattataccattaacaactcaagcttgtgttaagaactaggtgcaaacagtagtgctcattgcactgacaatgaaaatagtattgtataaagaaaatgtgcttctctttctactcctgacacgtttctaagcggtgcctccagaagtacatggcataggccccaagcggtaggagcccaggaaccatttgccaacagggtggcagctgttgtgtcctcattctttctccctcctctacctggatttccttgcagcagggggcagactgttctaggctgctttgttgcatgaaagccttggtgtggcctgttttccccccctcaacagggactgtttgggttgggcatatgaccaagccttgacctctaggatgtgtagggaagtgttctgtatgatttttgggaaagggtttatcactgatgaagagacatgagcagaatcacattacccttctgaatacatccattgtttgcgtcttgtggcccagggctgtagttggaggttggtgagcagagatagaagagcctggccactgatggtatgaagcactgatttaacccacactgaggaggctctggattgggcacttgaggtcattagtttttcttattgtgtaagcctgttggagttgagatttttctgtgacttggagctgtaaggcatcctaactttgaagagggatagtttttgtttgtagagaaagggtctctatgttgcccaggctggtcttgaattcctgggcttaagtgatcctcctgccttggcctcctaaagtgctgtgatgacaggatacatttttttaaaagaagttgtgtaattcagaagtgttagtcacagtgatttgggggcaagaatgattttgagaaaatgattcagcagctgctttctgctctgtacatttatatgtaataaggaaatgcaggtacccttgaacagcacaggtctggactgagcaggtccacttgtaagtagtttttgttttttttcccaatagttggccctccttatctgcaggttccacatctgcaaccatatacagctcaaaactatagtattcacagaatgcaaacctgaggatacagagggccaactttgtatacaggttctgaagagtcaacttcaaaacttttgtatgcggagtttggtatccacagggggtctggaaacaattcccccatggatactaaggggcgactgtaatgtcatttcttatttgcaagaatccagagcggaaaatgttcttttcgaaattagttgcatattaagtattctttctcttcatataaaatgtcatttttaattgatcaaattattcattgccttttttttttgacaaggtctggattcatgtacggatgtaatctttacttttgcaatgaactgctagttgtccttacactatttaagaaatccatctctttgtccctggtttgaaatactatttttattttattttatttatttatttatttgttgagatgaagtcttgctcttgtcccgcaggctggaatgcaatggcatgatctcagctcactgaaacctccacctcctgggttcaagcaattctcctgcctcagcctcccgagtagctgggattgcaggcacctgccaccacatccggctaatttatatatatatatttttagtagagatggggtttcaccatgttggccaggctggtctcaaactcacggcctcagatgatccactcgcctcggcctcccaaagtgctgggattacaggcgtgagccaccatgcctggccgaaatactacttttatcatagggtaggtcactgttagtagtgtctttg

SEQ ID NO: 2360 - DNA, 2091 bp, Homo sapiens
agagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacactaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaaaaaaaaaaaaaa

SEQ ID NO: 2361 - DNA, 2079 bp, Homo sapiens
agagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacactaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtgggtgatagttttacttatgtacatcgatatacatctatttaaaaacatgtacatttaaattgttgcattttatgtatttaaaatttattgagtaatccttctgtatgtattattaaagagaatatagcaaaaaaa

SEQ ID NO: 2362 - DNA, 4340 bp, Homo sapiens
agcagaacttaattactttttttttttcttgagatggagtcttgctctgtcgcccaggctggagtgcagtggcacgacctcagctcactgcaacctccatctcccgggttcaagtgattctcctgcctcagcctcctgagcagctgggattgggattattacagacagttgccaccacgcccggctttttttttttttttttcttttttgagacggagtctcgctctgtcgcccaggctggagtgcagtggcgccatctcggctcactgcaagctccgcctttcgggttcacgccattctcctgcctcagcctcccgagtagctgggactacaggcgcctgccactgcgcccagctaattttttgtatttttagtagagacggggtttcaccgtggtctcgatctcctgaccttgtgatccgcccgcctcggcctcccaaagtgctgagattacgggcgtgagccaccacgcccagcccctccagctttttttgagaggagtctgactgcgatgcccaggctggagtgcaatggcgctatcttggctcactgcaacctttgctttccggttcaagagattgtccgcctcagcttccccaatagctaggactacatgcgtgcgccaccatgcccggctgatttttgtatttttaggagagacggggtttcaccacgttgtccaggctgatttcaaactcctgacctcaggtgatctgcccgacttggcctcccaaagtgctgggattacaggcatgagccaccatgcccggccaggatgctgtttttgtttcttcgtttgttttgtttagtttttgagacagaatctccctcagtcgtccaggttggagtgcagtggtgagatcacagttcactgcagcttccatcaaactcttgggttccattgatcctcttgcctcagcctcccaagtacctggcactacaggtgcacaccaccgcacccggctaatttttttttttttttttttttttttgtggagacggggtttccctatcctgcccaggctggtcttacattcctaggctcaagttattcacccgccgcagcctcccaaagtgctaaccaccacgccctacctttggcacccttgttgacaaccaattgatcataaatgtggtttgtttctggattcttgattctattccattgatgtatctattacttatttatttatttagaaacggagtcttgctcttcttgcccaggctagagtgcaatggtgcgatcttggctcactgccatctctacctcccgggctcaagtgattctcctgccccagggtcccaagtagctgggattacaggcacccaccaccacgtccggctaaatttttgtatttttagtagagacagggtttcaccatgttggcgaggctggtctcgaactcctgacctcaggtgatctgccctcttgacctcccaaagtgctaggattacaggcatgaaccactgcgtcctgcctgttattccttttcaatattcttttgcctactctgggtcttttgagtttccagttgtcatctttcttgtcaatctttgtgaaaatgaatcactacctttaattttacatcgttgagaccaccgcaattttttttttttttttttgagacggagtcttgctctgttgcccaggctggagtgcagtggtgtgatctcggctcactgcaatctctatctcccgggttcacgccattctcctgcctcagcctcccgagtagctgggcctacaggcgcccgccaccaagtccggctaattttttgtatttttagtagagacagggtttcaccgtgttagccaggttggtctcaatctcctgaccttgtgatctgcctgcctcggcctcccaaagttctgggattacaggcgtgagccaccacgcccggccgcaattattattattataattattttgagggggactctcgctctgttgcccaggctggagtgcaatggtgcgatctcggctcgctgcaaatctgcctccgggttcaagcgattcttccgccttaggctcccgagtagctgggattacaggtgcgcaccaccaccccggctaattttttaattttttaaatttttttttttttttttgagacggagtttcgctcttcttgcctaggctggagtgcaatggcgcgatgtcagctcactgcaacttctgctgtgggcggcaagccacccaggcgccgaggcaagagactgaggacacaagctgttccagtataataaaatataaaacaagaatagttataccagatatagatcttagacatgattatatatgaatatcattaatcattagtttgtagtaattactctttatcccaatattataataatccccgctctataatcataacctaggaaaaaccaggccatacagagatagtgtagcaggacgagtcgcagacaaaactcctcagacaccggattaaagaaggaagaggtttttttattcggccgggagcgtcagcagactcgtgtcttaagagccgagctccctgaaaaagaaattcctagcccttttaagggcttacaactctaaggggtctacgtgaaaaagtcgtaatagatcaagtaagcatgaggaacgtgactgggggctacaaacatcagttaacagaacaaaaagttttatagtgctttctcatacaatgtctggaatttacagataacaccagtagttttggtcaggggttaataataatattattattttagccaccagggccgggtggtggcgccaaggtcgtctagctatttatcttacttctgtttctttccaactttttgctttctctcttttctcctgtcttataaactagggaaaaggggaggttggggagaaactgggaaggacaacaggagaagtggtggcctcataccataataggagctgaggggacacagtgaggtgtgaccagaagacaagagtgcgagccttctgttatgcccggacagggccaccagagggctccttggtctagcggtgacgccagcgtctgggaagacacccgttgccagggggaccatggtctagctgtagcgaaaagtgtcaaggaacaacacccgctacttagcagaccaggaaagggggggggggtctccctttccccgggggagtttagagaagactctgctcctccacctcttgtggagggcctgacatcagtcaggcttgcccacagttatccggagacctaaccgtctccctgtgatgctgtgcttcagtggtcatgctcctagtctgccttcatgttccatcctgtacacctggctctgccttctagatagcagtagaaaattagtgaaagtactgaaagtctctgatatgcagaaataatggtgtaagctgtctttctctttgtctcctctctctctctgcctcggctgccaggcagggaagggccccctgtccagtggacacatgacccacgtgacgttacctatcattggagatgactcacactctttaccctgccccttttgcttgcatccagtaaataacagtgcagccagacattcggggccgctaccggtctccgcacattggtggtagtcgtcccccgggcccagctgtcttttcttttatctctttgtcttgtgtctttatttctacactctctcatcgccgcacacggggagagacccacagaccctgtggggctggtccctgcactctgcctcccggattcaagtgattctcctgcctcagcctcctgagtagctgggattacaggcatgcgccaccacgcccggctagttttggatttttagtagagtctgagtttctccatgttggtcaggctgctctctaacttccgacctcaggtgatccacccaccttggcctccgaaagtgctgagattacagacgtaagccacccctcccggtcttaattttaatttttactagagacgtggtctccctatgttccccaggctggtctcaaactcctgagctcaagcgattctctctccttggcctcccaaagcattgggaaacagacgtgagccaccccagtcaacctccttttgggattcttgcaacttttctgtaggtgagaaattatgtcaaagtagaagctagataaaggaatactcccttcatcccctgagcattccacgaggtgaaatcctccttttcccattggcccagccaccgcccagcccgtggccattggtccagccctcgcccattggtccagccccggcccatccctcgtccattagtccagcccttgccattggtccaacccatccattggttcagccccgcccattggtaccgcccccttccattggctcagaccccgtccttt

SEQ ID NO: 2363 - DNA, 1183 bp, Homo sapiens
acaggctcgggatccctcgcagcgctaggggccgcagccccggtcgccggggagtgccatggcagggaggcggcagccacgtgaggggtctgcggaagcgccggagctgaaagctgggggcgaagcattttattaatgcttttacgagttagaagagttgggataatttgccatctggagtttctctgccttgctgatctgagctcagacctgccaatttaccagagataattgataacaccctgtaacagctgagaggaaaatggaagaaacggagatacttttagtgaagcagaataaaccactgaacaggaaaaatgaggaagctgtgagtaccagtggaaggaacgagccaggaagagggactggaaccatctcagaagccatgcccctcaggctggaacttgccctgtctcctcgcagatgagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaatctgtgttttgtttgattatattac

SEQ ID NO: 2364 - DNA, 4250 bp, Homo sapiens
tctatttgttatttttaccactgttgaacagcaaactgttgaggctagggttgattattgataatttttatgtgtttagtaataaccacagcatcatacgtacaactgctttaataaatccaagttaaggactttgaggagagcatgtagcaagtattcattttaacaaatcatcacagacagtttccctgttcaaagctccaccaaaaagcaagcatgcagcaaaggcatagactgtatttagagatgtggtttcatttattcttgaagtcctataaccttgcattatttaaacacaaaatcccacctaacatttgccaaatccaagttaatctcaaaaacctccgaggacattgagcacaagcagattactgtaagggcactggtggcagattgtggtggagagagggctgagtgacccagagcaaagcctgcccgggttactcgctgccacttcaggagagggattgtatcagctctcattaccttttgtcatgaggcagttcataaattaaatatgatatcatgcattatctcaaaatatttctatattaattagataattcacgatgtaaaacgtgttcatgcagaagcaaaggcggatgtaatagtcaagtatcagggaaaaacccctttaggatacccagacattaaaaatgtaaaaagtagcttataagaaatgtggattatcagatttttactatatataggttgtgtttaatagtaatttctgacacctgcacatagatgaagaaaaggcagttgttaccacttttcaccattcaaaaaatgggcttgtctcttagagtattggttaatgctttgcttatttgttaatgaagacagcattttaattttaaagcttccttttgtaggactgatggcacgggcagaatcacatttaagaaaaatggtttggaacactttttaataaaaaattgtaaaatcagtttccagtgtggtcaaaattagaatgtaaaggaaagcatttttaagaaaatacagaagcccaaatcaagggagagtaatataaaaggaaatattttaaattaagaaaaggaggtgttatagtttattacatcatgaattatgctttctgtacttacgctcttagtgaaggagataacattgaagtgagaaaatgaacattctcagttatttgcgaagttagtaaaattgcagtccctattccatttttttctgatgaaaatggatacatgagatctcatttattgctctcctcaacacctttactgtcccagattccattcacgttccaaatcgtggacagtaaaactgaagtcagataaacacagtcacaggtacaactgggagcgagttttaacatagtggtaattttgcaaatgccaacatgaatactagtgagtactcaatttacgacagacaatttcacaaaaaccaaccacagagtgatttgatattcttgcttcttagagagttttctaatccatataatgcaatgggtcaggttgctcatatgattaaaaaaattaatcctgtagaaatgatgtattagacatctctaacccaagaaaaagatgtcttttgtataacttttaaattcccatttgtctatcttaggacaaatgatgacttcttcgtgtagtaatgaaaacgtctaaatcctgctctgtggagaaaagctagaaccatgggacattaagcaagaatactcctctgatttaggctcccagactacaactaacagtctttatgtatttatcatcttggttattgttttatctcaagcatatacagtgtgcagaaagtagaataatgaataaaatatgaccatggagaaaacccataacttttgcttctattatagaaagcagtgtttgttctttttaatttattacatgttcacattgaaacattaacatctacaatattgtctttcagtttactcttcaattactaaagcaaatgattttgatttatagcacttacacaactgcagttcaggtcacagaattgaaatctatttgataatgtctcagcattctcatgggcagccaggaaaaaaaaaaagagagagaaagacaaatagaaattttagtgggttcagataaatgattattctgacaaacctggaaaatagtaattaaacagttcattccaaaagaccccaatgtaaactctgctcacatacataatttgtataaggaaaatgtatgagtttttttcttaaaaataaatagaagcatcattgcatttataacagattgatcaatcttatgaacagattacattgggaaagtcactattattgctgtgtgtttgtatattttattctttccttttttgtgtgagcatctactatgtgccaggcagtgactgtgtctgagtgaatgtatccatggtgagcactcaggcgccatcactgccttcttggggcttacaccctattggggtgtcagagatattataacactcaatattgacccaatgggatgaaaattgttatcttcatgatttcttccaatgggcttagatttgttgggacagggcagaattagaataattatttctcacatataagagtaagtgatatgagattgggaatttcttgccaacactcaagcaaactgcagaagataattactccattttactagctcacctagtttctgaaggatggggtggggagtgagacatggagcctctggggacaaggataggggggtgggactgtcccagtggagggtgccactggaagcctccacccaagtgggccagcagctgtgcaagggtgcagcagtaggctggtgaaagccaggttgtccagatctttctaggggaagagaaggattatagaaaaggagaaaagggaggagcaagaacatctctccatggcctatttttatttttgttcccaagagactagtgtaataaccttatgcccccaaagacagcccagaactgagtatcttcagtgttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaaccatccatgataaatacaacaaggcttggcgaaacctcattactcttggaagtcttcagaggttattatacctactgatctgtatttgtctctaagagacatttgaaacacagttacaatgtcaatttggtgtaacattacctgtagtagagctcagagtatatggcagtgcacggtcactcaagatgcatggcgtgtcatttgggtcgctttgatgggtgctcgggtagaattagccttgtagagactaatgtgttcatgctatctctgatcctgtggtgttgtataaaaatgaacagctaaaaatttacccatgacaagattaaagcaaaaataaacacaaagttgttagactttaaa

SEQ ID NO: 2365 - DNA, 5590 bp, Homo sapiens
gcagtcattaaagaatgttagccaggtgcagtggtgcacgcctttaatcccagcactttgggaggtggaggtgggtggatcgcctgaggtcaggagtttgagaccaacctagccaacattgtgaaaccctgtctctacgaaaactacaaaaattagccaggtgtggtggcacgcatgcctgtaatcccagctacttgggaggctgaggcaggagaatcgcttgaacccgggaggcagaggttgtagtgagccgagatcacaccactgcactccagcctgggcgatagagtgagactccgtctcaaaaaaaaaaaaaagaatgtcaactgctcctggctctgcagaggtatggcccaggtgacagggctattgagaggccaaagggaccctgatcagccagtggtgtctttggaataggtgctgcaagctctgggaggtgctactgcgcaccagaaggttggtgagttggccaagggtgtggagctggctccagaggggaaggaacaaagggaagggaccctctgggagctggagagacttgggagcctggaggcaggaattccctgccattgcctgaggcctggtttggaaagtacaatgcagttttggcatggtggttgctggcctggaatgtggtggggtgaagagcgtggtggaaggacacactgagttcctgaccatccagcaacaaaggagcaaaaagaccttggaatccatgagaagtttgaaggtcctgattttcacgccatgattggagattcctgtgatgtatgtgctgggcagagaggccaggccctgaaggccatcctgttccaggcatcctttctgtataggaagtctgagggttacgttagataaggaatgggaagccactgcagttctccacccaaggcctttggctcaataccagcttccagatcctcaggagaaaaccccccttttcttgaagtcacttgttatgatgacaaatattgctatgaacatccatctaccagtttttgtatggagagccatgaggtcactgtgctcaacttcacctattattatggcaagcaagatgctctgaaagaagaacatttttcatctcaaaagtaaatgaacggcttatgagttcatattggtaatattacccaaaacggctatggaagcaaatgactacattagtagcaaaacacaaaagaagttacgtaaatgttcacaaaacactttgtgggaaattcacgcccttcccacagcagttatttgcctgcctttgatcttcagggttctcaggctccatggcctgtcccagcgactcctccttcatgcttatcagctgccacatttctaggaatcaacacagattctttggagaaaaaaagaaggactggcactttttcttaaggactcacaattccatacaaaggtggatccaagcactgtgaggggtttaatgctcacaatttggaaggctctctttgaaaaaacagaggctaaatgatgaatacaaaattaggtataaatccttggaaggggagtagaagtgaggtacccagagtgtaggctttattagcgtttagaaaatccaattctgatttcacagtatcagagacaatcttgtaagttatggcatagtctatatctgcatctgtctgtcaccattatcagcaaacccaaatggttcccagttgacaaaaaaagagacattctccccctgaagggggtggctaaagctctcagttttcatcttgtctccctaggtttatgtttccttctggaatcttcctctgatgctcccattaacccagtaaaggagtttgtaggtttccttaaaaagatttccttcgaagagccatccaagtccatacacacgcacacgtcacacacacacacgtgtaaagatcaatcctgcattatgccgttatcaagttggccatgaagagagtgacatcgctgcctcatggtgatgggtcttccagttgccagctctgggcacctgatttctctggacacgacagacgtatgatatataaaaactatagactcatgctacattgaaacaaatttaactggatttatccaaacacaggaaccacagacaccagattttataaaagttcacataagagttattcactataataggtttccaaatggaattaaaaacgaccaagactggagtaattaatctaaatttggtcaaaaaaaaaaaaaaaaaaagaaaaaaaaaaagaaaaacaatattgctccaggccctgcagggcagaaagggctccaaaccgtgtggggtacggtcgtgtggtcaccctactacccaaccagccatggaagtgagcccacacggtgctgaccccagagctaacaggcatgtggctagaggtcagtgagagggttgagaaattgatctttttaatttttaactttaattttttgagacgtggtctcactctgccccttctcacaggctggagtgcagtggtgcaatctgggttcattgcagccttgacctcccgagctcaagcaatcctcctgcctcagcctcccaagtagctgggactacagccgcgtgccaccacgcctggctaatttttgtattttcctagagacggggttttaccatgttgcccaagctggtctccaactcttaggctcaagcgatcctctgccctcaggctcccgagcagcggggacgacaggtgtgtaccacaatatccagctaatttgtttgttcgtttgtttgttttgagatttggcggtgggggggatgggaagggaggtctcataatgttgcccaggctggtctcgaactccaggctcaagtgattccacaggcgcgcccaccacgccccgcccgagaaaccccatcttgagtaggcccgaagccgggctgtggaaagccaggcgcgctaagcccctgggcctctccggagccgccctcgccccgcgcctgcggtgccacacgcatccgccgctctgcacgcacaagacctcctggcaggcggaggagaaactgaggctcctatcagatgcccttgcttttcgacttacttagcacccgtgaaacggaggcctacggagcggcggccatggcctgggcgcgttctggccaccgggccacactggatgccggcctggcctcgccagagggcggatgtgcgctgcagggaggcgggaggcccttgtgcttcagcccttggtgagctggaaagggaggacattctagctctgaagcatttactggggcccctgctcaaggacctcccggctccctcctgcagaaatatcagtatcaccgccccacctgcctctgcaaacagtgcacccccgcagctccccagcttggaggccctgcccagcggggctgggatcctcagcgcccccaggcctcagctcattccttcaggcttcggcttctgctgttttctcacttccttcgcaataccctttctcattttgcgttaatttcctgcatgtcacagtaagggccttactcacatgataatccctatttaaaatagttcttacgtagttcttattttgtcgagggtactgtgcacagtactttaacacatgatcgcatttaactctcacaaaactggaagaggtcgctgttgtcattgtgctcagatcagttaagtaatccacccaagggcacacagcaggtaatagcagaatatcttattccactgcctgtgtttttaaccactatgcatactaccaccttttattatgtatatattaaatcatcttctattctttagttttctactgggtttctttaaaaccactattttagaaaaaccactcttcgctggataaagtacaggggatctcatacaagggtaccttgttaaagcaacacaagacactcatgaggattcccacaggtctgtaaagctcagtaacttctgtggtccttccacgattcacaaatacattgcaaagatgccaagtgtaaattcagttcatgggataaggcttaatgtcctgttgttgggtaagattcactggtgaggactggaactgctttataggagacgaaactctaggtttgagctgaagcctgagagaattacagagaagtgcttgaaccaagaatgaagatacagaatttctggagcatgtgttgatagcaagagtaaaacagggattgtaggcactgtgatttttaagtaggtgatttagataacactgaagaaacacaaaagcgacaacaatctctcttcacttcaacttcctcatgggtaaacatgttggactagcatacagctaagtccccatgattccacatatttactttttaaagggttctaaaaacttcatggtgaattccagggctgctgttgtgattgttacttcaatgttttacatggaaaagtttcaaacttataaaaatagagagaatgaatctccaggtacccattactcaggttccacatttatcaacacatggccaatttcttttcatccatatctcatccacttttacactgcttttattattttgaaacaaatattttatttataaggcagcatatcatgttatttcaacattatttctaaaacataaagacttttaaaaaatagccgtaataccattatctcaactaaaaaatacataaacacatagaaaaggattctgcgaagtcattaaatatttagccagccagtgaagcttcttaaggtataattaaacatttgttcagagctaggctaggattctgatagggatcaaaatacgccacccccaattatgtgacactggcatattgattattttgagctgaaggcaactgagaaacaacagatataagaagagctgtctgctctccccctttctgcctaaaaaagagcataaatatcccccaccctgtactaggataagagtgacctttatcgcagagacagagagctgtcaccaagatgagtctgcataagcaaaccttactaaaatagccctttctcacaattatatcaaccctaggagcccaaatcccctttcatttgtagtcacttcttccacaatttctcaccctttgttaaaatggtatataagctcccaactctaacttttttttttataagttccacttcttttctgtgacgcccctgtgcatataaaattaaaaacattaataaaatttgtatgtcttttctcttgttgtctgttgtcattttaattcacaggctctagtttttttccttccctatagatctcatacattttaaaaaacaacggagaaattaatatgaagaataattttagtatgtctacattagcaactaagataaataatactaaataaaaataatttcagggttttttttgtgtgtatgtgtctgaaaagagtaattcacagtaaaatgtaacctgtttttgacatctgagggtatataaaaactgaaagcataaaaagaaaattactaagttaaatttcttaattttttctgtattactgaatatgagaattgccatgtgatcttcattatgttcagcaactgatatatgtgaatatttgttatttatattcaaagggatttcagttatataaaataaaaataatgataccaagtttaaacctattttttaaaagcaaggctttaaaatttt

SEQ ID NO: 2366 - DNA, 6384 bp, Homo sapiens
acttgggctcgcgtcctcggccgcgccgcgcggcacccgggcccagcagccgggaggcggcagctctcctctacgcccgtcccctcagggcggctgtggatgttgccagtattgtcgatgcttcagagcgacgtttgccctgcgacacaggcgggccggctctcctctgtctttattttcctggaggccgacaggagcggggcccgagttcggtggtggtcgtgagcgtggggggcactcaggcccggacgggctctcaggtcgccgacggcggcggctggaggccgcgctggctgtcccaggtcgtcgttagctttagggagccgatctccgggcggccccacagaggacgcccgcgattcgatggcgatgatgcccgttttaaatggtgtccctgcagccgggtggatggatggatcgtacaccttgccttttgagagccgggaccttacgcccgactgcgtgttatttctgcgaataagaacgcaacctttggaggtgaagacgactgtcggctggattgaattggaatcgtgtttgtgatgatgcgtttatttctggaaatacgcggtctccgctgcttttgctttttgtcggcagaggtttgggttcttctctaacggtcaggataaaggcctgtaggcgacgctgcgcgagcgagaagctcgcccgcggctgcccgggcgcccccctctaggtgtgggtggagccgagcgcgcggggagaaccgccggccccgactcagccaccggtgactgcgggcgacccgcgggcctgcggccagctgatttcaaacatcgttttcctctttaggttcggaaaactgaggcgctggacaaggctggaatacaatatgtgattatacgtacagtactatggttgttgtagtttttaaattgtaaaacaagaagtaaccattgttccaccgttctctattaagtttgtgtaaattaaaaaggggctattttcggtaaaaagtgcagtaggtaagcggaattttactcaaccgggacgaaattcgtgttatatgaattgtattgtgtatttgtgtgtgtaccagtgcgctaaaagtaagtaggaaaacttgcttagattattccttttgcctcaggccactcagggggccaagatcctgtcactccttttctctaggccctgcgaatggcttcccgtcttgaggggagtgagccaaagccttgactgcggcagaagtccccgcgcgccgttgagggtgggggcgggcctgccctggcatccttgcgagtaggactcttccctgagcgtcgtccacagggcttgctccttcaccttcaggattttgctcgtgtcactcggtgcttccgcggctacttttaaactgaaagttccctagcccccttctcattttatcctttggacagtctacatatccatacttgtttatcttcttatctctccttccccagtgcaatgtaagctctaagaggacaagaggttgtgtttttctgcactggtgttacggcccccgcctagaatgccacacagtagatgcgtagtatgtggttaaggaatgaatgcgattataagggccttgatgctcccccatttctgtctttaatatgtacttatatgctacagagagctttataaaagatttaaaacacgtttattacagaattctataaaaatatattgcttctaaacattggaaagccctccacaacaccagaaacccacaaatgagggataaaatttgtttttaggcttctgtaaatgagcatgcccgaggacagtgcatcaaatgatcatatccatactgggccgattatgtttgctcttctgagtctcaaactgcattcttcatcttgtcgtcctctgtctttcaaaatacattaaaagtgagaatttggttggctcagagcaaatccagcactattggaaaagttcattcagcaagtatttattgggcacaaatgggtaccaggcacgctaattcaaaaggtgtgtgtttctgaggctagaaggccttacataaaggaccacatgtggctactttggttgctactcaattatgctgtcaagcaaagcaaatgctagtgaaatttatttttagttttcttctgaagaaaaggttcaatgaaagctgaggtcaggcttggtgtggatattttaattcaccatttagtttgctgtttgcttacacttaggttagcattagatatacttaatcatgatttttgagtactataaaacgtgagaaatcttatttcctagtggctggaaaaacaggctttttaaattaaaataagtaaatatatcagtaagctagaagctatgcaataaggctttggctatggtattacaaattttcatatttcatgtattgaatttttggacaagaaaagacagccttgataggtattttataaccattaatacaattaatcaaacattgtttagtaaatccaatcgtctattcattattatttttcccattaatcttcagaacagctttaagttaatacagatgactcagaatgtgtttttcactcagtttcaaaataccattatttcaattcgctaatagaagcacaattatcttcttgtctgctttcttaaatgttactggtaaactagtaattttgcatgtccaggtaactgcagctgctacagtcaatctgctttggaaagtcttggcattattgtgtcatttaatttaaaatttttaagtttttttagtttcttcccttattgaggacttattaggcgctaattagctttatgctagacatctcatgcatggcagtgaatgaaaacaacactgcctttgagggttttaacttgtatatagtttataccattttttttccaggttatagaatcaaagaaattgtttcaattcatatcacagtatttctctattaaatcaaatggtattttgcttgcataaatttaagtatccaagttgagatcttacatagaatctgttaatctaatattagtgttttcttcatttcattgtcttgggtttttttttcttaataattatttttcccaataccatccatttgttttgctcttacatttttaagtcttttatgttccaaatcaggtgacttacatcctccacttgtccattgaggatagcccagtaaacctttattctgactttaaattgcctccttgcttcaagaactgagttgcatgactcagttttctttgctagaaatatccctggatagtctcgtatgtattcttgatcaatgaattgcagaagatttgattaaaaattttaaatggatttcagggataaactatttgtatcaaatgtcatcaccaggaatttctacaactgaaaaatttgaattgttatttttattgaagaatatttatctttaagataaatgcaacttgctataaaatgatagaaatgaaaaattttagaaaatcattttctactcactattttatgcctgccagttatcctttgttagtgataaaattgtcttttatgggaacgaatttgttaaaggtagaaaaaaaactggtagtgtatgtatgttttatagattagacactaccaaaattatttaacatttagaataattaacttgctttcaggatgacagatgacttaagaaactgatgaagggttaattaaggatattgatttttagggcagaactacaaaattatcaaatcacttaacactgtaaatatgttcctgtttcaggttttcaaagtaaataccttaatcaaatttggaaatagtatttatggattttattcaacatagattatctattttgttaaaattatagaaatgaacagttcttttcccatggatgccttttttcatcttggcctattctgatcctttaagaacaagctttgtcctttcattaatacttctcacctataattacgaattttctctaaacttgtagattttattatccatgccatctatttataatcctatgacactcctatattgtttatggtttttttgtttttttttgtttttttttttagacgaagtcttgctctgtcacccaggctggagtgcagtggtgcaatctcggctcactgcaagctccgcctcccggttcacgccatgcttctgcctcagcctccccagtacctgggactacaggcgcccaccaccacgcccggctaattttttgtacttttagtagagatggggtttcaccgtgttagccaggatggtctccatctcctgacctcgtgatcccccggcctcggcctcccaaagtgttgggattacaggcgtgagccactgtgcctggccttactgtttatgttttcatgcatctataccttatgttactaaatcaaagtgaccagttccacattatactacaagtttcactgtgtaatgcataagaattacacagagggaagggcctcaaaaaatgcacttctgaagtattttaatgtaaaattatttaagaccataaagtttcatgaaagcctaatctttctggaacctacacatactctgcatgtgaaccagagttaaactagtcaagtattttaatactgaactaatctggaaaaacatcatttaaaaaattactgtatttatgaaggaagaatataaaatctgttaaaaacttaaaacatctaaaataggtatgaagagaggcttatggtgctcattttaacagcattcttgagtaggttaccttgcagtcaaagcatctgctccagaccagtgttttaaactgtggattatggtaccactatgggtcatgaaattaatttattgcattatgactagcattttttatttaaaatagagaaaagaatagaaaataaaagcgtacatcacagatggtaagggtatgtgtttttaagtaaacatttgttcatgtgtatatgtgttagattaccttgtaaaacatattccttattgtgggttacaggccaaaaaaagtgtttgtttttgtttttaaaaatctacagttcagattttccttagaaaatggggaaaaaaggaatgttagaaagatctgactgcctatgaactagtgaaggattttagaggaagtaccaggctattttagagatctgatactggtttcagaaaggtaatcttaaggcaaagggtaggaaataaagttatgttgttagtagaaatgtcaaatacggttaaagttgtgaggaggaattattttcctagtggacctacatttgttgtgtgtagatctgtgactattactgatctgttgtagcacattttccaatctaaaatgtccgatacagcacaataataaacatggggcagaatatatgtttgtttctatttcttcccaccttcccttcaatcttaaaacaagtgtttattaataagtcagaccaaagcaaatttctatctttcacagagtaattatcataggaacaaattactccctgaaaatggtggaaacttctttctccctccgaaaaataaactttcaataagtgttttctctctagccaaagtaaataagttcttaaataggtaactctcatttgccatccaactcattctatatatttaaataaatgtacttacacttgtgtataggatttaaaagggggaaacttaagaaggaagaaattgtgtatagaatttaaaaaggaggcattatattgcatgagtagaatgaaaagtatctaaccagaaagcaaataagttaaggattatattatactgaaatattttaatacaatttaaatatttcattactctttcactttatttgctatttgtagatttcagtattgtaatgttggcaagtctatttaagacggcattaataaaaattttgtttttcaggcatgtgataccaagtccctttccattatagataagtaaggcctaggttggttaaaaccttagctaaacacaaaatttgctagagaatcaacatataagaagctctaactccaagcttattcaccccagatatttcaccaatgttaacacataccctattgaactaagaaaggaattatattactaaccagcagagggagccaagtcaatcatgaaaggtaggagtataaaggaacatcatatgacttcctgttttgaatttaactgtatggcccctgctcactttttgagtttaccaaaaagacagtcataaggagagaaaggcgaccaatgtatcaaataaggatacagtgacaattataacttagaattaccttgcaggaaataaattggaagaaaaattgaattataggtatttctgttttatctagttttcatttaataatctaaaagattctggccgggcacggtagctcacgcctgtaatcccagcactttgagaggccgagggaggcagatcacgaagtcaggagatagagaccatcctggctaacatggtg

SEQ ID NO: 2367 - DNA, 2028 bp, Homo sapiens
agcccatcccgtgcggaccctacgccgagtccagcccggggctgctgggccagcgggagcgggaaccggacggcgctcgcgttctgccagagcggagaacgactcggggacggtgcggaggaccaggggaggagatccgcgcccgcacgcaccatcagccgagaggacggcccgcatcgcgccagtgacctaggagcgactcggggacggcttcgggctcccaggccctcctgggccaccgggcactgaggagagcggcggctggaaactgtgggacccgaagggcgggagcccagggcccgcccccgccggagcgcccccgccatggccacgcccccgccacggggatgggcagggcaagcaccggaagtgcgtcacgcgggagcgtctgcgtcgcctaccctgcgtggcgcagctaggttccgagcggcttagcctccgggcgcctgcgcagtggcggtcctagagacgcactcggttgccatagagacgggggcttgggagcgacgtcgcgctcgctggcactggcggcacttgccgcgccgcagccacctctttccgactccaccagtgcgggccctatccggggttttgagtcacgcagacctggacacagcgagaaacggcagtccgggcccgtcctcccgccccgggttctgcaccccagagttggacgcttgcttctcgctttctcctgagagaagtctccgcgtttctgaacaatgcactgctagtttctcatttctttctttctttctttttttttttttggagacggagcctcgccctgtcgcccaggctggagtgcaatggcgcgatctcggctcattgcaacctccgcctccagggcttaaactattctcttgcttcagcctcccgagcagctgggactacaggcatgcgctaccacgcacagctaatttttgcatttttagtcaagacggggtttcaccattttggccaggctgatttcgaactcctgacctcgtgatctgccctcctagggctcccaacgtgctgggattataggcgtgagccaccgcgcccggcctctcatttcttaattgtagacattgcgtacttccggagaaggtccctgagaacctggctgatcttccccgctgcacccctcacgtggtcctgttagctcccaaactgtcaacctgaaaggaaacccagaggcaggctctccaggacaagtgagttaatctgggaatcgcagggggttgcagcctaggctgttcgtgccatgacagatcataggcctatctgagagggccgggcgaaggggaaaatacagatgagctcacaaaagttgttttgtaacaaaaaccactggctgtgggcgcttgctgcaggagtgggcgttagcttgttgttggagagagccttaccaggccgacgtccttgtgcaagctgcttatctagaatactgcagtcctgaggaatttccctgcagtaagtccggttacaggcaaacgtgcaggacgtgcaggagcgtcttgtgaggaggcctgctgcaggtattcctgcatgagagctcccccttcgtggcctcccgactccatttgtttagggattggtggaagtagttccattttggtacctgcaactttcacagctgtcgtgatgaaatcaggcttagctcttcatgattgagtacctgctgttcactgctacagtataaaaccatgccacaattcctgtacaatctttttttttcttttgagttaataattacctaatattttcacatatctagctttttactaacccatggccagcctttttttcaagtaccccaacgttttcgccacatgcctaacgataccgttttccaaaggctcaaacacatccgttgtgtctaactgattctcctgttccgacctagaccgatcacttcctgacccggctgcacagctcttatctcgagcttttctctgctctcatccttgagactcactttgtctgtctcctttcttggattccctgtgtaaacgaaaaataaaatcctaagctctctaccaa

SEQ ID NO: 2368 - DNA, 3543 bp, Homo sapiens
gcggggttggagggactcagctacgcgcctggggaggccgcgggccctcgcagactaccgaacttccattctgccgccgggttttcacacctgccggccccgaggaaacaatgacgttgggattttggggggccgccccttgactcgggcgaatgggacacgaacggcgaccccttgctctcttccatccgcctgccgccgttgctgcccaccgactcctacagctcatttctcgctcctgcagcctccaggaatgcaaataatttctcactgggttttggcgggggcgcggagctgcggagaagcgcgcgcccaacagctttcgccgcagctgggtccccgggcgctggcggctgcggcccccagatacaggcggaggctgcaatatgcacatgcggccacagtgtggcgccaggggcccgccgcgggacacgctcggagcgcgacgccccatcccatcatttacggatcaaaccaaataatctagaatcaagttgctgtgtgtgtcatactcctcctgttttttttccctaaacttttagtagagtcatttacatagttcagtttttacctcagctatgttacacagtggcaggaaaatattttgtctccaaactacagcccaagtatgagagcagcgtatcctgaagctaattagtaaccagaaaatcaggaaggtaaagcaaatctctggaggcaagatctggactctatggtatcgccgcttctccccacttgaagcgtctctttgcagtgccgcacttggagatttggacttaatcgttaaacaaacagaacagttacattctgccttcctacagggcaggggcctaggactggcagcatttttgttgtctctagaaatagaggggttatgagagagcctcaaaagagagggcaagaataacacatccatttctcatcatgagttacccccttgtatgcctagaacgcgtatggagacattctcttttagtaaagtcaaagagaaaagccatgaactaagtatcctgaacacagaggcgtgagccctctcagtctcacagtcccttaggagtcatttatctcagaagttggttgaaacaaaaacagttcatacagcatggtaggcagaattctaaaatgatcccaatgactcactcccttgcataatccccttgagtgtgggtggaacctatgacttgcttctagccaacagaatatgacaagggtgatgaaatgtcactcttgggattgctacattatgtaagactctatcttagcagtctggatggaaagtctcctcctgaacttgaagaggtaagctgccatgccaggagagggcctacaagagtgccacaaggcaagggcctctaggagctgagagtggccccccactgatgggcagcaagaaagcaggaacctcagtcctacaaccacaaagaactgaattctgccagtgaccttgtgagcctggaagagctgcaaaaagaaacacagcaaagtcaacaccctaactgcagccttggaagactctcagcagagcactcagctaagctgtgatgggagtcctgacccatggaaactggaagatcttaaatgtatgttgttgctaaatttgttacacagcaatagaaaacaaatacactccaactcttgacaaatttgttaataggaccacgcatcctaagacaaacacacagaagggcaaacatccagatataaacatcctactacattgatatgaatactcacatatgtaagatcaatgatatcactagcaaaacaagctccaagtcaatgggcttttcctttcgacatacacctctacacataaccaaaaatgcttcaactacttttcttttctccagaggcagttggtttggctaagtaaaaatggggttcttaggagactaaggcggaaaagagacaatagtgccttttccccctccagaacttatctaagaatggaaggcaggtgtttctatgctatacatagcatgaattttacagtcatggatactgatataatgcttccaaatagaattaattctcttccctcccttattcccacccacagccagcagatgctgaaagactgcactgcccaaacactgccatctttgctttatatatccaaaagagtgggaagtgctgtcacatctccatcagaaactgtcaaacactagtaatggtagaaaatatttgaatgacacaattaataggcttgattttgtggatgctctactttagaaagaaaattcatatgcttttcaaacacacatgcaatattagaaaaattaagtgtgaactaggccacaaagcaattttcaacaaatactaatgaactgataccatgtttaacacaaattctaaccaaagtgctataatattagaaatcaatagcaaaaaactaccctccaaaaaacatctaagtaattcatgaataaaataatgtataatggaaatttatgagtttttaaacttaaatggtaatggtagtattatatatcaaaactcacgagatgcagcttttagcagacattactaatttcctactcaacaatcattcccctaccttcatgactttggtgtcagccatatgattagggctcgggtccaccaaccagctgcattttcttggtcttagcatatactgattaaattgaaatgactaagagtcagtgagctgcaattgaattccccatggctgactgtggcaaaacattttaaaatagggcatagacggcaccaaccaaaaatgttggtgtattgtactgtagtaaaattaacaagtcttgttcattgaaaacaaacaaaactttaatattatagtgaaaagaaaagccacagagtgggagaagatatttaagacacttgaaaaaggacttatatccagaatatataaataactcctgtaagtcagtaagaaaaagacagacaatagaaaaattatcaaaaagaccttacaaaaaaggatacccaaataggtaataaacgtgaaaaatggtcaatatcatagtcattagggaaatgcttaatttgcatttgtatatccaaaagagtgggaaattgtaacatacctccatcagatactgtcaaacattagtaatggtagaaaatatttgaaacatgtaaacaaaaatatccacagcattactatttgtaagtggtcaaaaccagaagcaacccgagcccctcagcagaatgggaaaatatgaaatatacagtaataagaacaaatgaacttcaatttacaacatgtatacagttcacaatcataatgttgagaaaaataaaccagacacaaaagagtacatcctgtcccataccgtagccctttatatgaagttcaaaaataggcaaaaaacctatggtgctggaagtcagtgtcaggggtggactagaaatgggcaagaaggagtttctgaggtgctggaaatgtctaaaatagatctggatgctgtttactttgaaaaaatttactgtggcatacatttatggcttgttgtacataagttatatttcaatgaaaattcacattaaaatgtaatataaaaaaga

SEQ ID NO: 2369 - DNA, 2464 bp, Homo sapiens
agccggcctcacgccgccgtccgcaacagcagccgcgggcggggtgcagccacctccgtgagcgccgcagcccgccccactcggggcggggcccgcgggcaccggagagcggacggccgagcacgagggggctgcgcgcagctccgggcagggaccccgtctgcaccgggtggcctgcaagattgccggggtaggcagggggaggagaacgctcacccgttccggtctggcgctcccttttctccacacccacacgcctcccgctccacgctggcggcgcagctgctcccgctgccacagccgccaccgccgccgaagctcgcgccgccgccgctgccgccttggctgagcgcggtcacgtgacgcgatccgcggggagcctgggggcgggcgagtgcgcgcgcgcgcgcgcggaggaaccgcggctcggaccgggactgggagctgagcggcactgggagggcgtttaaggggaggacccggcgagcgcgccctcggctggcgagcgcgcgcctggcgattagaacttgccgcgcggtcgggaaagggtggccggagtgaggggcggaggtggggacttgcgcctccgcacgcccctccctttcttccttcccctgagcgccttggcttgccgctgcccccgccccctccagcgcgccccttccctcctgccgcagcctgcgattggctgagaggctctgacgtccgtgtttccatgacgtgttggtgcaggagggagcgcgcggggaggtgactccgtcagtcacagctgctgtttcggcgcggggccgggccgctgccgcgacgtgtggaggcaggagagcgatgattgccgcaggagaagtgcgggcgcccttcacctggggcccctcccgaaccgcccccgggcccatgcccctccagggcccaggagcgagccagcgggagggcgagggcgagcgctcctggcgaggacagattaaggcgaacccccagtcagcggacatttgagcggctcctcgccgcgtctctgcccccactccaaaccggactcgacgcctgtcccgggccgtgacgcacgcaccggaggaaaaagtgcttctcggctcgctccctctttggggaagagagctcactccccatgcgggcgcgggacactccatctctgttcctgccggtcgggtccgcaaacaccggggatcccagctgcggcgcccaaagggttaacgcaggcgttcggccagtgcaaaccggcctcgcaggatccgcgcttaaaatccgggtgttttcattttgggtttgtttcttctactatgccaagctggtggctctcttttaattctcttgtaacatctcaaccctgcacccatctttcctgaggggaaaaggaaacgggataacttgcggtatttcgatgctcaaaggtaaccggcggctctgctccaaccttcaagagattttgcaagttgaaaaaaaaaaaaaaaccatccttcgtaacatctacttaaaaaaaaaaaagcaagttttccttcttgtacacgcatatacacagtaaagatgtgtatcttacctaagataccgcgcttcatcttcatctaatctttatttgaactcaccgtcgccactggcccagagaccttgtcagtgttattttcagtatcagttaatcagaacaaaaagataagttctgcaatcttctttctcttaattccagaactggaaaattaatatttatatagcctcctcaaaagcatacaggcaataggaagtatggtattatgttcacgatctgatgatagcatttgttttaaaatattttaaaagattagacacaaaatgtgtaaaagacgtttaaaagtgaataaatataaatcaatgctgttgcaaataatttttttatcagtttatgtatctcactaggcttgacattaccagccttctgagctgtgcccttgatgtgtaagataaacgaacattgaacagaatgatagcatttttcctctcttcagtcactgatggagaattggttaatgtggtacaataaatagcccttcctgacactatttcaaatctttttaacagaagaataacctaaatttcacctaataaatttcaatattatttccccctaaaatatctttcaaaacgactcagagacatttaagaatcactggcttttttccaacttttcctccaaggaagttacaatacaatgttgaattatgtattctactttaatcaagaatttgacattaaagtaatatgtgaatcattgctatagtacactagcaaaatgggtaataaactagaatctgttcactttgtgggtttgttccagttccagattataaaatgaatgctcttaaagtgttgtggtcatgaaacaattattgagcatctttatttaagaacacgattcaattaagttttcatttatatcgataaatctataaatgaaacatacggaatatatatattcatgtat

SEQ ID NO: 2370 - DNA, 717 bp, Homo sapiens
agagtacgggtgagtgaaatttgtaaggtttggtgtgttcatttgagtgggtgccagacgtaacgggcccgggattgaattagtttagatcaaaatttgatgtaattatcgcagagaaacgctttcttacgagtgtttatctcgagcctgctgtgttcagcatctttcttggtgttttgggagaagcagacaggagttaagtccaagtccccgccctcacagagctcaggtggcttgggggaaggttggtgcgcaaacattaaaattagatatcgacactagtgagtgtccccgtcaagaggtctgtgaaataaggttgagcctacgatgcagaagttaatctcacagcaagttgtcagattccctagttgaatttgctttggacatcagtgtgaagcagaactgatatgccacttgaattaataaaggaagtcaatggggtgcctgaagttcagccgctgagtaaattacataaagtagatttcggatccctacagccaggttacaattatagcaagaaatatattcagggaaaactttcacttatctcttctttaacttatcgtggaaataaaacagctgttttgcagattggactacaaggacaccattgcagtggctagatttattgtttttttagcttcttcatctacaagcagagatggtaaaccttgcatatttttgaaagcatttgaagacctcaaatcaactgtttat

SEQ ID NO: 2371 - DNA, 1283 bp, Homo sapiens
gaaaacaactaagatgtagtaatttttttttcctggttcaaaccttcaataacttgctcattcagcagtctctctgagctacatttttatttgtaaagtgactctgtctgcatggcaatgagcaggtgcgtgttttttccacattcgccctttcttgcagtatccagggaaacacatcattacaaagggtttctacctgaaatctttcatggaaggcctacaattcgaaaagctgcacatgtttacagaagagctcttaccctccatgcaaacactttgctctgtggtgtcacagctttgtgacaataagatggcaatctcggatctacaaggtgctgtcgggaatcaaataaaatatgttatcagagatatcatcacatctatagtgtttaacagagctttatgccaactactaagacaaagctttaacaaagtttatagaatactgaaactcgtaacaattacctctctacgtgatgctgtaaggaatcttgctaatttggtaggaagaggaagcatttaggaaagggtttagtatctaccaaaagtacttgacctcaagtaaccaatagtaatgcaaacttgctttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgt

SEQ ID NO: 2372 - DNA, 2519 bp, Homo sapiens
aatttgctaaactttattttatacatacacgtttacatttactagtcatggtgtcaacttgttaacacaacgaagccctaatggacccgttttgaaattagaagctggacagttacaggctttggtctcttcaagaatccaattcacccctgggtttcgcttggcacacaccccaggagaacgtcgatgcacacagctgtgtagctgcaaacggaaaccactctcttttctctcgtatttttcagtcagactcactcaggattttgaaatgaatcatcacgagaaatttgttttaaagttgaatcactgagaacatctaacaactgttcacattctttatcacaaaaactgaagtcggaaaagacgccctgaaaacttgcaagggctaatactctatgatagaatattactactgttcaccatgttaatacatttacttactaccatacacctgaacagtcacggcagaacaagagcatgtgaatgacgaaaggaaacttgctttcagggtgtcagattatagaacatgcacaggaatttcttccacttctaacctcgctcatcagtcacatttacaagaaactcaattttaagcaaagagatgcctgaaataactaagacgtgtacaaaaacaagttaacctatgaacacaaggtaatattctgatagtcttcgatgtgacttccaacatatctgagtagtcacttttcagttttttaaacacgtgagaaaaatagatttggattacatctttgtggacggctacgatacagtttggaaaccattatctcagggaccctgctctctcctctacacatgcgcacgcaaacacacacacacacacacacaatgacacatggtggtctggtctaatatagtgtgtctgaattcagagggcagacattaacagccaagttttgtttttttgagagagagtctcactctgctgcccaggctggagtgccgtggcacaatctcggctcattgcaacctctgcctcctggattcaagcaattcatctgcctcagcctcctgagtagctgggattacaggcgcgcgccaccacgcccagctaatttttgtagagatggggtttcaccatgttggtcaagctggtcttaaacgcctgacctcgtgatcgacctgcctcagcctcccaaagtgctgggattacaggcgtgagccaccgtgcccggccaacagccaagttttaaaagatttttttcccctcttactataatgtgagtagtgaccttctgctgcaaagatggtgacagtttggtgcaaagatggtgacagttgggtagatggatggaattagagctggggacctaggaatgcctgcgtccttccctataatcaccccccttccccacaggattcctgagagggctcatcccaaatgggaatcaaagtgccatttttactaacagactctaaaactcaaagactttgaggtctaggcagacattctttttccctaaaactaactcttgggacctcctggctagataactggaggatggaagctggagactgaaggagcaataaaaccaggtttgcagcgaaggtcctggcttaacttaccccgctggttacacgagaggaaggcgggaggaagaatatggcagggccacccagctcttccaaatgccagggcctgcagaggtcgctgaccattccgaggagggagcaaggcgtgggggagaaaagctgaacatggatgagtgtaacagtgaccctgctcatgcataaaggggaatgaatgttctagaattttcccaatcctcttaccaactctcctgcctccgaagagaaggtgagtagagaaggcggtgaaacggcaggcctggtagagaaaagggcatagagatccacctcccttccccaactccctcccacccaagacctcacctatcgtttacctcagggccagatctctatcaacaggggccctaagagagtccaaagtcttattcagtgacaagagagaacttggttgacttggtacttcttccttgttctttcaactcctcatgggagcggggttcttggcagacacccaggccacggccttcttctttggtgggctttcatggccaccatcttggtctgactcagaggcgcctcctgggctctcggcttctgcccgggcatcctgaggtggctctctgggacccttccaggcacatttcgccatgggcttcttcaaagccaactcctccttattcacacagggctttctgctgcccttgatcggctctgagatcgccatgctttcagcatcacccacctcaggatcctccaagttagctgtgctgttggaattgatgcctttgggttttttccagggcactgcttcctgcctggagttcttcttctgcttctttctcctggagcgagacttagctccagccctgcgaaccaaaggtttggtaggctcatgctggtcttccgtggcattccagttgttgggggtctctgcctttaaggcagaacccacctctgctgcaagcccc

SEQ ID NO: 2373 - DNA, 532 bp, Homo sapiens
gtggtaaaatttcaactttatttggccaatgtgttcaattcgattgtgaaatagaaatgcctgaagaactgtcagcgtctgattcagctccagcatccttggccacctccccacccgggagtcaagggtcgtggttctgccttgaacaggccacaggccgtgctgtagagaggcctggccaaggtggaacaaataccctgatgtcgaaaaatgtctaaaaatcccacagacggaattttcaaaaagaggagaaacctcccgcgggagggaggcagcgagactccgaacacggtagcaagcactctggacagactcatgtatgaaaaagtacatcatggtttcaggaaacaagccccaccagggtgggctgcctggagatggatccctttccaaaaaccgaaaagcagaaggaagagacgggggtgaacggacggtgtgtaggggtgaggtgtcacttcagagaggttccctgggtttccggcgacgccctccttcaagcgaggccgcaggcttcggaggcgtgcgctgctgc

SEQ ID NO: 2374 - DNA, 440 bp, Homo sapiens
agatggcagccaccacgggctcgggagtaaaagtccctcgcaatttccgactgttggaaaaactcgaagaaggccagaaaggagtaggagatggcacagttagctgggatctagaagatgacgaagacatgacacttacaagatggacagggatgataattgggcctccaagaacaatttatgaaaaccgaatatacagccttaaaatagaatgtggacctaaatacccagaagcacccccctttttaagatttgtaacaaaaattaatatgaatggagtaaatagttctaatggagtggtggacccaagagcatatcagtgctagcaaaatggcagaattcatatagcatcaaagttgtcctgcaagagcttcggcgcctaacgatgtctaaagaaaatatgaaactccctcagtcgcccgaaggacagtgttacagca

SEQ ID NO: 2375 - DNA, 405 bp, Homo sapiens
gccgccctcagaccccttgtgaagcccaagatcgtcaaaaagagaaccaagaagttcatccggcaccagtcagaccattatgtcaaaattaagcgtaactggtggaaacccagaggcattgacaacagggttcgtagaagattcagggtccagatcttgatgcccaacactggttatgggagcaacaaaaaaacaaagcacatgctgcccagtggcttccggaagttcctggtccacaacgtcaaggagctggaagtgctgctgatgtgcaacaatcgtacttgtgccgagatcgctcacaatgtttcctccaagaaccgcaaagccatcgtggaaagagctgcccaactggccatcacagtcaccaaccccagtgccaggctgtgcagcgaagaaaatgagtag

SEQ ID NO: 2376 - DNA, 1593 bp, Homo sapiens
tggagcgagcgagaacggactgcgcgtgcgtggctgcctggccggcgctgaggggctgagcgtacgcgggcggcggggtgggccgctatgctgcaactgaagcccagtgatctgacagtatggaagtgctttccttccgctcatccgcggccctgggctgcggcaggggggttgggtgtgtcaggtgaaaagtgctccctcccacccttcagacaggtccccaaaccctgcggcctgcgcggaattcctgcattgtcattgccggcccacccactgttcaggctgagagcggtcccccgcccaaaccggcgcttcgccggcgccaagatagaaatgggtcgcccggctggtaaagaggctgccctgcaaccctgggctggagtattgctgtggtcctggatttctggactttatttgcgttctcaagtggcgaagtgttcctcaacctggacccacatcagaagcaggttctccgagcccctaagcagcggcgtgacaaagtaattgtttaccctggaaatagactgttattttttaaaaattattgtcagggcttgctttaatgttcttaatgtttttgtatgagatcctccatgtgagatttgaaaagatccactatgcgggtcatctaaccggtcactagacattgattccacacttactacgtcgagcacagttgacactgggaatacatggatggacttatactagccctaaaataactccttttctattagaactttactaggtaaaggtatttgaatgtctgaactccatgtttagaaggagtcattggttttaaggctctgtcctagtacacctgtaagagcatttgcttaaaattgcctggcctttgtatgttatctctgtcacttcatatttgaaaatcacttgctagaatatggcctgatcaatgctgttatgctagtgagaaaatccacaactaaagactatttgctatatattagcattacggttagaagtctggaagcctttggaggctggcaaatctgagttcaggtctagctcttcgagtttactggctgtgtaaccttaggcaatttacttaacctccgtgagtctcagtttccttatctgtcaaatgaggataaaagaacttagagttgttattgagattaaacgggatgattcatgtaaaatggcttagaataacgactggcaaatcttaagcgcttaccacatgttaattgttatcaatgactttctttacctttcacaccattaatatctgaccaacctctagaagtgatgggcctaaagaactcttggagctaaaattctttgtcacctgtaatgccagcgctttgggaggccaaggcaggcagattgcttaagcccaggagttcttgaccagcctgggcaacatggcgaaaccccggctctacaaaaaattagccaagcgtggtggtgtgtgcctatagtcccagctatttaggaggctgaggtgggaggatcacctgagtccaggaggtcgaggctgcagtgaactgtgatcatgccactgcaatccagcctggatgacagagcaagaccctgtcactaaataaataaataaataaataaaataaaact

SEQ ID NO: 2377 - DNA, 11548 bp, Homo sapiens
agagccctcctcccgcctgctctgtgtaggagacagcctgcggagcccactgccggcgcgcagagagcccagcagctcttgagtccaggaagcaagggtgggaggagggacgagccagtggcaatgacccagacccggacgacccccattgctgagccagcggagctgcttggtgagtggcctccaggcggcatctcttgctctcagcccggagggggttttggggacccaggctgtggggctgcctcttcccatgccttcagttcaccccgatatggggtgaaaaaccctagagaccctcgggtgtcggtccaccaagggaggtccagactccccaggaatgttgcctggggaggggtgtcgcggtgggggggggggtgacccaggcccaccctctgcagggcacttaaaatgctccacatccccagtggatgcctcctgtcacgcatcacaccgtggtgtatttgagatcccatctgccacttgggctggagggaaatgaatgtttttgggtttcttgtcattgcttcctgcggattccattttactcctgttcgtttatggcctcaaacatgaatttgaagaattttgccctccctggcagtattgggaagaagattcttttgttcaagtccgtttggacaattagatgggagtattaacaaaaggtcgggctgggcacagtggctcacacctgtaatcccaacactttgggaggccaaagagcaaggatcgcttgagcccaggagttcgaaaccagctggggcaacagagggagaacttgtctctacaaaaaatttaaaaatcagctgggcatggtggtgcacgcctgtagcccaagctatatgggaagctgaggtgggaggattgcttgagcccgagagtttgaggctgctgtgagctgagatcacgccactgcattccagcctgggcaacaaagcaagaccctgtctgaggtcaactctgcccccaggaaggtatgggaccttgcaatcttatctaggttgcgtctttttcattgaaatcacgaaatcattaaggtaagtagggaagggtcaagatagctaagatgagtgaggggacacagacaccaataaaagttctaactttgaggactcctccagtattcttttcatcctaaagcttctggcctatcagctagttcagacacagcctaggagtctcaagccagtacaggaacaaggaggcaggttgccctcttggggcaaagctgtggccccacccttgatgaagaacgcctgtaggaacccaggacctgtgagcaggtagagtcctgaaggtttaagattctgtggagcaggtatgtgcagtgccagtgcgcaaccagcaactgatggacaggaataggtagagctgctctgagtgcattcctttggcaagcctgggccagaggcacacaggaaggaattagtcatgtggtatcataggccaggtgtggaagcaaatgagccagagtggaaccaggaccagccagggccaaggcagggagaagagttcctctagctgacattgacaggaaagcagagtcaaaaacctggaatggtttgcttcaaagactggatgctgcctaatgacctcgaaggccagtgatacctggactcttgagtgagcaaggcagattttggaatgagcacacaacttcaagtaagcccggagatgattacctgtagtttctgctgctcttagaggcagaatcatctgagaactgattgaggagtgcatgtataccccagagactagtgcactctaggataaaaggagtcattcagcccttacttttggttggatgcagggtgtagtttcaataaaatgtcacagaacaaatttctaagacctttaggttgagtgagtgttagagtttgtctagtagtatatttctcatcagttacctatttagctgttctgcataggcctttgagataaggaaataagtaagataaattctccccagaaaccgcaaaacaattataatgttgagagaagaatgaagtagtaactctgtctgtactgaagaaggaattcggtgtacagaaaagaggtcactgcctgaggtcgggagtttaagatcagcctggccaacatggtgaaaccccatctctacaaaaatacagaaattagtcgggcatgatggtgggtgcctgtaatcccagctactcgggaggctgaggcaggagaattgctagaacctgggaggtggaagttgcagtgagccaagactgtgccattgcactctggcctgggcaactgagcgagactccgtctcaaaaaaaaaaaaaaaaaaaaaaaagtaacgtgactggtcactgtgagctggattggaggaaggtgggaatggagactaagggctcttgctgagaggagtttgagtaagcctttttcaggttctcttgtctttagcatttaaatcctggactttataagtagactgacagttgtggcatcaacacaactaaaaggcagggttaccctcttagagtacacttggaaaatcagtctgaaatgaaagaaactttcttggtgaagtggaagtggaagttttggttgggtgcagtggctcatacctgtaatcctaacattttgggaggcaaaggtgggaggattgcttgagaccaggagtttgagaccagcctgggcaacatggcgagatcccttttctttttcttttttttggggggagacgaggtctggctttgttacccaggctaaagtgcagtgcaatggcattctaacactcacccaacctaagggtcttagtatccatacaaaaagcattgacaaaaagcatgccatatgttaagatcaaggtttatctttgggtgttgagtgcaacacttgttataagaagcaaaataaacttagaagcaaaggagtggatgaggatctgtcttgggggaaaatccaaagattagttgtgatcagagtatagtaccttttggcctgacttatataacaaactctgcaatatgttaaaacctttaatgaaaacaagggagatgttggactctaatgtcactcttaataatgaaataaccaacatttgttgagctttttactacataccacaggtgttcttctaagctttttactttcattagctcaatagtctttgccttatcatataataggcactactgcatggatatatgttgtcatttactgaggaagcagttatcaagagcccagacaataagctgagaaatctgagttgactttaaagtcctcctgtgtttcaacaagggtgccaagaccattcgatggaggagggacagtcttttcaaaaaatggtacttggaaagctggatacccacatacaaaagaatgttgttggcctccttaccttataccagatacagaacttaaagtggatcaaagacctaaatgtaaaactgttagaagaaaacacagggcaaaagcttcatgatgttagatttggcaatgatttctcagatatgactccaaaagcatatgcaacaacaacaaaaaagatgaattggatttcatcaaaattataaacttttgtgcatcaaggaacatgaagaagaatgaaaagacaacccacagaatgagaaaaaaatatttgcaaatcatgtatctgataagagattaatatacaggataacaacccaattgaaacataaagtagccaagtgcattggcacacacttatagtccctactattcaggaggctgaggcaggaggattgctgagcccagaagttcgagaccagcgtgggcaacattgcaaggccctatctcaaacaataaattataagcaaaggacttaaatagacatttctccaaagacgatatacaaatggccaataagaacatgaaaagatgttcaacatcactagtcattagggaaatgcagatcaaaaccacaatgagataccagttcatacccattagaatggctgtcatcaaaaaaatggggccaagcacagtggcttacgcctgtaatcccagcactctaggaggccaaggcaggtggatcacctaaggtcaggagttcaagaccagcctggccaacatggcaaaaccccatctctactaaaaaaaatgcaaaaattagctggttgtggtggcaggcgcctgtagtcccagctacttgggaggctgaggcacgagaattgcttgaacctgggagatagaggttggagtgagctgagatcacgccactgcactccagactgggtgacagaggaagactccatctcaaaaaaaagaaaaaagaaaagaaaaaatggaaaagacaaaattgttggcaaagatattgagaaatttgaacccttgttattactggtaggaatataaaatggtgcagccactgtggaaaacagtttaatttgtcctcagaaagttagagaattaccttatgacccagcaattccatttttaggtatatattcaaaagaattgaaagcagagactgaaataagtgcagatacttggatgccagtatttataatagcattattcacagtggccaaaatgtggaaccaacccaagaattgatgagcagatgaatggataaacaaaatatgatttagacatacaacggaatattattcagcctttttttttttctgagatggagtttcgttcttgttgcccagcctggagtgcgatggcacaatctcagctcactgcaacatccgcctcctgggttcaagcaattctcctgcctcaaccccccgagtagctgggattacaggcacacgccaccatgcccagctaattttgtatttttagtagagacggggtttttctccatgttggtcatgtgtccggaattgatgggttcttggtctcactgacttcgagaatgaagcgcggaccctcacggaggcagaggttgcagtgagctgagattttgcgactacactccaacctgggcaacagagcgggactccattccaaaaaaataagaaaaacagaaaaataataattacatctgcaaagaccttatttccagcaggcaagaagaatctgttggatgattacaacattgctggattgatagcagcctcacctgccaggctcaaactccagcacagactccctttttttggtaagatggcggggtacgacttaactactcgcatcacgcaccttttggatcggcatctagtctttccgctccttgagtttctctctgtaaaggagatatataaagaaaaggaattattacaaggtaaattggaccttcttagtgatgccaacatggtagactttgctatggatgcatacaaaaacctttattctgatgatattcctcatgctttgaaagagaatagaaccacagttgttgcacaactgaaacagcttcaggcagaaacagaactaattgtgaaaatgtttgaagatccagaaacgacaaggcaaatgcggtcaaccagggatggtaggatgctctttgactacctggcggacaagcatggttttaggcaggagtatttagatacattctacacatatgcaaaattccagtatgaatgtgggaattactcaggagcagcagaatatctttattttttcagagtgttggttccagcaacagacagaaatgctgtaagttcactctggggaaagctggcctctgaaatcttaaagcagaattgggatgcagacatggaagaccttacatggttaaaagagaccatagataataattctgtgagttctccactccagtctcttcagcagagagcatggctcgttcactggtctctgttttcttcaatcaccccaaaggttgtgataatattgttgatctcttcctttaccagccacagcatcttaatgtgtccacacattcttcactatttgactacagcagtcatagcaaacaaggatgttcgaaaacgttggcaggtgctaaaagatctaggtaaagttactcaacaggagtcttacacatataaagacccaattacagaatttgttgaatgcttatagattaactttgacttagatggggctaagaaaaagctgagagaatgtgaatcagtgcttgtgaacgacttcttggtggcttgtcttaaggatttcattgacaatgcccatctcttcatatttgagactttctgtcacatccaccagtgtatcagcattaacatgttggcagacaaattgaacatgactccagatgaaactgaaaggtggattgtaaatgtgattagaaatgcaagactggatgccaagattgattctaaattaggtcatgtggttatggtaacaatgtactctcaccctatcagcaagtgattgaaaagaccaaaagcctttcttttagaagctagattttggccatgaatattgagaagaaacttaatgacaatagcaggtcagaggctcctaactgggcaactcaagattctggcttctactgaagaaacataaggaaaagattttaaaaaaactctaaaagaaagatgaaataataaaactattatataaagggtgacttacattttggaaacaacatattgagtgtaaattgtgaagaattggaataaaattgactgattcaaaaaaatttaattcacaaaaaaattttaatccttttaagctaattatagattcacatgtagttgtaagaagttacaaagaggctaggtgcagtagctgacgcccatgatccccgcactttgggaggccgaggcaggcagatctcttgaggccaggagtttgagactagcctggccaacatggcaaaaccccatctctacaaaaaattagcaaagcatggtggcacatgcctgtaattacagctacttgggaggctgaggcatgagaatcacttgacctgggattacaagtgtaatcccagccataggctgggtgcagtggctcacacctgtaatcccagcactttgggaggccaaggtacgggtggatcacctgaggtcaagagttcaagaccagcctggccaacatggtgaaaccccgtctctacaaaaacacaaaaattagccgggcatgatggtgcgcacctgtaatcccagctactcaggaggctgaggcaggagaatcgcatgaacccaggaggcagatgttgcagtgagccaagatcacgccattgcactccagcctgggcaacagagtgagactccacctcaaaaaaaaaaaaacaaaaaaaaaccaccagccatttgggaagccaaggcaggattgcttgagaccaaccagaagttcaaggttgcctgggcaacagagcaagactgtctcgagacaaaacaaaaagtcagcatcttctgcccacttttactttaacatacatttatggatctattgtctctttccctgttctaaaactttaaatttcacaagaatgaagattttgctgtcttgtttcctgctgtgtccccagcataaacagcataaagaagtgccataagatagaaatttttgttttctgttcaccagtatatccacagcacctagaacagcatctgctttagacttattagatgaagacttaaaaaaaaaaggaacagcacttctgcacatatttagcacttgatacatatttgtggaataatttctatcataactagcagctacttcctaatttgatatgtagcatcccgtattaacaggacttttgtgaatggagaggacatctatttattctttgttatgtgccaaatatatttgtattaatcataactcttaatattcctttaaaattaaataattgtttccacagctcttaaaatagaatttaggaacctagcaacatgccactcatccattaacagtgataaattatttaattttataaacttttcattaaagtaactgatatagtttggatatgtgtacctgcccaaatctcatgttgaattgtaatccccagtgttggaggtggggcctcacgggagttgactggatcatgggggcagctttctcatgaatggtttagcaccatccacttggtgctgttctcatgatagtgagttctcatggtgtctggtcatttaaaagcatgtggcatggctcacacctgtaaccccaacactttgggaagccaaggtgggcagattgcttgagtccaggagttagagaccagcctggtcaacatagcaaaaccctgtctctctgaaaaatataaaaagtcaccaggtgtggtggcacacacctgtggtcccagctacttgggaggctgaggtgggaggatcacttgaaccgggagttggatgttgccatgagccaacatcccagacactgcactccagtctggcgacagagcaagaccctgtctcaaaacaaccacaataacaaaaagctgttgacacctcccctgcaacttcttgctcctgctctggccatgtgatgtgcctactcctccttcatcttacaccatgattgtaagtttcctgaggcctccccaggagccaagcagatgccagcatcatgcttcctgtacatcctgcagactcgagagccaattagacctcttgtcattataaattacccaatctcaggtattttttttacagcaatgcaagaatgcactaataacgaatctaggtcgggcacagtggctcacgcctgtaatcccagcactttggcaggccccaggcaggaggattacttgaactcaggagtttgagaccagcctgggcaacataacaagaccctctccatgttggggtctctttaaaaacacacacagctgggcgcggtggctcacgcctgtaatcctagcactttgggaggccaaggcgggcggattacctgaggtcaggagttcgacacccgcctggctaacatggtgaaaccccatctttactaatgatacaaaaattagctgggcctggtggcacacacctgtagtcccagctactcgggaggttgaggcaggagaatcacttgaacctgagaggcagaggttacagtgagctgagatcatgccactgcactccagcctgggcaacagagtgatactccatctcaaaaagaaaaaaaaggcggggcacggtggctcacgcctgttatcccagcactctgggaggccgaggtgggtggatcacctgaggtcaggagttcaagaccagcctgcccaacatggtgaaaccccatctctactaaaaatacaaaaattagccagccatggtggcaggcacctgtaatcccagctactcgggaggctgaggcaggagaatcgcttgagcctgggaggcggaggttgcagtgagccgagatcgtgccactgcactccagcctgggtgatagagtgagactgcatttcaaaaaactaaaaagaaaacacacacacacacggccaggtgcggtggctcatgtctataatcctagcactttgggaggccgaggtgggcaaatcatttgaggccaagagttcgagaccagcctgggcaacatggcaataccctgtctcctctaaaaatataaaaattagccaggtgtaatggcacatatctagtcccagctactcaggaggctgaggcaggagaatcacttgaacccaggaggcagaggttgcagtgagccaagatcatgccactgcactgtagcctgggtgacagagtgagactccatcaaaaaaaaattaaacacacacatacacaaatctaatgtatcagatatccttaaatgcttctaacactgaaaatgagatgaatatcacaactagaatggttatcacattatacataagtgggttgcaaaaactgattttattatacacgtatactttttaatttacatttggattcaaactttttttattatacactcctggcatatgtaacattcagatagttctctttctagcactatgataatctcatcagatcccaagagttggggaggaggacttgatttcagactatccagtttgcaaatccacatcacatatgcctttacgaattattttgaataggtagtatgcattacacaaacactatacagtgaagtctttttcaacctctctcagttaattatatcttctcaaaactattctacgcaaacacaaagacatatgtactatatgtttttgtttttgttttgagacagagtctcactctgtcacctaggcagagtgcggcagtgcgatctcagctcactgcaacctctgcctcctgagttcaagcaattctcctgcctcagcctcccaagtagctgagattacaggcacgtgccaccatgcctggctaaattttgtacttttagtagagatgaggttttgccacgttggccagactggtctcaaacccctgacctcaggtgataggcccacctcggcctcccaaagtgctaggattacagtcatgagccatcattaccagcctactatatatatattttttaacactgtatacaatacacacagtttgcaccttttttttcttcatttaataatgtatcttgaggattgttgcatttggcacttcatctaaatacaaattattttttctcccactaaaatatagatttcatgatgatgagcacttatcttttcactgctttttatttttaaatgtgtttttctgttgtttcatgaatatttagtttgtatgctatcttttgcctttgtcagtaatgctgttgcaatcaatatccttgtacacgtcaattcttacaagtaggagtataaatacaggatgaaattccaaacgtagatttgctgtgtcaaggggtgtgtacctttccaattgataaggtattgccaaatgtcttcccattgaggttgaaccaatttatatactcactagccttgttgctaacattataacacaagaagcattaaaattgatttttgaacaaaatcaatgtatatgcttttaagtgttctttctttttaaaaaatcattattggaaaatgcaagcaggaatacatggcaagcagagcccatgcaatggccagaattcctacagcagaaatgacttcaacatttgtttataaagattttctccaaatgatttgttgaaataacttgagtcttcaaggtttaattttccaaatgttggctcaaacctgcactgaaattctggcctacggtgtcctagcaaaaatctccctttgcaagatgctgaggtatattggcaaaaccgcagatcacatgactccgggagtttgagaccagcctcgccaacatggtgaaatcctgtctctactaaaaatactaaaattagccgggcatggtggggcatgcccgtattcccagctactcaggaggctgagacagaagaatccttgaacctgggaggcagaggttgcagtgaaggtgacaaaacgagactctgtctaaaaaaaaaagtagaggtcaaggcaatcattcctagggaccaggtagaacccaactggagaggaagatgacacaattcaacatgctatggaggagggagagtaggttttatccaggatcacatgggacaaatgcaaggacaggctcaagtttcccacatgcagcatttctcaatcccattttccttggcaagagttcttcccattactaggctattccaatatagactaagctgttgccctggaaggactcta

SEQ ID NO: 2378 - DNA, 2350 bp, Homo sapiens
caaacctgcattaacatttaaagaaggcaggccaagcatggtggctcatgtttgtaatcccagcactttgtaaggccaaggcgggagaatcacttgggtgcagaagtttgagaccagcctgggcaacatagtgagaccccatctctataaaaatttttagccctcactcgccgccgacgacctgtctcgctgcgtgcacgccctgccgccgccccgcagaaatgcttcggttacccacagtctttcgccagatgagactggtgtccagggtgctggctcctcatctcactggggcttatgccaaagatgtaaaattcggtgcagatgcccgagccttaatgcttcaaggtatagaccttttagccgatgctgtagcccttacaatggggccaaagggaagaagaacagtgattatcgagcagagctggggaagtcccaaagtaacaaaagatggtgtgactgttgcaaagtcaattgacttaaaggataaatataaaaacattggagctaaacttgttcaagatgttgccaataacacaaatgaagagactggggatggccctaccactgctactgtactggcacgctctatagccaaggaaggcatcgagaagattagcaaaggtgctaatccagtggaaatcaggagaggtgtgatgttagttgttgatgctgtaattgctgaacttaaaaagcagtctaaacctgtgaccacccctgaagaaattgcacaggttgctacaatttctgcaaacggagacaaagaaattggcaatatctctgatgcaatgaaaaaggttggaagaaagggtgtcatcacagtaaaggatggaaaaacactgaatgatgaattagaaattattgaaggcataaagtttgatcgaggctatatttctccatactttattaatacatcaaaaggtcagaaatgtgaattccaggatgcctatgttctgttgagcgaaaagaaaatttctagtgtccagtccgttgtacctgctcttgaaattgccaatgctcaccgtaagcctttggtcataatcgctgaagacgttgatggagaagctctaagtacactcgtcttgaataggctaaaggttggtcttcaggatgtggcaatcaaggctccagggtttggtgacaatagaaagaaccagcttaaagatatggcaattgctactggtggtgcagtgtttggagaagaggggctgaccctaaatcttgaagatgttcagcctcatgacttaggaaacgttggagaggtcattgtgaccaaagatgatgccacgctcttaaaagaaaaaggtgacaaggctcaaattgaaaaacgtattcaagaaatcattgagcagttagatgtcacaactagtgaatatgaaaaggaaaaactgaatgaacggctggcaaaactttcagatgtagtagctgtgctgaaggttggtgggacaagtgatgttgaagtgaatgaaaagaaagacagagttcggatgcccttaatgctacaagagctgctgttgaagaaggctttgtattgggagggggttgtgccctgcttcgatgcattctagccttggactcattgactccagctaatgaagatcaaaaaattggtacagaaattattaaagaacactcaaaattccagcaatgaccattgctaagaatgcaggtgttgaaggatcttcgatagttgagaaaattacgcaaatttcctcagaagctggttatgatgctatggttggagattttgtgaatatggtggaaaaatgaattattgacccaacaaaggttgtgagaactgctttattggatgccgctggtgtgacctctctgttaactacagcagaagttgtagtcacagaaattcctaaagaagagaaggaccctggaatgggtgcaatgggtagaatgggaggtggtatgggaagtggcatgttctaactcctagactagtgctttacctttattaatgaactgtgacaggaagcccaaggcagtgttcctcaccaataacttcagagaagtcagttggagaaaaatgaagaaaaaggctggctgaaaatcactataaccatcagttactggtttcagttgacaaaatatataatggtttactgctgtcattgtccatgcctatagataatttattttgtatttttgaataaaaaacatttgtacattcctgatactgggtaaaagagccatgtaccaatgtatggctttcaacttaaatcactgaggcatttttactactattctgttaaaatcaggatttttagtgcttgccaccaccagatgagaagttaagcagcctttctgtggagagtgagaataattgtgtacaaagtag

SEQ ID NO: 2379 - DNA, 2627 bp, Homo sapiens
gcagcgccccactcaacaaagcttcccgcgggccctgccccatgactcaccgctgggtggggcgggcacgcaggcaacccgcgggccgagacggggtagtgagggccggaagcccggctcccgactccgcttcgtccccacaacctccggccgcctgaagtcctgaggggccgtggccctgggtcgtctcccctgttcccagcctccagtcgcagctggcggagagaagttcccgaggcccccccgacttgcaaggtcccttgccccgcccagagctgagccttccgaggatctgaggaccgagtccagcccagctcccaggaggggccgggatcctggggcagggaataaggggcaggggctggctctaaagtcgggcgggagaggggcactaaccgagatgggggctgagcctccggtctgggagcttcgggaggcgcgtggcgggatggaaaacattcctgagaccgttggattggatttccgaatttgggaggctaggactccggctacggtggctctgctcttgggatgagaggactgggcccagcttgcgaggaatcatgaagtggacacagggtgggaacgtgaattttaatgagggggcagaccgaggaggtggtggctgcccggagatcagggccaggctgtgctagatggcgcctggaaggggggtcacccaagtctccctgctgtcatttcaggaggccgacccaagtctccctgctgtcatttcaggaggccgaattttttcccaatcccagagaaggtgtcagaggcctggttagcagtcttgtcgatggtttcctgggtggtcttggccagctggtccatggctggggaagggcgggagagagggcaggtcaggcagggcccgggaaccacagtgcctgtaggcttagcctggcctgggtctcccgggggacctgcttggggcattgtggacagagggctctgcagaggagaggatgtgcctgggccccagccgggatggggcggggagtgggaggtgtgctggggttgcccgcctccctccagccccaccagacctttctgccccgcctctgtggcctggtccaccacttgctgagctgccgctccggccgctgacactggaacagagagatgtggcttttagcccctgttgaggcaccaccgactacaggtgccccaccattgccatgcctctgtgtcctccagagtattcggtggtacaggtccaagggatggatgccatggagataaagtccctggcccagggccccccagcccgaggggcaggagacctttccatgcctctgggatgtttttgtttatttctaactctgagctccttctctgtgggggaggagcttccctttccatctccagggctactgagaaaatgttggacagaggaaggaaggcagggcagggccaggctgcagctagcatctggactgttggctaatgctggtgatggcgcagaagacccttgcccccttttacagcttctcccctagaagcctggcccagatgcctgaattcccacctttcatgcacttagccctggggcttgcagttttgccaggtccttactgcctcctccctcctgtggcctgcccggaggggcacacaagcaaagccagtgcctctgtggacaggcagcttaagacattaggagacaaatgaaggaaggaggcaaaacttccaaggccggactatctcctctggaccagagtttcggcctgctgggaatggagtcaccagccccgggggggctgacaggtggctcccgcctacagagctgtaactcatccctgctgctgaacaggaaagggcctgccttacccagatcccatcctccggaaagggttagtcaggcaagtgtgctgagaggcccctgggaacctcgtctcgattaacccatcagaaagcagcccatcctttgcacccagctctcagatggaaaagtgaagcccagaaggaagggacctgacacggaggcttccttggtagcatttcagtctcaagggaagaactgtgggcctcccctggagcactggtgaactgggtcacctccagaatacggaggagagagctggaggtggaggaactaaggaccttctttgccaggtggggacttaaagtttcagttactcattgttggggctcagaaaccaataccccgaaatatagtggtgtgacattctgaactgaagaagccttaaggtctctccgaccagactcccacaggccccccaaccctttgtctcttccaaagcatacagtgaagttgttctctgaagttcctcatctgccttaagtctggacccaccaaagaagaaaacaatgaccactggtcccttcccggagttttctctgactgaactgctgtcacaggaagaaagactgaagcctgctcacatacctggacagattttgcaaaccgttgtctgctctgtgagcccaacagactttgtcccaggccactgtatgttcttcaagcccactgaattcccctgaaaatcatttactagccccctgaaattacccacacttccccattgctcatctgtaccccatttcgtggtggggcagtcactctgatttccccttgcatgctaatgaatgtgtattccatttct

SEQ ID NO: 2380 - DNA, 2372 bp, Homo sapiens
atgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgagctgcctgagctgacacgaggggaggggtctgtgtagccaacaggtgaccgaagggcttgcctgcccacagcttacttggccaaggggtttctgaagttcctgccggcaaacttagccttgctgcccagctcctcttcaattcttgggaaggagaaaggtaaagagatggggaggaaaaaagaaaagtcagacctcaagttttaagttttcccatcctagatgtggtcaaagacacagccccactcctgggaagttgagaacacagaactctccagtttgtccaccttctttaaaccctctaaacttgtgcttctctgagaagccagatatagaaaagtatttagttctcctcatcccaactcaccatgctaggtgccctccacccaccgccccttctcttcctctcctctccccgtcagtgttgcagaggagcaaagtaaaatgtcagcattgccatttcttggaatataaaaattctaatgcttttgttttttaaaaaatattgaagggacaacaaataaatggcatggggagaaaaggagagtgaccttattaaaagacaaaatgtgtgagctgtttggatcttgatgttaaaaaaaaaaaaaaaaaaaaaggccaacacattttggggccaggcacagtgggaggatcacccgaggtcagcttgaccaatatggtgaaaccccgtctctattaaaaatacaaaacaattagccaggcatggtggtgggcacctgtaatcccagctactcgggaggctcagacaggagaattgcttgaatctgggaggcagaggttgcagtgagccaagactgagccactgcactccagcctgggcgacagagtgagatccctctcaaaaaaataaaaataaaattccccagcaaaaaaagaatgggagtttgaggctgcagtgagctatgactgccccactgcactccagcctgagtgacatggcaagaccctgtctcaaacaaacaaaacaacaaaaaagccctgcgtctactgttcacctgcttttttgtatatgtttgaaaatttccaggatacagtttgaatgaaggggtaatatgggagaacttagcggggtggcgggcggggggacaagtctcctggtgttcaggggcttcccaaggacacagacaggaaagggagaccagaacagccccacagcgctcacaagtggaaacccagccatgtgcccttcggccttttcttcctccctcccagccctggctccacatccacaaacaggggttaaatgcgctgaaacagatcatatgaaggagctctctgaaagctctaagaaagtcatgcatcagctgtcaaagggggtcccattctttctcaccagaagagggcagcactgtgtggaacaggctcctgcctctggtggcgctgcagtgggtgggtagggggagtctaggcctaactctgtcctgacctaagcctgctcagggcctggctgtctgcactgtgcacctgcacctgtacatgttcccagagccaggagctcctgggggagggcagtgcctacactgagtgcaggcccccacctagtgaaccacaggccccttgttctcaggagccctccttacctgaggagctggttgtacttggccaagcgctcagatcggcaaggggcaccagtcttgatctaggagaaaagaaaggccatttgcttacagcggacaagctttgcaggcatttctggcagggagagggtgtggtgtcagagagagaatttctagaggatctgatgctaggaaagtgggggccacaacatacaggcagggcgctcatgcccccattctgttcagcctcagaaacaagagcactgactcaggggacatgagcaaaacggggacagacatggagcctcactggttttgggtcttcctaggaagttgaggtcagagaagaaaggaggagacgctcattcttacctgcccagtgcacagccccacaaccaggtcagcgatgaaggtatcttcagtctcccccgaacgatgagacaccctgggtagtccttgatgaaggacttgtacaggtcagccagctggtcaggcgagatgtacctgctggggtcatcgggagacttgaagtccaggtcatacttcccagacctgaagaactcggaggccgctacgtccatgccgatgaccaccttatcagtgtagccagctttcccaatagcagtcttcagcagctccag

SEQ ID NO: 2381 - DNA, 10186 bp, Homo sapiens
ccgagcccagctccactggccccggccgcggggctcgcccctccgtccccaaacgaccgtctccgctgccatgagatgccgacagcctgtgcgctggccgccaccccctgctccatcaggtgctggaatctgagtaaaagcctgggcgcgagctcccagccccggggcctgccaccggctccacgaagcgggcagctccagcggccgccgggagaaggaagggcgaccgggggagacgggtcgcagggacagcacgtggcggaaagttagccccggactagcacgccccacccggagaagccggcctggaaggggctgcggaccaccaggcggagcggtgggcgaccgaagtgcggctgggctggcctcctcgtctccgcactggaagaattgcccttccgcaagtcttcccttcccacatgggggccctccaggccgcacctcggtcgcccaccgcttcccttgagaagggagactaaagacaggcatctggaagctgtcactgtggcgcgcgggcagacaggggatcccattggagaggaagagccgtagtagtcgctgctgccttcggccgacccaacggccgcctgcttgggaggaagaaaaagaacgcccccgctgaagaattaaggcagccattggttgctctaggggtaaggaccgaggcctcccctgggtgtcactggagcagccacacgtgggggatcagccgacttcattcgatcgctggcgacagacccggcgacccgtaggaatgcgcgctggggctgcggctggagggcgtggcgacggcaacaggcgggtggctcgagtgggtgcgactctgggcgcgtgggactgagaactcctccgccgtggggaagatttttttcccagcagatgttggggtgttactgcgtgtctgaggggccggcggaatggaggggtcccggtgcgtgcagggcagcgaggtgtgtcagatgagctgtggatccctgcggccccacgtgggccggagaggggggcccacgacaacaagcgattgaggacagcgatggacagggcggggaaccagctgggtggaagcacagggagtgtggtgaggagggaagggctgtgatctgccctcggtacgacgccccaagggacagcctggcctcctgaattagggaaaagacaaccggtctctttagacgggcgcctcagagtctgacctgagtcttcaaacgcccagatcccctggggccttgagtctccctgtcccgctggccctgcctcgcctgcgcttcaggactccgacgcccccgcagccttgggctaagggtcagtcgtccccgggcgcgggtccggctgccctggaactgatgctggatttcgctggtaggtgggctaggggcttggtcaccccgtctgaattccactgtcaggacagctgtggaaccgccagagaaaagtctggccatgaaagaaaggtgaggggcgccgacgcagagcttatttattcagtctgtgggcggactcagacgtgcagagcaccaacctcttcaatttctgccctctagactccaaatcttttgaaattagggaccaccattttatgccaaacatacagtaggcgctcaataagtgttgaattaagattacacataaatgggccgggcgcggtggctcacgcctgtaatcccagcaccttgggaggctgaggtgggccaacatggtgaaaccttggctctaaaaaaatgcaaaaattagccaggcatggtggcgcttgcctgtagtcccagctactatagaggctgaggtgggagagtcgcttgaactctggaggcggaggttgcagtgagccgagatcgcgccactacactccagtctgggtgacgcagtgagaccctgtctcaaaaaatatataataataagattacacacagatgggtgctgtgcaaagggagggggaagacaaatactttcttctgcagctctggtacatggacattttgtcctttctccataaggaggatcagacagcagcagcactgcccatggaccagaggcctcatgtaaggcctgggaaaagagggctccacacaccaccaaccggatgtaagggcagttgcaaaggaactgtgttatcttgaccagaacagactgtagaatttgtttatcaaattttttttttttacttatttattttgtgaatgtatatgctgtaaactcatctgcttagattgtaagaatgtgaatgccctaccttggtgggtaggttagtttattctaatcagcaaaacttaacgttacatattccaacatctcatttgggatgtgaagatgctatggggagggtgggtatcctggcattgctagaatgttggagccttagcgagagagtggcagagtggggagaacctggcacttcagctacagatgatcacttatgagctttgttatatcaaataagttaaactttcatctcattttttttttttctattgtaaaatagggtagtaacagtgagtcctgggggaggacgtgttctgttagccagatccactctccaacctgctgtctgtcctttggagccttaactcaagagactttctttccctctagcttccagttgagtgaaggcactaggaagcaacagcgatggaacaaagaggaaggagtatggttatttattcccccctggctcccttactatggcaccattgcaggctggttgcctccctcaaccaaaggaagcagccagtatccctccctagggtgacccagagtaaacccctatggtttcccttcattttgcacatacctttgcagatagtctttttataaaactctactcacattatccagtaggaatgaacatctcattccttcacagaattgttttgagagttaactgagaaaatactgtattattattattagaatgacctataatttctgtccaaactgagaaacttttgaggctgggaaaagggggtttgtgctgatagtaatgatgtcaggacaataggaaaaacaaggacttatggccaccccagctattattgccagtaaactctgctttagacatattaagcaatcaagaagtggtcgtactatcacgcttctgtcactagactatgaatgtctcaaggtaagagtgcttttttgtctattagcttctgtcacatggtctggtatattcaataaattttgagttggagatgagggtaaagactaggaaatgaataatttttattgccatactaaggtaatgaagagtcaaggaggtctttaagcaaagaaaatttgcattttagaaaacagctatagtgaatatttggcattgttagtaatttagggtctattccctttttaattgaaccccaatttatttggagagcttttccaatgaatgtttcaacttggtaaaaagtaaatgcctcttaaaaaagaggttctgggccaggcgtactggttcatgccttgtaatcccagcactttgggaggccaaggcgggcagatcacctgaggtcaagagttcgagaccagcctggccaacatggcgaaaccccacctctactaaaaatacaaaaattagtgggatgtgctggtgcatgcctgtaatcccaactactcgggaggctgaggcaggagaatagcttgaactcacaaggtggaggttgcagtgagccgagatcgcaccagtacacttcagcctggctgacacagccagactccatctcaaaacaaaaccaaaaaaagaggttcctcgctggctgtggtagcatggtgtagtcccagctactcaagaggctgaggcaggaagatcacttaaagccaggagtttaaggctgtagtgcgttatgattgagcctgtgaacagccaccgtactccaacctgggcaacatagcaagatctcacgtccaaaaaaattaatttaatttattttcaataagaggctcctgaagagacgttccatcacacccttcctttcatcaccacagtacatacattcttaagaaagtatgtgatctaagcttggccaattagatgctgttacatttgaattttgaatcaagagacacaaagacaatacaaattgttacagtttatgcaggccataaattattttttactttttggcaaattgttacagtttatggggtctacaatttatttttttattttctggcttaagttatctaggatttgtttctgtggtttacagtcaaagaacccaaagaccagatcactcttgactaccataaaaatgattaattataaagggatacaagaaaaacaggaggctgggcacagtgtctcatggctgtaatcccagcactttgggaggccaaggtgggtggatcacttgaggtcagaagttcgagaccagcctggccaacatggtgaaaccccatctctactaaaaatacaaaagttagccgggcgtgatggtgggcgcctgtaatcccagctacttgggaggctgaagcttgagaatcacttgaaccggggaggcagaggttacagtgagccgagatcgcaccgctgcactccagcctgggcaatagagcaagactgagtcacagaacaacaacaacaacaacaaacaaaagcacacacacaaaacaggtgataagttagctattgccactttaattttggatggtttaactgactgtcctgaactgactgatcctgaactccttctgcaacacaatatgtaaaaatgttcattaaaacattgtaaaatgcatctacatttgagaggaaaaagtaaaactctctattcacagataacacaaatatacagaaaatcctaaggaatccactaaaaaatcattagaagtaataaatgaactcagcaagtttacaagatacaggatccactgagattctgataaacatggaaggcaaaaacattgaaaccgtcatttataaactcacataggctccagtgattatctcttcttttctttgttaaaaaaatgcatttaaaaatcattctagaaaattgttaggcaatgttaaatttaccaataactctgactcttctttgcccctaccactttttattatctttgaaaatcaagacaatatttgcccttcttcaatcttttatcatttcttatttttctctggcttctggaaagtgagtaattacctttacgatcacttatgaaatctcttgcatggataattcatttaggcctagaaactcatttaaagcaatcgattgcttgcttaccatgctggattttagtagcctttaaatcatgtttattctaccttttttcattaaaacattagtctctttgggagaggagacaaataaattaaaacttgagttttaccttttctttgtcatctgatagcattatgtcatcagcacgaagcagtagcttccatcctttcttgttcaccctcttgtggcaagtattacttgaaaaacaaaaaaataaatttaaaaaaagtctttgtattctttttaaaggcaaaaattatctaagcctgcagggacatttccattcttataggctatggtactctttaaagcacgctgtttaaaaaatctgattgcaataagtatgtcctgtgaagtgacatgctccttagagtaagatgacttggcttgctggccactctgtttggcagccagccctggagctgggtcagtttcccctggctctggcatcactccttctcagataattcctttctccctgtggccagtcattgtggtgacagttattattctttttcatgagcctagaaaatttatgtggtggatgtccctctgaatactagatactgccactgaattagaagagaatcatatgcacttgtatattctgacagccatgtcacttacaccttctcaccttttgtctcgtcctatttgctatctaccattctaccactgtccatttctaccagctgaataactctctgatgcaggggttactctgcaccctcatctcccttactgtagacttgttccttttgaatgagataaaatttccttgacttataatatttcagtcataatttccttgctacctcatgtaccgatacctattggattatgttcattttgttaattttcccaagttcaatttgctttaccactaattctctctttccaggctgagatttcaaaagtcatcagcattatatttcaccttacttctgtctgttttattgagtcccatctgaatcagcagaagtggctgtaggttggctggtatcatgaattttggcagattatgcttcatgagtcatcattccacactttaggaagataacgaactagccgttgcaagactgccttcctactcatcagcagagaaaacatggacttggaagccaggacacttgcgttcgtgttcctacactgtcaaacatcatgagctatgcaaaatttttaagttgatgtatttggatataggcgaagctgctgtaatgggaatatcccaagagtcattggttaaagaaaaatagatggttttttgtttgtttgtttttgagacagtcttgctctgtcacccaggctggagtgcagtggtgcgatctcagctcattgtaaactccacctcctgggttcaagtgattctcctgccccggtctcccaaatagctgggactacaggtgcaagccaccatgcacggctaatttttgtgtatttctagtagagatgagatttcaccatgttggccagactggtctcaaactcctgacctcaggtgatctacctgcctcggcctcccaaaatgctgggattacagatgtgggccaccgcacccagcctagatgtttatttccgattgttaccttatctactctgatcaaaacagtctcaccagcaccatatccacattctagcccatggaaagggtaaagaaaagaaagtggaagatattagtttccatttaaggaagtgacatggaaataatataagtcacctgtgttcacattccactggcaaaaattcagtcacaggaatgtacttagctgcagaggaggctaggatatgccctccaaaaactcaggggggatgtcctacttgtaaaaggaagaaatgaaaaatggacactgagaggaaatcagcagtctcagaggtaatatacttacacagttttttaaaaaacataaaatgatgcagaatgaagtttccactctattcaccatctatccagtcctcatgcctcccaacaagaggtaaatactttattattgtgtcatgtatctttccagagtttttctaagcaatttgcaacagatataaatatgtatccttatttcctaccttaccccatattgtacatgaaagaaaaaatatactatgtataacattctgtatctttttttcacttaatatattttgcagttccttttatatagatacatagttaccttcttcattcatttatacagctgcctactgtttctaaggctatatcactgataaagtctcatggatacactcaaggttttttcagtcttttatcatgataaaccatgccgcaataataaccttgtactagtcatttttaacatgtgaaagtatatctgcaagatacatttccagaaatgggattagccaatcatatgatattaagccaaccttttgatctctttgagctgcatttgttaactaataaattaagctcatatttacctcataggatcattattataatgaaataaccatataaacaattattgtacaacaatatcaaaaacaaaatagagataagtttatcaaaatatgtgtaagatctgtactctaaaaacctataaaactgtgttgagagaaattaaaggaagcctaaagtaatggagaaatataccatgatcatggattgaaagactcaatattgttaatatgtaattctccctaaattgatctacagattcaatataatcccaattgaaatccaagcaagctttttttaaaaatagaaattaacaatctgattgtaaaatgtatgtgaaaacacaaaagacctatgctagctagccaaaacaattttgaaaaagaacaaagttggataacttacactgtgcaatttcaatacttaactaaaaagctacaataatcaagacatggaatcggccaacatacaatcatatagtccagtgggagagcatatggaaagtctacatatagacacatatggtcaattgattgttggcacaagtgccaagataattctatgggaaaggacaatcttttcaactaatcatactgggactattggatatccatatagaagaaaagaacctcaaaccttatttcacctatacacaagattgaatccaatggatcataaacctaagtgtaaacagtaaagctttgtttagaagaaaacaaagaaaaactcttcatgactgtgggttaggcaacagttttgtagaggagacacagaaagcactaaccaactggatattatcaaacttcaaatttttgctcctcaaaatacaccactaagaaactaaaaaggtaagccacagactggggaaaaatacctacactatttgcaaaaaataataatgacaaaatatgtgaacatacacataataaaagaagatacatgtttggccaaatgcatgtgaaatggtggtcaacatcattagtcatcagagaaatgcaaattaaagtacaattgtatgcctcctagtagaatggtgaaaattagaaagactgatgattccagttgttcgggaagatgtggagtactggaactctgatgccttgttgctgtctttgtttagtgttggtataacagaatacctgaggctggatattttactttaaaaaagaggtttattgggcttatgattgtggtgactagaagagtcaagattgggcagctgcatctgatgaaggcctcatgttgcttcaactcatgacagaaagcagaaagagagagtgtgtgtaaagatcacattgtgagagaggatgcaagagagagaagccaaggaagccaaactcatttttaacaacttgctatcatgggaactaattcattctctcagagcaagaactactcacctctgtaggagggcattcatctattcttgagggatccatctccctcacccaaacaccttccactagcctacctcccaacaccaccacactggggataaaatttcaatatgcattccagtagggacagaccacatccaaaccattgcagttggtgaaaatgcaaaatgtacaagcactttggaaaacagattggcagtttcttatgtagttaaacatatatttaccatatgactctacatttacactaaaaaatagttacacgacagaaataatgagtccacaaaaaagcattcatagcagctttatgcatagcagccaaaaaatgaaacagcccaagagttcaacaacaggttaactgacaaacaaattgtggtacctatatttacataatagaaccctgctttggtataaaataaaccatggatacatgcaaaatgtagataaatctcaaatacattattctgagtgaaagacgtcagaccccaaaattacaaatggtatgattcaacatatatgaaattctaaaaacacaaaactgtagttacagaaagcaaaacaatggtggcttggggtatcagatgaggaggatggacttgaaaagagcacaggatggacttttggagtgataaaaatctgtatcatggttatagtgatgattagatgagtgaatgaatttgtcaaaattcatttgtctgtacacttaaaatgggtatggttgtatacaggttaaacatcaataaaaaaatcttaaattgctgtactaatattgtttttgtgatatcaaaacctgtaagagtggacctctttctctacaagttatcacatgccatcaaacttttgcttagatttgttgaatgcttttctgtctcaggcaccatgcaaagtattttgtatgcatctctcatttaatcatcacagcaatcctctggcatttctccatttcttgatgaggatactaaagcacagagacaataagaatattatccactttgggaggtcaaggcaggaggatggcttgaggccaggtgtttgagaccagcctgggcaacatagcaaggacccatctctacaaaaaacaaaacaaaacaaaatcatccacgttatccaatgtctaattacactgtgaaattaataagtggtagagctaggattcaagcccaagtttg

SEQ ID NO: 2382 - DNA, 1630 bp, Homo sapiens
tattgctatgagtgtatacactctcttaaagtcttcctttctaaaatatttatatccattaggtctaaatgatttccttttaccttttgggtctgataagatttgggtatgtgtctatatctatatatatacacacagacatatgtatatacatgtatacatatatatgtgtgtatacatacatacaataccatgtcagacttaaagataaatatctttaactcattgtatataaacattattaaatttagttttccattaattatttaagtaaagaattagttaagcagccagattttctactttgtatgtatacttcaaagtttttaccatctcaaagctgcagattaaatagatgcatatatactggcaattgagtatactctaaaattattaagccttctgccagtccttttgtttcatttttttcatagttaatcattcaaaaatgagatgatgctatgactttttgatacttaaaattcccaagaattcattagccgtaattaaatatgatccagttcaaaactctggtcttaggacatgtattgccatgtatcttataaaataagctactattcttatctgtgcaatatgcattttatttattgtcatttgtaacatacatggagctgcaagtgttcatggtatccttcaaaataacagaatccctgccttgaagacattaaactcttaaggcaactggaagttagaagttaaaaaatgagcatgaaagttagtaaccaaaagtactagttcactgtataattctaaaacactgatgatgtttgcacctaataatccaagcataatgtggtacaggctcaaactgtagtaatataagctaatagtatgaaatttggaaacgggttcctcttgatagttggcagtgtgctcctagcaatcgaaagcagcactaatctgttgctttatgcaaaagatgcaatgtattataaagatattaaagttcctctacattttataattttccttgttaaagccccagactgccatgtccctgaaacttgagtcaaacacaagcttatttgcactaaagagcatggccaaaaaaataaatgacagggtggaaaagctagttggaacctcttgaaataattggttctaatatgagaatttcacatttgtctatttgaaagctgtatggtccaggcagacaatctgtcagttcactaatttaataatgcactttaccttttgtatatagaagatgtacatttatgccacttgacaggtgggatgtgtttcaataactatgtagctagaatctataaggtgatcccgtgcatgcatatgtttgtgttggaactgttgttgtaacaggtttccattaaatcagtgtaatggagaagggtagaagatgcttttgaaacaaatcccagtatatttaacaaagaattttaaagtagagttcacatttgatgtcttaagaactagaataaataaaatactatttctaacccaaattcttattacagttgagactatatttagttgagattccccacagtgccctgacagttaatttggggaatttgtctagacaaaatttttttcaatcattgtttcattgttgatatgtgtttaagtaatgaataaatatgcagtacat

SEQ ID NO: 2383 - DNA, 1476 bp, Homo sapiens
gccaagtcactggggcggtggggacgatacttctcatttgtagcctttcaatttggtgctctgtctggctgttttgagagctaaactccccattgctcttctggaaggagagctcgctgtccagtactgcgcgggatgaccgagtgaacaggggactggagacgagatgtggctggagactgagagaagcagaggagtcacactccactcacctccacctcccaaagtgccgggatcacaggcttgtgccactgcgcccaaacataactgaaggttttacagacatgtctgtggcaccacagaacacgaacggtcccaatggaaaccccacgcccaatttcctcagggaactgctgtggcggaggcttgcaccccacgtggtggccctaggtacaacggattccggcgggcagagcgccttagatcccgagtctgcagcccagggcagagtgccaacttctcctcatcccttcgtacgccatagaatggaaagacactggggctcctctgttaggagcgtaggagggacaggctggacaaaagggctcccgaacagcaggttcggaggagagcaacccggccctgacccccgcccccaacaccgttcccgacctcgctccccaatatcccggctctgcaccaattcctcccgcaagccaaggaaccccgaggcactcctagtctctaaaccgtttatttctccccaccagaaggttggggtgggcgggcctagaacacagcgtgcggcgggttcccgggtggagccagcgcagacagcgtgggtccctgcggctcttaggcgaaggtggagttgttccagcccacattggccgcgttcatgtcgtaatagttgatgtagaccctgcggggggaggaggccggactcagcgggtggctcagtcccgggcctggccgcgcgccgccgcccctcccccgcccctccgcgactccgcgtacctgtccgggctgatgcgcaggcgctcggccagcaggccgcacagcagcttgctgtaggagcggttctgcgcgccgccgatcttgccgatgctgtgcaggctgcagagcgcgcacggctcgctggagccgccgaaggccatgagctggtccgggaccacgtgcaccgcgatgtactgcgaggaaagggcgcggtcagcccgccccagcgacctcgtcgggccccgaacgtccacttcgggcccgagccaccgtcctccccccgccccgccccccagctccgttcaggagtcgcctccccagctcccagcgcggaacccctcgtccggtgggcacccccctcttcctgtcccctcccggcaaacctgggggggcttgccggtggcctgcgccagctgctgggtgagctcggagaggaacccgtccggcacggaggcgcggggcacgttggtgtttacgatgaacatcggcatgatggcagaaggaccaggagacccgcgcagaggcacagacgcacgcgcc

SEQ ID NO: 2384 - DNA, 2118 bp, Homo sapiens
atttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacac

SEQ ID NO: 2385 - DNA, 963 bp, Homo sapiens
cagctttattttaaaatatacaagtattttgaaatgtagagtttaaggctgttctatttcttaaactccacacaaaactgacaaatccataccaaattaatcacccacagactgccaatttcatccactaatttaacactacagcattcaggataaattaaaggatttaatagtatagacagttaaaaaaaaaaagcagtcatttgtaacatgctgctataaatagaacaaccagtttatggattactggtacaaaaagtttcaatggcaaacttagagcttccttaaaacaaacaaaaaaaatctagactgagttgaagcgttctccatctgggaaaaaaatgctcatcttgtgaattttaacactcagccaaatataaaatcatgttttagagggggaccatcactgatactgggacttaagccaggctttcaaggtttggattaggccgactgatgtggggaagggtggaggctgccagcaaaggaagaaatgagattcgaagttgggataacttgtcaaatgccaaggacaatgaggagacctgtttgttgggagcagagttacatattagaataacaggatttaaagggaacattttttaaaaggtatgttccaaaggaaggtatagttgaaagtactctatccagtccaagaaattcatataaatcagaatttggagagaattttgctgagtacctttccagtgtatacctttgcattttgttaaaggtcacaatcataccataggggctttagaaataatggtaactttttttaaaaaaggtataatcacctcttatttataatgaacagctttagttaaaatatttggccagatgaaagctcttgagcatcaccatggactctcaggctttacatctctggagtattcctgagaaaatagtaagaaaaaaaagcaactttcatcactttttaaaagctctttttcagaggttgtt

SEQ ID NO: 2386 - DNA, 3519 bp, Homo sapiens
attttttattgttaatgtaacttaattccttaaaacctggaatattaatatatataatctattaaaagctgaagattaaatatgtaatttttgcttttagtttcttgtgttagtatgcttaaaggtatcaatacttttattctatattcattagaagaaaggtaataaatttaagtttcattgctgaaaaattttaaatgagtgccaccccatagccatagtcattttgattaagcataatttaactttcattatagcataaagagaaaataattattttagtatggaaacagtgataggcagtgctgtaaacaatattctctgaaaagttgtgggggtcacaaagaaaattttaaagaatatagaagcttttttaaaaaatctttttagtgtagtttcttagaacaaattataaacataatcattctgaataatcaatttttatttagtccttaactatgtaaaaccgtatcagtagaaaaatgtgctggtgtcgtgtctaaagatggataaatttctttggaatttatctttggagaccaactttatgaggcagactttttgtctacagctttggaaccaaaaaaacttcactctaattcagtcctaaaggctattttacattttgccggggtaaagtgacttcaagatacagcatggtgtcttgtatctagtagaatattgtgctagccatctaaaaaagtggatttgagccttaatttggccgtttctcaattgtctagttgaccttagacaattagtgtccatggctttccttttgtttttcccatactgaggaacttaaactacagctctaaaatgtcttttggttttaaaattctgaatgcttatatactactattaaaaattaaaaatccctcaaatagtagggcaatacaggtaatatgaaattaaatgtatttttatccattatttgattcccacctgttattttatttagaatacgaatacaaccaagtagggaaaaacgtatcagtaactgctattcaacttaaattcagcgaattaatagctgaatagaaatagctaatgacaatgcaaaagagaaaacaagccatattgctaagaaaaggatagtaagctgcttagaaagaaccagcctgtgttggaaataattctcttctagataatttaccttattttcttggcttgtactaattgaatggaagtggttaatttgttcagagtttattgccgtttgatgccaccccagtctatagttctgtgtgactttccatattgaaagagtagggttagtagccaggttgtcagtcttttacaaatgtctacataaatgtctacataaatctgaaagtggtttatattcaaggttagtttttcagtagcgtctcctccttattcattcacttttactgtgaagactgaaatccaaaagccaggttccccaaaaaagtatttttaaaaaattttaggggaccaaaataaatagaggaagaccaatataaaaaaatatgttcaactattccattttaaatttaaagcagaaaaaaaaattgtgcccctcagacctaaaggcagctttaaatgtatatagtttggtgaaacatttgggaaatattaatttggaggtttagaagcatacgaaaaacaaattcaaagcacttgaaagtaaagacaatatcatgaggtcgaaaaaacttcaaaaggatattaggtaagagaaaatgtgaatgaaagcagtgaatttctgcctctcctcgtatttagggtacttaaaattactaaaaaatactgtctttttaccatacagctagatggcctgtattattcttaatgtggccaaaggagtgaagactgattagggttttagaatttggaactgtagtcacataaaggcatcttttgcatttcttaaaccagtaatctacattttctcctggaaatggagaaatatgaaatgtgctgtgcatagcttttggaatagaaaacaaagttttaaaagaatggatatgttttcttgcacaacttgtaaaattttaattaaaaaattacctcatttttcaatccataaggtgctttgctcaagtttgtgggatgtttgtaccatcccataaaaacccccttcacccaaactgtatttgaaatatgcaaaattcataactaagggatagcattccttggagactttgttttgttttactcttgtttaccagctgggccaacatggtagatatatgagattcacatatggtttcattaaagcacataggaaagtgctcagtcaatatttaattagtttaattagataagggaaaggagaaatcctaaatttgatggattcttttatactgtgaatatatttccatcagtgttggtaagatatcaaatgactatcagttgatcccagtcatcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttttgtcataataaataattacttttccaat

SEQ ID NO: 2387 - DNA, 1415 bp, Homo sapiens
atttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctggaat

SEQ ID NO: 2388 - DNA, 3228 bp, Homo sapiens
cattataaaaagttggctttgtgtaattacaccgagccatacaacctataaagtgaaaatactgcagattttaggaccccttcttctctagtcacaatcattttaaacagtgtaccccaggatgaaaaaagctccatggctgacatgtacaattacatgtattaatgactgctctacatcctatgttctgcctttggccaccacctctattccacatataattcatcattcttgtttgcctgcagactcttgcagtgccttgtaatatttacaatcttttcaggtttttgctggaaagaaaagtagtcttctaaagtttgaagatggtgaatagtgtactgctgtctccatgctgactgcagtaaccgggttatcatatatgttatgtatacattatgtatatataacatgtgtacatttaaaaatacagaaaaaagtgagcttgtgcagaaatggagaaaacaatgttattctcatcactgtggggttttattaaaattattttttcccatgacttacatgtttggttcagattatagtcactttgactgtaaatactggctagttttctatccagggcttttgcattatttcataattttgctaaatcatataatagtgctattttcatccttgtctgaggtacttttcctccccagaaataattaacttgaggtaaagctcagaaattcccttcttaacaaagagcctactatataaaaagggccttcctttccaaaaaacacacaaacctgtccttttcattttccttcttgtagaggagaaaatggttgtacttaaccatcctgcttgtaaagtttattcagaggatagtctgtatgtccagccaccatgtttacttctcaaagtgcaagtctgatgaatagtactgtatctccatatgtggtaatgtgagcatttcatcatgaagtacctgctgctatgtctgtgaagttgggtgtaacatcataagaatatgaaaccagtattggtgtaaatctaatgaaaataaccctatgtatatttgtagcagtcttgaatctctatttaaggtaatttgctgtaatataacaaatattcattctgtttttcatcccttccttgccagttttatatcaagcatgaattccaatggtttgacagcaaaattatctgtgaaagtttaaaaggcacttttctgctgtgatttttggattgagtgtggagtgttatgtacagtttgatgggatatatcattttagaaccccagatttaattctagtccaattaattttgtttaactacctcgttttcagtgctgttttgggtgcacaagtaaacactacctgtgaaacttgcttttttgccttgattctcagtattctttcagattataaatctggtctgcctcttttttcccagtgctagccaacagtttgagatgagagggatcatcactctcatctgtgtttaagtggagagccatgtgcttctgtgaaatatgctttggggatttgggggtggagagcagaagaataattgaaattggtggcaatataggatttaggtgtaggagttagttataaaataaacaaatggtaagaaagtacctgaattagacaatccagtgcctataactttgcattttttattagagatgcatttctcgtctgtgtgcctaaagggcaatgggttgaaattgctttaactaccacagcgaaatatttgacaaatccttcagcaatggcctatcattcaacatatattagcacagtgctaggtatttgcagtggtattttgttaccttaaaacggccaaatgcatttagttgaaatgtagttgatagtaagggttttatataactttatccaatctctaaagtttatggaagcattgactttcttctttgctgtcttttctgagtgatgaaaatgatgcattccttttttttccttgaaaactcagcaaatgtttgtaaccagatgttccttgtttcacatgtttactgtgtaacactacagcatatttaatattggtaaatactgtatttcagtcattatgcataagtacattcctgaggtatatttgccatcattttgggattcagttattttatcttctgtttgggtcagaaaaacttgaactatctgaggtggtatgcaggccattttctagaagattgttttttgaatctgtagtttatcaaggacttgttccccccctccctttgtttagaagaggaatcagaaaaggggggtggtgtgtagaaaaggcctttgatttgataggtgtaatttctaagattgaaattttaaaaatgcagatcgtaagatagtaacactcaaacttgataaaatcctttgaattgaaattagtatgaaatttttatggaaccaaatgccttcaggtcaccctggaaatagtctttgtatgtgaaagatcaacacaaacattggtcaggaaccctgacagccaatatatgaaggagcctgggatagtaactaggttacactaaagttattttcaactaagatagctagacgagtgtacaaaccaatagctcctattctggaaggttttctttttattaaaaaaaattcaaacaaggttaaaagtcaagcaagaagggaagagagaaactgggttctgagaaaaaaatgtgccagtataaaataaactcctaaatgcgtgcttgtcatcctctagtttttttttaagttgaatttcttttccactgtaacttaagatttgagattgaggtttgcggtccagaacataccctcagcagatacagtgactaactggaaagtgcagttgttcaaggtctgtcatgctcaatcacctaaagctataatttgtttgatatattaagcatgtagacctagtgcagcatgggagccactcaggaagtttatgcaattaataaactttcagcataatttactatgaagtatgcagaatttcaccctcttctccacacttaacatttagttgtatatgtgaactctcctttcttaattggggaatgtagcattatatagaatgttgttaaagttaattttaatcctttttgacattaacctttttttttttttggtaaaccaagtgatctgcctttcagcaactgtcttattttggttctttgaaactgtgatttttatttcatttgtacccaaccattgtaagtattttgttttgtttcctggaaattctgttttgaaacagaaaataaaggctgtgttaaatgag

SEQ ID NO: 2389 - DNA, 2415 bp, Homo sapiens
caaatggagtattttattcacatgttagttatcattttaacacacacacaaacactgacacactctggtttgcgtggaacaagggtggtctaaatatcctaaaagaaaatgaaaaattaaagtacattaatttttcattactgtaggcaattacgtccacatcacttacaaagctattactgatattgtccaaggaagcagagtggtacagaggaaggaaacttgagggtaaattcatcagtgacataacagatctcaacatgagaaagctgacaaaacatgaatttttgctgtgaaatttctctttgcaaaatatgaagaaaagtcaatcaatgggcagtaaataagagtaggtggtgaacttttgctgtcaattctcctcacagtatcttgcagaggcatcaagaaaattgcttagtccttctctgggaccaatttcagaacttttccaattgcaatggtcttaccctcatctcttaaagtaaaacgacccatctgaggaaaatctttgaacgtctcgaggcagatggttcctgctgtccttaaacgagcaatgcatacttgatcttgtttcacgaagcggggtcgtgtcttacttttttctcctgattttttgtctaccaaggagattaacgctgttatctcaacttcctcaatacaagtatgaatgtgcagcaccgcattataacctgggcagatgatggatttgtgctcaataatcactatctgaacatcaaacgtgcgtccagaatggcagaggttactaggatcacaaagtatgaatcctggaagaatctcttcttcttcaattcccttcagtctgattttgaggttttcacctggggctacaaaatcagtttcagtatcatcagaaagtattccaagaacttctacattgtgcttgtttggcatcatcacgagctgctggcctttaaaaatggacccggattccagctttcccaggaccacagtgcccatatctttgtacttatccacaattggcagtcttattggtccatcaattgatctgttgaagtttggcaagttatccaaatacggaataaatggtaatccagtgtaccaagggcagaaatctgactgctctttaatatttgctccggtcagtcctgagcagggcataaagtgaatgtccttttttggactgaagcctacttttttcaaaaagggcaccagtttttctttacattcttcatatctctcgatgctccaatttactgtgggatcatccatcttattaataagcactattaaatgttttacccctgccgtttttgccaacatcgcatgttctcttgtctgtccacctttttcaaatccagtttcaaactctcctttcctggcagagatgaccagcacagccaaatcagcttgagaagcaccaccaatcatatttgggacaaaactcttgtggccaggggcatctaaaattgtgaaatgtttcctttctgtttcaaaataggcacgacccacttcgactgttttacccttgtctcgttcctcctgatttgtatctaaggcccaggacaaataccaggtttctctgtttttttccttagcttctctttcatatttctccagtgttcttttgttaggtgcacctgagggtacgatcacagatttggattttcttatttcctctttttcctccatcatttcctggccactttcttctgggggccctgaatctcccgaggaaccacccccaggctcggcttcacttacttctttactgtgctcccatgattcttctagggccatttccacctctccattttctacaacaggttctgaaagttccatggtaacggctgaattggaaccttcaagcgacactaacggttcctctcgggaaggttccacaggtgccccccgtcccatccttttaccttgagggtatcccgcgccggtgcaggtttcatcgttgctgccggagccggccgggagggtgggcggctgagtcgggccccgcaggaaggacggcacgaactccgcggcgtgtacgttaggcacgaagggcttggcgttgacgttgagcttacggctgaaagccgagctgaggggctcgcgctgggcctcggccaccgcagaggagactccatccccgctcggggccgaccccggggattccatgtccacctggtcccagcaatcgggcgccgagtcgctgctgctgctgcccgaatccatggtctcggaacttgctgtgtggcagtgagggagcgggctcaacaggccagaagagcgggctccgccggcggggttaaggcagcaagagcgaagggccaaggggtagcgacacgaaccttagctgcaccgcggaggcagctaagcgccgatgctgcattcgcaactgcggcggcagcagcagatatggcggctcaacactctcctctt

SEQ ID NO: 2390 - DNA, 4379 bp, Homo sapiens
gccaccctcgaacgggcaaaagaaagaaagaggcaggcattcctcaggccttatctctctggttctttctgctacatttgacaccttgggatgactctcaccttctggaatctctctactaccttggtttcagaagagtgaaccctctggattatcacatgaagctacttcctgtgagcagcccagggatggccagtcacttgtgacctactttcagagctggcagttctgacttctagaacaaactcggaacaagcccatctacagctggttgactgagtttcctttgggctcctggcaccagaaagaattgctcactggaaggatcataggtggcactcatgtctcactgccccactcagggaactctccaggagatcctcagtgtcatcagaagctgaaaaaaacagtgctgagaaacgtggcctgccgtctttccagctaagggagatggcccattcgaccctgggttgtcctctgcaaacgcgctgctgcaggttgcatggcaccatctcctgattgcaatttgctttcctgagggagtgaactgactgaaattggatggtaataagttgctaggttattttccactttttagtttatgaggcttattcattttgctttaacattaaccactgccttccttttaaggagctggtgaggcagcgcatggcaacaggttcagggtgaggagtggcaccacctcctttcagtgaggatttgggaagggtgaaaagcaccctaatcttctcagccgcatgtgaacaaaccacctgtcaaggtgggtccttcctatagggaggttgatgtcagcccttcagggaggtctcagttttcttcctccacttcctaatcccttcattataattccttccacaacagaataagtttcttgagcaatgcagcaatatccagcaattttagatagacatttaccttttgacctagaaatctcacttctacgaatccatcctaaagacacactttcagctggatgtggtcgctcatgcctgcgatcctaacactctgggaggctaaagtggaagaatctcttgggctcaggagctcaagaccagcctgggcaacataggaagaccctatctctaaaaaaaataaaaataaaaacggcacacagtcaaaaattcaaaaattaatatacataaggctatttattacagaaacattggtagtagcaaaagactggaaataactcaatgcccatcaatagggaacggagtaaataaactaagatacctacacataatggagtgccatgcagctttgaaaggaaatgaggcatatttctatgttatatgttgtgatcaccagaatataacctaatgagtaaaaagccaggtgaagaaaattctgataatatgctatcattggagaggggaatatgaatataccatacatcacataggaggagagaggaaataaagtgagaggattgggatagaagctagacttttctaaatatatcttgttttatagatttatgttggaagtttgtggatatagtactttagaaaagtataaaaccaaattagacttgacaaaatgaaacaagtcaatctgttgagttgatggtgtaactacacagtgagaaactattgcaaatgaccttaacactcaggaattccactgtatattcctaatgggagatcccctaatgaccaaacttaaacccagtccaaccaaaccaaaaaaccttgtaaaatatctgaaaccatttttagtaatgaaatgagaaatgtggtcgtgttggtgatatggtttggctgtgtccccaccccgacatcatcttgaattgtaactcccacaattcccacatgtcatgagaggaacccagtgggaggtgattgaattatgggtgtgggtctttcctgcgctgttcccatgatagtgaatgacaagatctgatgattttaaaaacggtttccccgcacaacctccctctcttgcctgccaccatctatgtaagatgtgacttgttcctccttgccttccgctgtgatcgtgaggcctccccagccatgtggaactgtaagtccattaaacctctttttcttcccagtctcgggtatgtcttcatcagcagcatgaaaataaactcatacagtaaattggtaccaataaagtggggtgctgctgaaaagatacccaaaaatgtggaagcgactttggaactgggttatcaggcagaggctggaacagtttggagggctcagaagaagacaggaaaatgtgggaaagtttggaacttcctagagacttgttgaatggctttgacaaaaatgctgatagtgatatgaacaataaggtccaggctgaggtggtctcagatggagatgaggaacttgttgggaactggaacaaaggtgacccttgttatgttttagcaaagagactggtggcattttgctcctgccttagagatttgcagaactttgaacttgagagagatgatttagagtatctggtggaagaaatgtctaagcaacaaagtattcaagaggtgacttgggcgttcttaaacacattcagttttataagggaagcagagcataaaagttcagaaacttgcagcctgacaatgtaatagaaaagaaaattctattttctgaggagaaattcaagctggctgcagaaatttgcataagaaatggggacccaaatattaatctccaagacaatggggaaaatgtctccagggcatttcagaggtcttcatggcagcccctcccatcacgggaccagaggcctaggaggaaaaaaatggtttcttgggccaggcccagggtctccgtgctgtgtgcagcctagggacttggtgccctgcatcccagctactccagccatgattaaaagggcccaaggtacagctcgggccgtggctgcagagggtgcaagcctcaagccttggaagcttctatgtggaattcaacctgtgggtgcacagaagtcaagaactgaggcttgggaacctctgcctagatttcagaggatgtatggaaacgcctggatatccaggaagtttgctgcagggacagggccctcatggagaacctctgctgggacagtgtggaaaggaaatgtggagttggagtccccacacagagtcccaactggggcaccacctagtggagctgtgagaagagggccactgtcctccagaccccagaatggtagatccaccgacagcttgcacatgtgcctggaaaatcggcagacactcaacaccagcccatgaaagcagccagaagggagggtgtaccctgcaaagccacaggggctgagctgcccaagaccatgggaacccacttcttgcatcagcgtgacccggatgcgagacatggagtcaaaggagatcattttggagatttaagacttaactgccctgctggatttctgatttgtatggggaccagagcgcctttgttttggccaatttctcccatttggaatggctgtatttacccgatacctgtacccccattgtatctgggaagtaactaacttgcttttgatcttacaagctcctaggcgaaaggaatgtgccttgtctcagatgagactttggactgtggacttttgagttaatgctgaaatgagttaagactttgggagactgttgggaaggcatgactggttttgaaacgtgagaacatgagatttgggaggggccagaggcgggatgatatggtttggctgtgtccccaccgaaatctcattttgaattgtaactcccacaactcctgtgtgtcattggaggaacccagtgggaggtgatcgaattatgggggcaggtctttcctgtgcggttctcatgatggtaaatgagtctcacaagagctgatcgttttaaaagtgggagtttccctgtacaagctgtctctcttgcctgctgccattcatgtaagatgtgacttactcctccttgccttccacaatgattgtgaggccgtcccagccatgtgggactgtaagttcattaaacctttttttctttccagtcttgcatatgtctttatcagcagcatgaaaatggactaatacagttggtaagactgttttgcatgtattataggataaagcaatgagtaattatgttgttttgaaaagtgggatgttttacatcccaggtatggatataagatcaataaagttaagtagaaacactttagtcttacctaaatttgaaatagaactattagtaagaatccataaagtatttgcttgtaaaaaattctttctagaaaccatcatcaattcaaaagcaagcatttcttgcacacagaatatgatctctaaatgccatttactaaaagaaagcagggctccttagaaaaatggctgattccagatctgggctcctg

SEQ ID NO: 2391 - DNA, 4703 bp, Homo sapiens
cgcccatgggcccctgtgatggtcatggcctcaagaatcacagtccaggttacattagttatacactctggaggtgacttgacctgtcattgtgaacaattattgctcttggacgacccaggacataggccagccagtacgtaccccagtgtgttggagaatcgcgctcggcttcttcctctgtgctgagtcatgaaagttgccggagcaggtgcagttacacaacctccaggtatgatcctgtttaaggactggatttaggataactacttagaggttaaaagtcacaagggtgtatggatgaggctggagtgatctgggaccaaagacatctaggcttgctgtcaaggcttctgatcaacatgagatgaccgccgtgtggtaaactgatgaaccctgaccctgatcaacatgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatgaacgtgagatgaccgccgtgtggtaaactgatgaaccccgaccctgatcaacgtgagatgaccgccgtgtggtaaactgatgaaccccgaccctgatgaacatgagatgaccgccgtgtggtaaactgatgaaccccgaccctgatcaacatgagatgaccgccgtgtggtaaactgatgaaccccgaccctgatcaacatgagatgactgccgtgtggtaaactgatgaaccctgacccattaggctttggctacagaatgtggaaataagttgtgttactacatgtgtgtaatcctagggtgcaggacaccggccgggaggttccatagagtgatgggttctgcaggtaactcatcctctagtcctctgtaagctcctagaaggaagaaattatgtcctttagactaataaaattcctccaaaccaaatacagcacctactgtgaagacacaaagatacttttagaatagtaaaaactttatccattgagaaattccttaatgaaacagtatccaagaagtcatttgccagcagatttcttagaggtgcgataaagaagaggacattgccagtcgtcacagcagctgcaatagctcctctctattgttaaacagtgggatatcttgtgcaggttttcagttgacaatcaattttaaagattagtttcggtccccatcaatcaattatttattaacccatcaataaaaatttaaatgctctgtgaggtacaatagctattaaaagagacagaggcactttctgtgtccagaggggcttttagtctgctctggaaagcaagatgcgtgcagatgagtgacgcagtgcatcgtgtggatgcaaagggagggactcacatgggaaccagaggagctacgaagggaggcagtggggactggtgggtcgagacctggaaataacacatgaataggcaacaaaggtttcctttcctcttccatgcacttcagtccttgaaaaacgtcttaccacggaattccacagcgtaccaagcgattccacagcttgatggcacactctcctttctcagcattcttgaaaatggcgtgtgagccaagccatcttactgagaaattaccttaaaccatttgatgaaccaaaaatattttgtaatacccatctccgacattaggtaggcaaatcacacagaaacaccgaggtcttctgagtcatatttatctgaaaaatcacagcttgggtgcatgtgaagccagaggagcactcctggggcctgcggtgccatcactcagctcccctgggcttcacatggccatggagcacccagcaagtgtaggctctgagccttcagggaggggcggcatcagccagcaccatcgtctcctgggtcttgtgcctcttccttggttgcggtgttgtcagggccagaattgggcaattccgggtgacatccaggtgtggctgctgacacggagcacaggtgaggttcactgaggtaagtgggccatggccttgggcttctagttcagagcacaccatccactcagcatgtgaacccagctccaaagcgtatgtgtgcatgtgtgtacctgtgcacattgcgcatgtctctgtgtatgcatgtgctttgatgcatgttgatgtacgggtgtatctgtgtattgtgtatgcacacacgagcatatgtgtacatgaatttgtattgcacatgtgtttaatgcgaacacgtgtcatgtgtatgtgttcacatgcatgtgtgtctgtgtactgtgtgcaacagtgtgtgcaagtgtgtatatgtgggtttatgtttgtacagtgtgtgtagtgtgtgtacacatatacacctgtgtgcatgtgtacatggtatttaagcatgtttgcacgtgtgtttgtgcttgcatgtgctgcgtgtttgtgttggtgggatgtggggaggctgctgtggagacaaaagctggagagaacttggtagagtaacccaggtcaggaaatggcacctgcaaaggaaggctggagtgcctgggattcacgttgaaatggccaatccgtcagctgggctggacacagccatcacgctgggcagctgtgaggttaaaacagaaagtctgggctgtggggaggctgagaattgagatgcatgtatgagatgagtcacgagggccaagtggtgtgtgtgagaaagcaggcacagcaccactaaacactaaggagatttcaggggagttacgggtggagggaggacatcagatctaccctggaagttaaacgtgtttcgagtgcattaaatactatgggccacagacgccttgtctccatatctactcttttataaatgaagtaaagttcttgggaaatacttttctcactctaaagctcacaatctatcttgcaaaaaatattttaaattccatctcaaataagccagggtgaaaagggagcctgtgcaccagacactgccagccttgcctggctctcgccttcttgctcttccttccccacctgctggggattttcttaacgatggagatgggtttgggtttgtcctgctgtgctctgctccccattcccggatccaaggtcctgcctctgtcctgtcccctgagccacctcagggatgcagggtcccccacctggtcaagtgcccagtgctgtgttgtcatttgcaagttcttcctgtgactgaactccaaatggcactgggactgctgactccacccactggacaacccgtgttcttgcttttggggtttctgaaacagccccaagactctgggcatcttgattttgctcccattgcttctcaggacaccctgctcctgtggtttgcagccccggccttctcttcgaggacgcctctgctcttctgcctcacactcggattggaccttcttcagcacagccagtggccgaggcttcctccctggggctcagtggagcaggacagatgctgcatccaaactcttccattgggttccagtctgttccagtcatgcccttgagcctctaaagctcctaggtgagagacgtagcagctgacagcacttcccacttgatttgggtggactccagcctccccagcaacaataagagatcaaaagcatcgttgaggaagcagcttgctgaaacgctgagtgcccgccactctcaggtcaggtgggaccggcaggccagcatgagttcctgaacacttggttctcaatactggccacagccacactgtaaggggaaacaagagggcactgtatgcaaacatctcttgaactctggagtctgctcaccttcctgcctcaagcccctctcccacgtggtccagtcaccattctccacagagactaccctaaaacccagcgactctcgtgtgcctgcagaatggcacagcccgttctcatagcagcactcctgtttaatcagagggatgttaacgaccaagtcatatttgctcgatttgtgttcaacatatttcatttgtaccgataaaacttaaaaatatccccacacatgcattgcctattaaagagtatcttccaggtacacctcccttacacatcagttaacttgataatttcttcccattcttgtgcaataaatttccttcctgatcagctctgtccagcagcaacaataatccacgtagagacatgcaaactaaaagtccgttagtggaggcacgaagctgatgaggcttggaaaaaaatgaccgatttgattaaaattaggacccatgggagtggagctctgcctattttagaggcaaagtaaatgcctgggagtccaatcaccgacattctgtttgaggtttctaatcacaaggaagatggagaaaatgcagaacaagtggtcaagaacagggagataataaatagaatatttatgggctgaggaaaacaattaccaggggaaagcccaagaagcaaagatgaacagagaacgtgctgactgcgctcgtttggaaaggcctcatggccaaaggaggagaggcattatgaggagcagtgaccgagtgggcaggacccccggggatcaggaaaggtgcacggggggaaatgagaggcctgagcggcttcccagcgaaggtttttgaagcacggtttgattttctctctccccctcaccatccccaa

SEQ ID NO: 2392 - DNA, 923 bp, Homo sapiens
cggcgatccggggtctgggcgcggcgaggtctggtgtggcagatgtggatagctggaccctcctgggtgcctctgcgttatgtcgtttggttgatgcatttggagagaatctgtgctctccacaactgcaggggcaacatgctttcctggcctcttcagatcagggtggctgttcttgggtgctgcaccaaaactccagcagtgggctttcttcaagtggccggctcacctcattcctgccaagacccaggtccgtgttctcacagtgctgccatctttcctccgtgtgagcgtgggctgtgcggagagtggacctcggtgtgtgcggggctgcgtgcactgccatcgctccctctacacgagccggcgtggacccagggctgagctgtgaccacgagggccatcccgacgagccgccatggacccagggctgagctgtgaccatgagggctatcccgacgagctgccgtggacccagggctgagccgtgaccatgagggccatcccgaaactgtgattgttttctgaatgtggaagcgtcggccgagcgcggtccttggagaacccttgctgcggagaatgacgctcactctgcggcctggcctcgcctccccatcccttctgcaaactcacaggacaggattgatggggagagcccaggcgaaacgaagctgaccctagtgaccagccctactggcggctctggaacaggcccgggaccggtggcctggagacagtggtcctttctggatgggctgcagtctccgaaggcttcccccactggagtcagccctttaggagtttgtccagtgcctccagaaagctgttttttgggggacggaggacttggcctggaattctggaattcccagggggtcagacatggttatgggaagtttaataaaaccggtgaatcacgtgaa

SEQ ID NO: 2393 - DNA, 4939 bp, Homo sapiens
aaatgaagttaaatctctggattgaagataaactgaagaataatgaaccacattccatgcaagagatttgtgactatgcaagaggaattttcagagacatgtctttagacactgaaatgaatccagaaaaaaatttgttgggagtaagggatggtttgaggaatttagggtgtaccataatgtggagaccaggtcttatttgacagttatgccaaagaacaaacagttcctgcagctctcatgttgtattcaccacaaattcaggaagtggctgaagaaggggattacatgcctgcacaaatctttagtgctatcgagagtgtcaagctttgaaaccctttgaatacttctgaagagcaagcgcccactgatgctgaggtcaacaaaatcagagaagctgacatttccattttttgccaatacttcaggtgacctcataatgaaacccttgctgctctacagaaaattgtgcccaaaccctctcaggggaaataaatgagccaagtttccagtgtactagcaagcaaacagaaaagcccagatgaatcttcctctccttaagggatggtttgaacagtactttcttgtggatgttcaagactacttaaaagaaaaaaaaataccttgaattcaaagtcctgctgattcttcagtctatttggtgcttcaggtacatttgccaatatgcatcctcatggtaaggttgtctttataactagccacatgtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgtctccagaggttattatcataagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaaatttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgtgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgataa

SEQ ID NO: 2394 - DNA, 1336 bp, Homo sapiens
acctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggcttacaggcatgagacaccgcgcccggcttatatatcattactttcttggctgagagctgtagtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaagtgtcaaccttcaattatatacctttttgtcactgaattaacacttatttctcacgacgtggaagcagtttcagtatggtttgtactaagctaagtgatagttgtcatctgtatgacaatttagaatgttttctgtgtccatttgtgatcaaaattatatgttgctttgtgtgataaaacctggtggtggtagtaactttgaacacactttttgaacttaattttgtagttaatcttatcctgatgagtaattctaaaacttatgaccactactagaaatgaagcagttttttgtgtgtgtgtgccatcacagtatatactgaccttggagctttcctagtgctctcagagccatgaaaatatcctttcacacaaattttctcaacttacccgtaacatcgctttgagtttcagtcatacctagagttggaaagtcgtcaaattagtcctctgtcctcaagtatctgtaagtctgaagaatttaggtaagttacttaccttaaaatcattgccaatcctttaaactctatttggatggctgtgaaatattttaacattagggttaatgtcataaatcccattctttttttttttttgagaccgagttttgctctgtcatccaggctggagttcagtggtgtgattttggctcactgcaacctccgcctcctgggttcaagggattctgc

SEQ ID NO: 2395 - DNA, 225 bp, Homo sapiens
atgagcaaagctcaccctcccgagctgaaaaaatttatggacaagaagttatcattgaaattaaatggtggcagacatgtccaaggaatattgcggggatttgatccctttatgaaccttgtgatagatgaatgtgtggaaatggcgactagtggacaacagaacaatattggaatggtggtaatatgaggaaatagtatcatcatgttagaagccttggaatga

SEQ ID NO: 2396 - DNA, 694 bp, Homo sapiens
ccttcattcaggtttctatttttattcaactacaagcaaacagcacaattaatgcaacattcagcaactccagaccagcttttcttacccccatgaagaacgatcaatttaaaaaacacagatctcaggtttcctcccaagctgtcagcgagcgctgctaccggtctagattgccatgtcccaacaacagcaaagccaccctccctcctgcttcttccaggattgctctttaaagggaccagagtgacatactgatgcctactgaggcatctgagatgcactgtgttggaggttagcctcaatgccagcctctggttgtctaggtgagtgacatcaccataaaatcacattgtgtaccagttcaggtccccaagctaaccccctacttcccagacagctgctcgtacagtttgggcacatagtcatcccactcggcctggtaacacgtgccagccaccggggccctgagctcatactttttacggaaggacgccaccttgaatttgccacggtggtctccagatcggttgctgaggatgggctcgtcacactttagcggcctgtcctgctcgtaaaccagccagacatagcggtggaggcctgtggggagaggcagagggaagatgtacacacagcccagcacttgagatggggacatcatccatttttatcgaatgtttcaacatggaggcac

SEQ ID NO: 2397 - DNA, 469 bp, Homo sapiens
ggcctcgctatgtctgccattttcaatattcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgaagtatgctgtatagtaatggccttcagcatcctcttcatacagtagctggggaaaatgccagaatttaattgccatcagatttcattgtgaacaaggacttactgcagaaaataatggaaaggatgtttaactcttttatctccgaacattgaatgagataaatttccagatgctgttctctattttaatgttattggaccaatattctgtataaataattaagatgtaaccatttaatagtctgtaacaatgaacctcagtactgtcactacaatattacattctg

SEQ ID NO: 2398 - DNA, 5904 bp, Homo sapiens
gacactattacagatagaatgaccacaaccatattaacaaaccaaaaacctgtgcacagaaacaagatgaagaaaatatatcaagatgttaaccacactctttggatggtgaaaacatgggtgagtttctcttctacatttctgtaacttcaaagtttctataatgaacacatttcatatataatggaaatatatgtagtaaaggtggactaccaaaacactagaatgatgacctttcaaggaaaccgaaacaaaataaccataatcccacaacaaccacacaactatttcttgtttttcatctttcttcccatctttgacatttatgcatacttatcactaacaccctaataatcacagactagtgcacagatcaagatgttaacagttaattgttgttgggtgttgggaatatgtgtgaattttctttactgaatttccaaagttttgtatgagtatgtattatatttgtaatggaaaatacatacataaaatttattaccaaaacaccaaagattatttaaggaatttgagacaaaatatttaaccaaattcccacaatgacaacactattttagttattttccacatcttttcatttaagactttatgcacacatatttaacactgttatcacaagcgtgtgcactgaaacaagatagaggaaacagatcaagatgttagcagtagttgttaggtgttgggaatataggtaattttttaaaataatttactttattttctaatttttcctctgggtatgtattatgcacaccaatggagacacacataatacactgttatcaggacattattatagggaacatttgaaaaaattaaagtgaaagtatttaaccataattccacaaaggtaatgtaacagctattttgaatatacattttgacacagttataatcataaacctgtgcacagaaacaagaatgaacaagataagaggagagtatatgtctttggatggtggggatatgattttttttcctccacttttctgtattttccaagtgtgtgataatgagttcaaattatgttcacaatgaaaatgtgatcataaactttttagtaacactaccataaagaacattcaagaaatttaagaaaataatgctcaactataagcctacaacaacaacaccacaacagcttttgactataagcatatatatttttaaacagttataatgaactgtttaaatgaactgttaaatgaacagcatataaatgaactgttgagttataactgtagtataaatatactttcgtgtcctgctttctccacttaatgttctgtaaatatatttccacgttgctacataactcgtgattatcatttttaaacagttgcattaagtgtccacagataggtttaaacaatcattctcttgtttaccatttgttactaccttttcactagctgaaggttggaacggacaccctgacttacagcaagttgctttctgaaaaggggctaccactgccaacaatgttaacaccaagtaatgtacccacaaagttcaccccgacatcaacactgattctcgtttcaagagtccttttcccatgtagtaaacctcactgcccctcagctttcccgatgtccgttccaacctcagtccttcctatgcagccagccctcacctacaccataccatcaaaaactccttttccaaactgctcaggacaccccgctcaattcattctcagaaacctggccttctacagttcttgcctctggtgttttcttctgtctgtctcctctcccctcctagatctggtgatatattaggactcccttctttgactcactcatttctgcttcttgctctcagctctacaatcttcctaaactttgacactccctgcatctttgacatacttccaagccctaatcctgcagatccagaagagtaagattcagacacatttcccccagtgggtactttaattttgcttgttcaaatgatctacacttacattttgcaaatctttttttttaaattttttaaattttatattttttttccagccaactcaaggccaaaaaaaatttcttaatatagttattatgcgaggggaggggaagcaaaggagcacaggtagtccacagaataggacacaagaaacctcaagctgtgaggtcaatttgtaattaaaagaatactaagattagatgaacacaacactcagaaatactctaggagagctgaaaaagaaggaacagatgttaacaaaacaaattaaggctgctggggaacctgagtccatgttaagcttgggttgactgtaaagaatttttttttttttaatgcaagttagacatggagttagagggtcagataaataacgaagagaattaagttagcgatagaaagatctaaggatactagctcctgggcacctagggtgcaaactgacttgtggcagcataagctgatgctgcacaggggacccaagccatgttgctacttgtcacttaaggcaggaagcgcacaaaggaagtgatggttgtaacccattctttaaaggcaaagatgtaagatttacagggaaaagcttcgggttttatcaattcactatcatcaaacacatattgagttggttaaaaaaaaaaaaaacccagaacacaaatgtgtaatatttttgcatgagaaccacttcaacaaacataacatgtggcaaccaatcaatctgggtcacaaaaagccaatccgtatattgtaaagccttacacagtattaggttccaaagtgttggcgcagatgaaatggctgcagaaagaagctaaagtacttatcttttcaaacagtaaggagtaaaagccatgttatctatcatgcctacagcttcacaagactatttaagggtaagaaacaaaacaattactcaaaaagatattgacagggttcaaataatgcacaataaatctttctcaggatctaagacacttaaaaatataatcaaatttgttgctctcttcctcctccaaaaaaaaaaaaaattcaaagaataccaggtaaggtacctctgcagagtaaactgtaactgtatatcatataaatccaaatatatgtgatcactgttctgtcataatttgctattttatatacacctcatgaaacactatatatacgttacacaagtgtcatttacagttgatttgggcaaactctgtagtctggaatactcatagggttttctcaatctgattacttggaaaggtaagatgtgtgctatggctttcccacatgcagacactgacatctgaaggggaaagcttaagactgtggaatctgcacattcggtctcttttcaatctgagtttagagatgttaagtcaggtgtgtaacacactaaggttaagtctcctactgacattatcatggattggtttggattctctgtggtttggtaagggtcaagtcctaggtgaaggttttctaacctttaccccatgccctcagccagtgtgggtattctggtgtctggcgagggacaggcggtcattgaagagctgcccacagacgtcacatttgaagtacttctcatcagcttgattggcaccacctgtgctggtgctggcacgttcgatgtagcctgagcactccccaaaggcatttgcaggctcaaatatgatcatgctggcatgagttttcaggtgttcactgaatgctgtgctggaagtgaaggtttctgtgcattcatggcagtcatagtatggttcttctacctgaatctcttgatcttcaccttcttctgggtcttcaattcccacaccgtcaggctcgtcggcatctccctctggctcttcagcttttccctctggctcttcagctctttcttctgggtcttcaatacctgcaccatctggctcatcagcatccccatttggctgctcggcctctccatttggctgtccagcctctccaatgggctctgcagcctctccatctggcccttcagcctctccgtttggctcagcagcctccacttctggctcagcagcctccacttctggctcggcagcctccacttctggctcagcagcctctacgtttaagccctgaatcctcagaactacttgtggaacatggacattggcttcaacttcctgggctgctgctgctgcagctgctgctgcttcatcttcttcttcttcttccagatgaagctccttatgtttagtgaggactgtgctatgaataaaggacttaccacaatccttgcattcatagaatggtatagctcctttgaggggctcagtaagaaatgaggtgtgagtataggaggacccgtactcatagggctcattcttatgaacagttacgtgatctgcaagttctgctgggttgacgaaagattctccacagactgcacattcaaagagtctctcttcggtctgacttctctgaaactcagtgagggctaagcctggaatgatagcttcctcagccatctggctctgctccagtaaatcatcttccctatgaagtctcatatgctcattaagggcagagctatgaatgaagccttgtccacacaaaaggcatcgaatggccgacccagcaagagcaggattcctctctgcagcacgattcctccgtggcttcatgggcaagagggcaataaaaccatcatcacaccccttcatggaatacaactggtcttgttcatggattctctgatgctcgaaaaggaatgagctatgaataaaagattccccacactttggacattcatacagctgctctccagtgtaatctctctgatactcgctgatggaatgggtgtgaattacagaatgtgtgtactcccgactgtcaaccaggcacttcctgctgtggactttctgatggtctgtgaggtctgtgagatccacaaagcccaggccacagtcctcacattcatagattttgtcatcagggtcatccttctgagggtcttccatgtctgagccttgaatgacagggtcttcaattgtctcctgaccatgggtctcctcgctgtgggtctcctccccatcagtattctcgccttgagactcctcgccatgagacttctcttggtcatagattttctggtttgtgttgaggtcttcgctggtagcaaaaaattgtctgaagtccttacatttgttccgcgcttgctctttagcatactgctcttgggcgtaacttgtttgagggtcagtaggggccaagctgcgaatgacagaccattcatagtttctgcttccagagggcttctccctatcatgaatcttctggtgctcagtgaggtcagagctatgagcaaagcactccccacactcctgacattcatagagcatccctcgagggcgaaatgtttgttcaccaaaaggcagagagtgaattacagaggtctcattgctcctatgctcaatgtatttctttttagcacgagccttctggtattcacggacatttgagctgggaacagagaattcgccatccttcttaaactcaccagatccctctccaggaacacttttctgaggtttggcacggaatacactctgtatgacagagtcttcatagttgcgattcttactgcccccttcacaagggttctctctggcaggaatcttctgtcgcttatcattaaggtctgagatataaatggaggattctcccttctcattagattccaccaattcatttccattgtgacttcttggaggtttggaagccactaagctatggataacagacctactgtattcccttccttcagaggtgttccctccagcacgaactctctgatggttgatagcatcgaagctctgaatggtagactctgccattacttttggtttactgggccctgctacactgtgacttttctgagcttccacagaggctaagcta

SEQ ID NO: 2399 - DNA, 2242 bp, Homo sapiens
ttggagatgctttgtaattagtatattaaggagacaatacatttcaagaattgcttaaattctgatacccagatttaagcatgtgaacatatgagacttttaaacatacaattaaagctattcatcataatttgctatactaccaacataactttggagcgaaagtcaaatggtttaaagtaatcctgtaacatacctaaagaacaccttcctatattacgcatgcaaattctccacgtaaaggtcttttcactttaatttctgttacccagctctgaagtcactacttgggcttatcatggtccacagacaaggaggggagcaaatgaccaggactggtcaagattatatatatatatgtatatatatatgaatggcacagcagaaggaaacacaattctggaagtgcaagccttcaagaagcagcatattatgataaacccctcctacagaaaggtatcatttttatcactgataccacaggataaattatatattacgccatcttcaagtaacagctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacatagctgaagtcaattacaaggtttggcctagaaatgctaggggaacttctttgtagtttttacaggtattaaacttcatcttgcacactgaagtcatcatacatacagggcaaaatcagagcttttatatttgcgtttattcttcatttaactttttaaaacactactatagtttattaaaacaaaaacaagagcaagtagtgagcatattatgattacagtccttcactcattcactactgcacattaaatgccagcagtgagtgttattcactggcccattaagaggtctgacactgaacaccacctctgggatgatgttcatcatcctcatatgcttctccattgtagtggcgccgtctttcctgatttggatcaaagtccaccagttctacttggtccatctcatcagtctcttccacttccttcctctcgggtaggagtttttccagcaaagacagtttatcaggagagagaaagccattctcaggaaagtttaccttaaattcgatgattaggcgacccttttcatatggtctacgataaattggcatgccttcatttagtacacacttgatatctccatgcttgacaatctgacctggatgagaggtgatgacgatggttcggttgtcaagagtagatattggcttctggaagccacacagtgcttcaacgagctgtatgtccatacacatgaaaaggtcttctcctcgtcgagtaaaaacagcatggtccttctgatctaacacaatgataatatcgcctggctccagtcctggttcttggtctccttcaccatggaatgttatcttctggccatctttcatgcctttgtcaatatgaacttctaaaattttcttctctcgaactatcttccttccgttgcagcttttacatctatctttaggactgatccgctccccatggccctggcactccatgcacacagactgaatttgctgaaccattccaggtcctatctgatgaattcttatttgcattccagtacctcggcaattgggacagcactctactgctcctttcttacctcctctaccttcacatttgtcacaaatcacattcttttgcagagccagttttcttgttgcaccattatataagtcttctagggttactgagagctgatgtacaacatttttacctctcctttctctctgcatccttcctcctcctccaaaaaacatatcaaagatgtccatgggggagccaaaaccgccacctgctccaccctctttaattgcctgttctcctcctttgtcatataattcccttttctttgcatcagagagaacttcgtaagcttgagaaatctgtttaaacttctctccttcatttgggttcttatcaggatggtacttcaaagccagtttcctataagcctttttcaattcttcctgagtagcattgggtttgacccccaaaacatcgtagtaagttgtttctttcaccatcttctactgccggtgcgggctgaggccggtgtgtgagggagcgg

SEQ ID NO: 2400 - DNA, 913 bp, Homo sapiens
aacagcaccagcaccacgagcaggcagagcacgaaggcgaacaccgtgcgctgctccgcgtccaggcccgcgcccaccgggggccccgtcgacggcggcaggggctccggcgacagcgtccacgtcgcgctcatggctcacatcgccgcgcgccctgcggaggaggggacccgccccgggcgccggggatgaggctgcgccctccctcccgcgcctcctccgcttcgccccctcctgccgccgccgccgccgcctcccttaacgtgcccgaccccatcccccgcccgcgcctcggtccccgggctacgcccatgcccggcccgccggatcgccgccaccaccacgcggggacccaactctggccgtgcgcgcaggtgggggcgctgagagccgggaaacggagccgcgcccggcctgggccgcacacaacaggtgcgaaagcgcggccgcggcccgggcgcgcggcgtggggacggtccccgcggcccctgcccccgctccctttgttctcggcggcctgggaccccctcccccaccgcccccgccccggcgcgcccctcaccctggcttcgacccggacggggaccgaccgcccggcggccgcgctctctcagggacccgcgccggctgcgcgttcggcctctccccggcggcggcggcggcggcccgggctccggctcagcccaccccacccgcccctggagcggcggagaccgaggcagggtccagccctgggcaaggcgtccacccactgcggctgcagttcctcactcgaccttgaccgcctcccacagcagccgcctgctcccacccccaccatcgcctcggccactcccgcgccagagaagacacttcagactccgtagctgctcttctgcaattcggtgttttattctttccaaatctcaggctt

SEQ ID NO: 2401 - DNA, 2289 bp, Homo sapiens
atgctcgccagccccgcccggcccacattgcgcatgcttgccaaccacgccctgtccacaccacactgcgcatgctcgccggcccccgccccgcgcacggcgtcagcgtctagacgcaggtgcgttcccgtcgaggctcgcgcagcgggcgtttttggggatcgcctggcgggggtgttcgggagccgcgggctgaagcacgggggcgtgcaggcgcccaggcctcgtgtagtgagggccgagccccgcgccggcttcgctgtagtccgcagcccccggcggctttgtgggcgcagccacgctcctcagccgcccgcccacctgggcctgggccccggttgtttccctgcggtggctgtggtcgttcccgttccagggtctcgagcgcaccgccccttcgctgcgctgttagtcgagggcagttttctgggggatcccccgatccccccgcgccgctcaggcgtcttggctcgcggaagcgcaggcgccgactgcctggcgtcgtccgtgactcctggcccttctctgtggatccctttgcttctcgttgcgggttgtgtttcctgcttcgtgggcctggccgtttgcgtttggatgcaggcccgggtgagccctgcgtggcccgctggccttttcctgctccctaggtgactgagccgcgtgtgtgacacatcggagtgaattgaggcaacgcgttcctttccaggcttgcagcgggcggtgtcgttcacgctcctgagcagagccttccggtgctttactcgacgccacaaatagtgcagggttcctcccaggggctgtcgcgagctagaactcttccccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctcttactggcttcagccagatggggtctggttttctgttacttgcaacaggaaaaattggaatgatatctatgcatgctattaccgccttatggctgtggtgagattaaaacatgatactgtgggtgaactgcttagtacagtgcctgctattctttatgttggttttaaggtatttttcttgaactttaaagttctaagaaaaattaccgttttaaaattcctaccctctgttcacatgtttaaattttcatgatagtttttctgtctgcatgttttctattcaaaataaattggtcattcttcagttagccacgaa

SEQ ID NO: 2402 - DNA, 2292 bp, Homo sapiens
atgctcgccagccccgcccggcccacattgcgcatgcttgccaaccacgccctgtccacaccacactgcgcatgctcgccggcccccgccccgcgcacggcgtcagcgtctagacgcaggtgcgttcccgtcgaggctcgcgcagcgggcgtttttggggatcgcctggcgggggtgttcgggagccgcgggctgaagcacgggggcgtgcaggcgcccaggcctcgtgtagtgagggccgagccccgcgccggcttcgctgtagtccgcagcccccggcggctttgtgggcgcagccacgctcctcagccgcccgcccacctgggcctgggccccggttgtttccctgcggtggctgtggtcgttcccgttccagggtctcgagcgcaccgccccttcgctgcgctgttagtcgagggcagttttctgggggatcccccgatccccccgcgccgctcaggcgtcttggctcgcggaagcgcaggcgccgactgcctggcgtcgtccgtgactcctggcccttctctgtggatccctttgcttctcgttgcgggttgtgtttcctgcttcgtgggcctggccgtttgcgtttggatgcaggcccgggtgagccctgcgtggcccgctggccttttcctgctccctaggtgactgagccgcgtgtgtgacacatcggagtgaattgaggcaacgcgttcctttccaggcttgcagcgggcggtgtcgttcacgctcctgagcagagccttccggtgctttactcgacgccacaaatagtgcagggttcctcccaggggctgtcgcgagctagaactcttccccgcccctgtgagctcgggctgttcttcctcctccgcgtggctcactccagcctcggatgtttcctcgctgcacagacctgctcgggaagactcgagaaggccaccccaggactccagctctccccggaagggcttcccctcggattgcgtcttggcccctggaaccctccctctgtatcctctgctgttcctctcttggcctccatttgggttgtggcctggatactctggctcgctgcttcccttctcttaaggatcacagccctgcactgcctgtcgtccggtgcctggaaaccattgtattttttggtctgattttgtagttgtttgagaacttaagtctggtccctcacactccatgcccagaagcagaaatgagtaaagtttgttttatcttttcttaatatgacaattattgtgttggttcaacttatgttgtactttaattagaagaaatttggccgaaaatacaaggaaaatatacaaatgcaagtaattttttttaaacttccctgaaagcagggtctaaagaaattaccaaccaacttagactggatctagaagaaaaggaagggtctttgcagtcttaggactcttccgttccgcgacgtaggtgttaggataacagccataaatggttgtaagactttgggctcagataagtagacttaagttcaaattttgacttattttacaagtgtgtgatttttggcaagctcatcttcctaaaccatgagctccttatttgtaaaggggacattagccactctccagcaacagccctggtacttcttcagtcctgggatgggacgtatgattagcctaagcgaaccagaaaatccaggcccgtgaccagtgacttgatcagggctggcgatatatctaggtaggccaaccaggtggactcagtatttttgtgggtgctactggaaaatttatttaattctaactgaatgtagaaacagcaacagacatgaaatggcagttgtattgctgtcttatcatgaggtgagggcctgaagctatggtagccaccctgtgaaccttggaaggagggttctacaggaactggcagagctgagactgggacgcaacccatgtcctggtgacgtatttgagtcctgaggctggccctcctgttagtcttttctcttactggcttcagccagatggggtctggttttctgttacttgcaacaggaaaaattggaatgatatctatgcatgctattaccgccttatggctgtggtgagattaaaacatgatactgtgggtgaactgcttagtacagtgcctgctattctttatgttggttttaaggtatttttcttgaactttaaagttctaagaaaaattaccgttttaaaattcctaccctctgttcacatgtttaaattttcatgatagtttttctgtctgcatgttttctattcaaaataaattggtcattcttcagttagccacgaagaa

SEQ ID NO: 2403 - DNA, 2515 bp, Homo sapiens
gaactccgcctcatgcaggatgcccagggctcggaagcagtaaggaggatgctacagaaaggaactgcagaaagaaaaaaagccacatggttaacttttcccctggagggcaaaggggtccggctctcaaaaagaaaagccaggcacagatcccaacaccaagtgtaaggcagcacaaagtgggtctgaaaccccaggaccgggtcaaaggccttccgaaggcccgaggttcttgaggaggggaagctgatagggccctggtctttctgcaccagcgtggctctttaaaatacaaaacacccacaaagccaaaaaccctgaaacatgttctttagctaaccccttccctgcccagatgcctgcaattctgagaattcacttcagttttgccagatccaacccctaggcttgagggtggagagccaggcctcctcagggtcccttctaggctcccaggcccaccttaggctttaattgcattggctgtttcttatggtgttagtgaattttgcaaagaaagccctgagcattgcataaatgcttgggggcgtgtcatttaaatggaagttctccaatagtggctgaaggcagagtttactgttatccctccctcttgctggctttgctggagggcttttatcagagagattggaggtgggagagcacttttaaagcacaccccaccccctgcacccgagcggcacctaagcttcccagagaccatgaccttgtatgtggctggaggcctcaggcttagggagcagcctgaagcctttgctgtcaaccctcccaggaaagaagccgggcctcaggctgaggaaaaacagagtttcctctccagagggctcaatgagcagccaggtagtggcctcgggcagtcctcaccagggggacacctccctgctttgcattaactcatcagcaagctcatcgagagctaacgtgggcccagcagtcctgtgcttggaaatgatgccgtcacctccacactcctgctgttccagcctctgcaggtgaagctgcaaggtgagcagaggcaggcgtggggacacactcttcaaggactgcactgccccttctccctcctgagagctctgtgcactgggtttggggatgaggcgccagcctggtcaggggaggtgactgtggtccttctgaccagcttggatctttaaaataatcacaaaaaagctcagcctgagcaggtgggtgcaaggctcaggggcctgtgtttttcatcaatcagttttcttcctgcaagattcttagagctggatgttcacgggatcatggggcatggaggtggtcacgctcagacagtcatgcaccaccctcaatcccaggccctgcagagataggaagaatcccaaccagagggattcttccccaaacgttcccttgtggcccaagagtgagttccggcctgagtgctgttatgactgccggcgtctctccgactgcctctcgcctcagtttaaccatctataggttaggaacaaagaagggcttaggcagccatcgtttccccatttctgtcagagccaagggcttggaggcccagccccatccgggcaagggctgtccgctcctgcccaggcctcacctcctcgctgcagctggcaagattctttctagcagaacagaaacactggcccccaattccactctcccctcctgatgctaccgcagagggcagaaaggtgccctgtagcgtccaccatgtgtgtgtcctgagtttccagtgcaagtcatctggatttgcatttagctagggaaactcggccctcaaaccctctccctctctgcctgaatttgccaaaatgccaaccatccgggcaggtgtggatgccacagtccatccccattgcatttcacccccacatggacagaggcacacactcgcacacattcccagcacctttgactgctgggggatgcaggccagggtctgcctggagcctcagggttgggacttatctccaaaggagcccacaccccctcttccaggatgggcactggctggcagcacttttttccctcatcacatccctgacccctgcccagcccacatgcacatgctgtttcctgtctccagggccctagcctgtggatctcttcctcccatgcactcctagggtgaatgggctcagcaccaaacctggctgtgcccattccccacaaccccagcttggcctcctgtgggaaggagaaggcagacctgcccagaggagaggggcagtgttcccacccacctgctccagcacaggaaccagggaggaaagaagggagagggaggttccattcaccgttttctgggttagcgcttgattggatgtttcaagcaagggacaaggtgatggtggctgtaataggctcctcgtgggcaccgtcaccccagaaggcctgggcacccatgagaacctgtggccagcccttttcattggctgagttccctgctgttgtgcgtggtgccattttttttttaaacaacatatataaaaacaaaacaactggt

SEQ ID NO: 2404 - DNA, 6169 bp, Homo sapiens
gtccgactagcagcagccgctgctccccggtggttcagagccgcgcgagctgagcgtttcgcctacaaaagcatcttcggatcggtttcccaccgccgaatgttgcttgagccaatgtgactggctctaggaggaaataaatcacatctgtcaaaagagcctcgagtcgaaggataggagaaacctcgaatttggtgggtgctgaccaaggcaccatgcaaggggttaactttgctttagggggtgacctggctggctgctgcagttgccgttaacagccaccgaatggatgagactccagatccacctcctcctgcgttcctcaaaacaggaagatggagaactacggagagctacttcccagaggggccgatggcaagcactcccttcaaggaaactggggaagttgcccgattttgatcgtttccatccaaacacccaccagacaatatatacatacacatttctaaattaacagcattggcaaaaactgaaaatacttgtatttaaagttgatgacagtatgaaaacaagaaatccgtccgggcgcggtgggtcacgcctgtaaccccagcactgatcacaaggtcaggagttcgagactagcctggctaacatggtgaaacccccttctctacaaaaattggctgggcgtagtggcgcgtgcctgtattcccagctacttgggaggctgaggcaggagaatagcttgagcccgggaggtggaggttgccgtgagcagaaatggcaccactgcactccagcctgggcgacagagtaagactctgtccccgcccccctccacccaaaaaaagaaaaaaaaaaaaaggaatcttctatgttgttgagagggatgttaattagtacctttatggggcagtaatgtaacactaaaatttttcgatgatcgtgcaatattacttctgggaacttaccctacagaaatactataaaaagtaatatggacaaaaatcttcaccatataaattgggtaaatgtcttttggaaaacaaatcatggcctggccacacaatggtatgaaaagatgcccgtgtaaagtgaaaaaaagcatcttgtcaaacaatctgcatagtatgacacctttattgtgataaatgattctgtgaaggtatgtctggaagcacacaactaaactattaacagcagttacctctgggaaataggacagggatttcaggttttattttggccatagacacattattttgattctaaattcatcatttatttactaacttagcattactattgagtaccaaatatttgccagggaattgttctgggaatacagtaataattcagtttaaaaaaataaaatctttggagcttacattcaagtgggaaacaacatgcaaatataaacaacaaaggtaaaccatatagtatgtttaaaagtacaaaagagagccgggagtacaaaatacagcagggagatgagacaggaatgccccagtagctgcagctttagataagcctcagtgagaatgacacttcaggaaagaaatgaagaggctaaagagcctgaagaacatttgggtattgcaaatagtaagtgcaaaggcacgaaggcctgacctgttttggaggcagggaggacggcaggagcagggtgaacacagaggtgatggggtcagagaagggagaaaaggggtgcttcatgttttgcccagcattgaaggctattgtggacttttgagtgccatggtcgtctattggagagttctgagggttggtgtgatctgacttggatctcaagaagaacattctggattcaatgttgaaaacaaatggaaaaggagagagagcaggggcagaggcagcaagctcaggagaaacagcgattaagtaaacaatgggtttacttgttcagttttgagacttctttatgtaatctagatgcaactcatttatcagaaatgttttgcaaatatttttctgccactctacagcttgtctttttgttctccttatggtacctttcaaagagaagttctcaattttgataaagtacaatttatcgatttttccttcatggattgtgcttttggtgttggatttaagaaatcttttcctaacccaaggctgaacacgttttccttgttgtcttctagaaattatacagttttggggaactataatccatttggactttaatctttgccagtgttaagatatggatcaatttgtttttaattttgcatctgatgcccaattattccagcatcattttttcaagacctttgcacctctgtcaaaaaccagttgtccacatacatgttgggttatttctggactctattctgttccattagaccaatgcacagccagcagaagggactgatcccaaaaacatatgagtgaatgaagaggagtactgggtatgaagcttctcatctttaggtgtatcctaaagaagagttactgaacaaacacagagaagcagaaaaactccggcactgttacatatgtgaagaaaagtttcaaaatgataactaaacaatgtaaaatgaggcaaaaaggggcctctacgtagtgtttacgtatgagtggtcttagagaagtgtgtgactaagtagaactagattgcagaaggctgaaagagtaatggcagggggacctacatataccaaacagtcactaaggaagtggctaggccatctctcccgggtgaacctttctctgtgttccccatggcattttattcatacctctgtaatacaatcttttgctcatgcttctgttccattctgagttccttgaagggagacatcatacctcattcaactacagtactaaatacagtgctagaaacaaaacagacaccaaaataaaaacatggaggaggaggggaacgttaccctctcagccccttgatacgttagttctccttatcactacatgtttgcaacaagagtagctatgaactgtggagcggaagggggaaattaatggccagtttctgaacttgaccatgcaatttcctttgctgaaaaatttcagcttcacagattaaagatgtctatggttcgaatagcatttcctctatcacccctgcatttaaagtaattaaaaatgcacttgtttgggggaaaacaatcatggaaaaaattctgaacctataaacaaagaaaaattagaaatagtctgaagcaaaaggatctcctcagggcactcagaaggaaaaaaacatcacgcaagtctttcctttttatctgggacatatggtcaggtatgtacaatggatttgattggttttactctaagtattcagctaaaagacaaccttagtgaaactgactttctgatctcgtagcagacatgcagaagtgggcagtagcttgctattgcacaaaatgtggggccttactcttcccagtgaggacggtctacagttcaagttagggagacagaaggggagggatgtgtcctctgcaactatgcatttaaatgtatacataaaagggagtcgccacagtcacatttaactggagttgtttttccttcctattataacatctggattatctatgctggctaataatgcatatttctgcaatcttaaagcaatcttgcaataacacaaaaacaaacaaaaaaactagactacaattaacattcactttattcagttttgtcctctcaacttagaaggcaacaaatgaccacattaaaaagggagcatttcagaatatatatacataaaattggtctgggtaccctaaggtgtttgcgttgatagaaaattgacaccccaaactaagtgttctacttagcttctacaatagttattcctagaccttagattagtcattacatttttatttaaggtactatgttactttcatgactacaaaatgaggcactcgtacaaaacaggaatgaaaacatacatatactgtcttgtctttatgtcgtattaatgccaaagatattgtcagggattattttaaagaagcccttactcatgatggctatttttaaaaatggcacaggacagtaacaggctgaaaagaaaacacctggttgaggggacaaattaagtaaatacaagacagcttaaccaaggaagtcagcgaatctccacaaatgaggcttttaataatactttactggtaagacattttagttgggtttttttttgatggctgaataacatcctaaagaagtattttaaatataatcttttaattttacaatgtagaaaacttctcacagtaagtagagagcttagagtactcaaccctgaaaatgaaaataagtagctagcttggaaagttttaaaaagcgccagtgttcttatggcactacattctcctgcacgtgtgcgtgtgttcacgcacattcgcaaacgcaatacaatgtagaactgtccagtgtttgttttgttttaaaaagtcatcaattcaacctaaattcaagaattacactttaatagtggcattttgccaatacagaaatgacgtatcttggatcaaatcattttaaggaaagttattctatattacttgaataagggaaagaaaatacacaagacaagaatccacaataatagcagttacattaaatgttgaaataaaaattactttttgtttacatctggaattgagatggcccatcttcattgtttctccagagtactaagagggggaaaaaagtcacctaaaaacatgggaagttttttaaggctagctatacacaaacgtcacattggcatttttcttcagttttcatctcaactattagtactaaatagtttaaaaatcaaacataatttactaataatgaacaactgcacacttcatactatgaccgtttgataactggtcatgtaaaactatcaccaaatgctgatttgtcttctatatataaatagtaaaaataaaacaaaaaggtcttctttcctagttaaccttcttgaaggttgttttaacccaatataaaattaagcaaaataatagtataatttaaaaaaaaatttatgtgaagaagggcagcaatactaacattttctgaactatgggttttcaatatttaaaaggctcttggttaaatactaaaacccggatgctacccaagcaaatattatgctggaaaatgctttccctatgaaaatacttatctcattgaaaacaacacgataaagtacaattgaaaaactaggggagaattcttaagtaagacaatataaattacctgccagtaaaatggagggcaattttttggccattcatattgtttgtttacaaaacattgataagattcatttaaaattctgtaggattaagaatttttaaccttttgaagtatctgcctaggatctcttgctgttaaaacagatatgttccaatgactttataccaagatccacaaattctttgaaaaattaaaaaacaaaacaaaacaaaacaaaaaacccaaaattaatataatcaagttggccaggcgtgggggctcacacctataatcccagcactttgggagcccaaggaggacggatcacctgcagtcaggagttccgagaccagcctggccaacatggtgaaaccctatctctactaaaataactaaaataagccaggtgtggtggcacgcacctgtagtaccagctacttgggaggctgaggcaggagaatcgcttgaacctgggaggcagagggtgcagtgaaccaggatcgtgccactgcactccagcctgggcaacagagtaagactctgtctcgggggcaaaaaaaaaaaaaaaaaaaaaaaaaaaaaaatatatatatatatatatatatatatatatatatatatatatatatatatatatatatagttatatagttatatagttatatgctcaattcaataataatgtttttctcccaaagagagcaatttagaaatacactatgacaggcagcattatattttaaaatcctaattttttatagtaggactaaatttctgagtaaaggtagggctaacaaagaccttatttcaaatgagagaaaaggctgctctaaagtgccaaagagtataacactgaatcctatgtcaagcattatttctgatactgatttttttttttttttccaattttgcctaggttggcctcgaacgcatagcctcgcctccttgtgtgccaggacaaccggccggagccacc

SEQ ID NO: 2405 - DNA, 1502 bp, Homo sapiens
actggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccggcgtcccagggatcgcgtgggctccgcgcaatctctcccccactttaacggcgcgttttagccgcccggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggctagatgtgaaaccaaaacgcctaaccttttctgcctggtggactgccctctactggactatttgaggtattcagccagcaggtcaatgtgactaaaaaggtaaacatagagataaatgtaaacattaaaaaaaaaggaaccctttagtatattaacttttaccatgaaaacaatttcagtcattttgagaactgacaatgaagatgtttatacagtcttagtctccttttcaaccttggaggcagatctgcagcaataatagtaacaagtaggagcaatgggtgtactatcatgaccatcttttatgatgactggtgcattaatacaaatcacatttttctgagtccattcatgctatggatgttttcttatgcataaacatagagtagacacatactaaatagatcacatctgttaagtctcttgccacaagcatcaaaacttttcagagctgtctcttccgtgaaaatccatttcatgtagtagcaagttgattttctttgtggttcatccccacgcctgagacttgcagtaatgtaaaaccagtttaccatcactgccaaaa

SEQ ID NO: 2406 - DNA, 721 bp, Homo sapiens
cagagactcacccaagctacagaagaaatggagatttgcttaagttgcagagttttgatggagagatatttgcagttgatgtggaaattgccaaacaatctgtgactatcaagaccacgttggaagatttgggaatggatgatgaaggagatgacccagttcctctaccaaatgtgaatgcagcagtattaaaaaaggtcattcagtggtgcacccaccacaaggatgaccctcctccccctgaagatgatgagaacaaagaaaagcaaacagacgatatccctgtttgggaccaagaattcctgaaagttgctcaaggaacactttttgaactcattcgggctgcaaactacttagacatcaaaggtttgcttgatgttacatgcaagactgttgccaatatgatcaaggggaaaactcctgaggagattcgcaagacattcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaaagcagtggcaagtcaattgtattagcagaatattgtcctcattgcatgtgcagtttgagtacagattccaaacctatggctgagtttcttctagtatgatcaaaa

SEQ ID NO: 2407 - DNA, 5325 bp, Homo sapiens
tgcaaacccttcccaacccacttcccaggttttaaaaccttgattacagatccccaaggattagactgtatcggagaggtcacagtattgaatcagaaaaagaagacatgttttaaaaggtctgtacacaggtagtggtgtgtggggtgggggatgtacacttcatcactccaacatcaaaaaacatgatgcaaaaaggatttcagcgatgaccacagatttctagaaccctaccacgtatgctagcccccctccccatccacttttaaaagttgcttttaaaaaggataaaaagtgcacagacactttcgtaaggcacagacagattgtcacacaagtcgtttcattagggactcggataagacagcgagacagttaaataccgagaaatgccaggaggccgcatgttcctgagccggtgccccctgccaggactggggcaggcgcagggccgagcaatgggaggttattgcctctgcctcaactggacggactcaccggggttctcctgggccttggcgactgatttccagggcctgaaagcagcaattagccaacctcctcactgtgtctccctggcaggacctgagggtgatcaccaaccggcggggcctctgggggttctacttaacgccgttttggcagcagctcactgactgcaatgtgcccagcatttccaatgaagaggaggttctgtgaagcgcacagcaggttctggtcaagaaggcagcctttgggcacccacctcaacagacccaaggcagcggatggccaagagagcccagtggattctgccccaaatatctcatttccctcttagtgtcacctctgccagcatcacagctggggcacagtcctctctgctctatcctcacagcacctcacacgtactaggtactcagcaaatgtttctggagtatctttgtgtgcgttatgtggtgctgttttatcaaacccctgaacactcataatctgatttctggtttactcagcaaacctctactgagtaactactacgtgctggcacaggaccagcaccgggggtcagagaaaagttcaccctgtgtcctgaacacagtccatgctgattagtggcatcgagggactggaaacgtggtgctgccgtgaggggagcagctccatcccaggggactccccgttctgagaacctgctaggacaaggagctggatttgctttgcaaacagcccagtttttcaggagtctccgaatgaatgggcacaagaccatgaacaacggggtgttttcaggtgtcccctgtcctcgccctggagccctggctgctgtggcccagaagagcacaccatgggcagtgagcctggaacagccgagggctgggtcacgtgagggggtgctcagggggctggggccccgcttgagggggtggtgatcacggggcctaggaaggtggtgggacaaggccccaggtcccttcctaactgtggacacccctgaataacaagagagggcccttgggttggagtccagatctctcagacctcagctctgccaggagaatgcgggcagtgagcagatgagcctggaagggaggccgcttctcctcccagggtgtgggcagcggaggggcctggctggggctggaaccctccacataggcacaggtgcccggactctctccaggtgagtttcaagggagaaaactcacagtctcgagcttcctgggacttggagccaggcagtgggagtgtgggatgtggcagcagacactcccgggtttgaatcccagccctgccatctcctgttgtgtgatcatgaggtcacttcactcacaggacctcagtttccttacctgccaagtgggataacaccagctttcatagattgtaagtagcacagtttttttttcacacgtgaacatctctgattggaaggaactgtacagttgtagcatcttagttaagattggcagcgtttttccctatggtatgtaaaacagtgttttatgaccagcagtgtctttgatgtgacttattatggcaataagacctgccgcacaggattcacgcaggaaggtgcctctctagcccagtgccaaggcacgctgtaggtgcaaaataaagtacagtggctccttttcctctttctcttgtccccttctcaagacagaacatagtggggacgtgtgcatctcctctgtagcactgagtaacgctcagagcatcaggaaacgtctggtttttagaagataaacacttccttacctcctcttggaaacagggaggctatttatagcagctgcagagcaggttgaacgggccactgactcgcttcttcccaggtcacaggtggccaggagatgcctggtccacctctgggtccaggcctcagtcactggtttcccagtggaggctggacgtgaccccggctggaacccaaaggggcagccaggaagggcaggagagtggagctgctttcccccaggccactgagaccccacagcttgtggctgggtcgcagtgtagacaggagacggttgtctgcagcaccacaggcctggggtgaggagtcctcccatgcagggcctgtgcgtggccccgcccacacccagcacatgcaggaaaccaaattcagccaggcacccagggctgctggattctcaaactcttatcttggcaaacactgtggttccaaaagctgctcaaaagattctgctgcaaaattaaaatgtgggaatttccccagattttctagggaaaagtaaataatcagggattcttgatggggcaagagagtggggaccttaagttggaatcaggtcagacaactgtgattactcccagctagaggaggaacaggaggccccaaaccaccagcagcgcatgggcaccagctggtctgtggggcttgatctggtgaaggcctggcccagctttgctctgggcacccagacacccagcagtgtttgttatatgaatgcatcaactcccctgccttcctctccctccttccctccttcagcaggacatgaacagattaggaattgtactccaaatgatacttgctttttgtaaggcgtctcaggctttttagaacgttgtactggtcctcccaagaactcctggagttgtcaggttctagacttctaattgggaactgaaaaatagacaggccaagggacttccctaatgggacagcacagaagagggcagaggtggagcccagaactgggggcaagaagggagggacaggcctgggccagcccatcagcccagatgtgatctgggagtctgcagagatgggcacggctgagggggtggggcagggtcaaggtcccaggaaataccagcaggtaggtctgggaagggagagaatcccagtgccagcatttttcgttactgtctcgatcattagttaacatacttatcagtgaacactttagtaaccagcggaggaagatacactgagaatcagaacaaagaccaaaagttataaccaaagttataaagccctcgttcctcctcctgccagcaggtcccctgggaatgccaggcccaggggccaccacaggaaggtagagagctgtctgcatcgtggagtgggctttccagctccaggtgggtcacctgcctctaggattctttctctcccacagaaaaacagaacttactgctggtcttctccttggagatagggaagggcattacagagacttgcctccagagacggagacaaggttttgcacctttctctactcttctactcccaaacaccaagataaaatgccaccatcgtcaccctttggaatgccctatctagacacttctcctccctccagctgagcatacagctgagggaaggagaggatgcgggggaaaggcggccaccctgctcagtccctggaaggccactggcacagccggaggagccaggccagccgccagcccctgcccctgccagggtttgcatttccttacccagggatgactcagatgccgaggaggactggttgacactgaaggtcatatctgaatcactatcgtcctgggagccgctgagggaccctgatggagtcgtggtcgcagggctggactgcagggtacctgaggcccaaagagattccatcaggggcagtggaaggttggacctgccctgctagtccatggttcttcactgctttgcaccttagctttcccgtctaacgagaggaccagagaaacagccctgggatgttcttttgggatactaatgtgccctccctcataggataagggccaggccaacaggaacttccactctctggtctcaatagtggtggttcaggaaagggcacataacccccgtaaggcccgagacccaattctgcaacttttactggaactactaggaaagaaggaactcattccattcattgggaaggaagcctggagctggaagagccaacccgtggcaaaggcctgcctgagagtgatgccaacacagaggcaagcagagctttgagttggaaagagaggtaggatcctgctgatatccttccagtacctagatccagctattcctgaactcacccaatatactcccagacatttccttttttgcttagggcactttgagtggggttttgccccttgcgagaagatccctgactactagtgctcaacatggatgagttttcttccccaagcttgctgttggttcagacaataacagcttgtttcttaggatgaaaagatgccccttcccttgccctacctgaggatgaatggacagataatgggcacttcgtctcgggctgaaatgatgactatgtctgatggttcctcaaaaacacaaaacaacacaacttccccctccccaaaaaacactctgaccaaataaccacactgccacccggctcctcctctgccctcatgaagacagcaacagctgctgttgttactgttaccactgattaaaccagtgtcaggccccgctcaaggcattatatgcacatgatttcatcctcatgacaaccccatgaagcaggtatcactctctttctacagaaggaaacaggctcaggagaatctgtgatttgtccagcatcttcaaagctgaccagcgatgtgaccctgggatagtcatttaatctctctgtgctcattatcttatctgtaggtggggataatgatactgatttcaatagagtcaaagggaggataaaattcaatgagggaacatatgagctgttgactgcttcttattgcttggactctactttttgagccatgaagttggagccaggctctctgggaagccttctctgaacatctccttcactccaccaagctgggagaggagcccccggc

SEQ ID NO: 2408 - DNA, 263 bp, Homo sapiens
gtgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagacca

SEQ ID NO: 2409 - DNA, 2609 bp, Homo sapiens
attcctccaacaaataagacagagaactgcctgtttttttggttccctatcgaaggacggagcttggaacaacatttataacggtttaatgacacaaagagtaaaaggtgctgcagcccatccatctgctgaatgttgccaagtaacagccatccatggaacatggaaaaatgaattcacccggccaggcccaaattgtcgacccacagaacatgagatctgaaacgaagccaagcaaagcaacatcaccttctggaaagtgcagaaactgcaatcaagatcaacaaagaaaagcacccttcccatagattcatctctttggcgtttaagtgtttgggcgagtctacaaaactcagattcctcatttaactagatgttccaggtcacagagatattctactaaggcaattttcaaaagaccataaaaccaccacatcaatttatgcttgcaggtagtataattgcctttgtatcatatatttttagaaaaagtggcttaaaacaatttgaatagtgctttagaaataagacccttaaataattgacgctggtattgcctttcttaactctgggatttcaaaacattttccaaacattaattgcaatgggaccctggtgaggctgatattatcatacctattttccaagacgataagcagggagcgcagggcccgtttcttgtcttgccccatgcccttcagagcttgtccaagctcagagctcccttaaaaaccattggatcagctccatgggagcacagaggaaaatgagaaatgggctcttggagatttaagggattctgtaaggttgtgtgtgagtgagctgtagctaaaagtcaaagctggaaatctaagattccttattcagtgcttggatatatttcctcattaagataattcatgtagaatatcaggcttgcaggaatatgctggtaagaagtggactctgttgctgtttgtttttgagtaacttatttaataacaaaaatgcctccctttgatttgaataaaaataaatggctggattttcacaggcagcatgcatagaagaccagcaagggccaacagtgaatttcgacactgacttttaaaaattgtgaaagagatgctaacagcctaatttgcagtggagactagattctgtggctgtatcaggtggtggtataaagaagagccatatacagaaggtgaaatgaggggttaaaagtcacgctaaacatgctgcaaggacctgtgggcatcccaacctttttttctttaattgggaggagaagagctttttactaaagagtaagttccacaatgtaggccggtggcccaactgggaaatactcttgatttgaacagtttgcagcagttcttttctgaactctttatatagatcctctttcaatatggggacacatattttaaggtaaaaggggtattttactaattttttttaatgaagctttcactgcaagcaatatttggagttagtaatcaccggctggtttctttccctcctgcactgcaggaatgaggccactttcacagctggttgtcagcacatctcttattactaacaccaattattgatttttaaaaggcctacgctattagtaccctgctacatctcttcacgtacaatatgtgttttaaaaattccttttgtaaaaatataaaatctgagtccaacctttctatcatcactgtgcttgttctttacattttatcttataccttcacaggaaagcaaacccggaatctttttttttttttaacttttgggctaatttagaagcagaaatactttgcccatatgatctctctggcaggtatcacattataaaaaagcaaatggtgcgtagtgagggaggatgaaagaacataattagagggtttaggatcttctatccccttttctctgcctttatttcgtgccatcccaatctatgtttaagccaatcataaaaacccacctggcgtcatccccactagggtggctgcttttgcataggactgcaccccaaattggacttttctcttctctttgaaagttctcaatgaaggtgaattttaggatttctttcaaaagatactattcacacgtcagtcattctagttgttgatatattgtccaaatgataggcggctctgagaatatttatctttagcaatatttatgggtgtattagttttgtagagctggtgtaacaaagctctatgaaaacgctacaaagctcaccaaaaactggatggcttaaacagcagaaattaacgttctcatagttctagaggctagacatgcaccatcaaagtgtcagcaaggttggtttctgctgagggatgtgagggataatctgtttatgcccatttcctaatttctggtagttttctggaaattttggcattttttggattatagatgcattttctggtatcttccttcatgctcacataggattctccctgtgtgtgtgtctatgtctgtgtctaaatttcccctttttataaagactcagtcgtattgattagggaccacccaaatgatttcatctgctaggataccatatccaattaaggtcacatttactgagagaaagcacttcaacaactttttgggcaaca

SEQ ID NO: 2410 - DNA, 2070 bp, Homo sapiens
ataatgccattacactgtagagaaggtagcagattgagtgcaaggtgtgacaaacttgatggatggggctcactttccagacgttattctggagcatatggtaggaagctggagtgcagggacagctggcaggagcagttggccaatcagcagctagtgaacgggaagggagcacgtgactccatcatctagcctttccacgagagtccccaccctacgtgcaacacaagaaaaagacaattcacattctgaagaattcagattctgaaactctcccacctccccactcccacctacccccgatataaatcactggactgtttgtacgtgaaacagaagaggctaagcttcctttttttacacttatgagacaaaaagtgcagtgtttggttcgtatgtttagcacatgattttcataaagaatctatatatttttgccctacagagaattgttatacaggtcaagtgtgttttcctgatgttcctatgcagttacagtatgttgaaagtgttttaacactaagaagaaaactttaaagattcatgtgattaattggatttgaggataattattattatttggtttttagatttgaaaagtagaatttccattgagacaattgatttgaataggcctgcatttgattcttcatatcaatagaaactaaaatgatttgggagattcatttgaaaaatgattgtatacttgttcacaaagcgaaaagtgatacatgaaggtaatggttatcatttaaagcccacattttacactatcaggtcacaggagtctaatttttttttcagttagataaactgaccaaacgtctattcaagaatatatgtcaatatcatcctaatgtggaaggtccgaagaaccagaaaagtgagaagggccgtttacctccctctgtagctatcacctgttggtccacagagtttcttgagaaatgagcaaacattttatgattaggtaaccctttcacatgaacgggaagatgggaaaggtggaatgaccataagagttggcctgagaccagtttgttttctggggatttggtaagataggcagttcccatgggaaattgcttaaattgctttgttgcctatgatttgattctaaacaagtggtgctatcttctccctcaatatggctgtcttgagtttgtcttgcagtatcacaccattataccaattctttgggttgcttctgacacattcaaagtgaactctggctgatgttgctgtttcaggtataccatctggagttaatttcctagcagaaggtgaaagtccaggagaattgtcctctttcattgaacatgattgaaaatgtaactggctctgaacttcaagaagatagatgcccaagtgatgcattaaagtaagggaaataaagtcaagtttttcaactgccatccatattctcattggcagaattctgatttttttccaagcactgtttggtgagcctggaagcaccgtatcctgtcccaggagtacagtgaaatttccaagcaagagctgaggtgccaataccaaaagaccatggggagtctgcacggttctggttagatcaatagaaaatccatgtgtacaactgttaattcctcatcctccactagcactaaatttgtcactttaaattttgaaaccagggaaacaccacctgtcattctgtccccattctccatagctcttcaatctttacatgccgcaagacttttttgatagctcgtactcatcccagtgtctcctgaaaccccatcatgtaatgtactgggcaccttcttttaaacaaatgtttactctgtgggtttggttcatttcaatttctgcgttctgacacatatttttttaataaagatgagaaagagaaaatgactgttgcagtacctttctagacctactttaactttacctcagatgacagtttgttaacatatatggacacattatttttaactttatgtacaatgcattcaacagaacagcaaaatttttagaaattttccattaatttctgtaacacaccatgtaaaactgttacaaataaacatgtttgagaacaac

SEQ ID NO: 2411 - DNA, 8334 bp, Homo sapiens
attttagcgcatggtaatatttgatgcagttgtctctccttaagtattgtgattttcttcctttattaagagggttgtgggtcattccatgcttctcttaaggtatctttttactctgttttactgttatattttagaagatagttttaagaaacataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaatgagatccccagtcattgcccttgtaagcctgggaacccagtttagtgggagagactaatgtaaacagctttaatcaaaagtatatcaattggccgggtgctgtggctcacacctataatgccggcactttgggaggccaaggtgggtggatcacttgaggtcaggagtttgagaccaccctggccaacatggtgaaaccctctccctatttaaagaaaaaaaagtaaggcatatcaatttatggttatcaaataggtttttttttttttttttgagactgagtgtcgctctatagcccaggctggagtgtagtgctcactgcgacttccgcctcctgggttcaaatgattctcgtgcctcagtctcccgagtagctgggattgtaggcgcctgccaccacgcccagctaatttttgtatttgtagtagagatggggtttcatcatgttggcgaagctggtcttgaacacctgacctcaagtgatctgccttagcctcactgcttgcccctaagtggtgggattgcaggtgtgagccactgtgctggcctcaaatagtttttatcaaagctacttcaattagtggttagcaaggcttaaagactaattcagtgctttattttgacacttgttcgcaacatgttgctttttttcctgtgtcctatgggacctagtcatctgtatgttagattcacagaggaattaaagagataaacatgcatgtgctaaattgatttctgtcttgctttgttatcctataataatgttataaaataacattattataaatttcccaagagttgaattaataccaacaactggtaactcgtttttatgtaaacagcatacttgagaccagaaatcttctggatcactttgtggatctctgcctgccattctcattggtcctctgttcatcccttttctagagcttctccttaccttggcttctcttctgccacattggcctgcctgacctgtcctcaggccctgtcactgccctagattacgtttcccatgtcttcacttccaaatctggacctctcgtttagaccttctctcctgactgccagatggcatgtcccactgtcctccggtgtacatctccaaattgtcccacaggcatttatctcagatgaagtttcaggttggactcattcttctgccccaacagcagaatgactcattgagccattgagccattcagcacattctctatatggcagattcggtgctgtctctggaaatacataaacatagagcgattcctttttctgttgaggcaaaatatggatttggttaatttctattcacgtcatgaatgtggtatgtggaaggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaatactggcatgagccatgatgcctggcctcaaaatgcatacccttaaccactatgctctcacatttttagatgtgggatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgca

SEQ ID NO: 2412 - DNA, 2110 bp, Homo sapiens
ttacgtaaggttttcttttatttaaaagatcattcacaaaataccatatccatagatttactttctgtcatatagctgaatgtgttaagtgtttggaattccattcttacatttaaaagtcaactggattgcccagcagtttagatgcatgtgttttgttctttatcttatccacattgaagatgtaagtaggtcatctgaaagcctcgggtttgattacaccacataatgcatgtctttctgaagttaagtgttggtgttacacaaatggttcttatctcagaagcagagaagctgacaggtggaaggaaggagagagagttctgtggattgctgaggccttgtaacaagacacagtaggaaaagcccaggatgacggctggtgaccaaatactaagcacattccgctgggtgccccaggccaccctggccctgccatcacctggcgagggcctctttcccaggctcctgctgccggccgcccccaaactgctccccataggacagactgggacttgggtactgaaggatttttcatctgttcacacgcaggcgttcaagctcaaaagcctaacccctagcactcccacgtaagtgctgaaccctgcacatgggaacaatccagtgtgtccccaagatgtggccgcagacctaggcagctgcagtcctctactgctatctgaaggttcctgacagctctgcacagtacaatttatcaaaggaaatgagtaaagtgccagattctagacccattttggctctgaactgaaggggaggtgggaagcacagtatctcattatgttgcctatactaggaacagatccacacaacacacaggcaacagggatggggggaaacgctgtgtcagcgccgcagtcagcccagtgcagcgccagcaccaccccctccacccccaaagcgccttggcccagcagaaaagaaacccgctggccgttcactgcacccggccagagaggcgagcctccaccacgcacggcgaaagggtttttgttggaagccccagcaatacagaactcaacatgcaggtcagaagagaagcactgagggaatgaaaggaaactcctggagttgggccagtgtctaaagtaaagagaaagcaaaggaaaaatgacgcagcaccgcagcccaaacgcccccccacggcggccacctctgctcctccgaggaaccccgtgtgctgctgggaaaacaaggagcaggagaaaaaggacagaaggaaaatggggaagcagcggaagaaagaaaaaaacgcacaaacaggcactagatagatacagcaaagcccagaatgtactaaaaaccacttgttaacagctgacatgcactcacaagctgtgtttccgctgtgaggaggccaatggcaggcgcaggagtggcggctgcaggacggctgcccggggactcaccaggctgtggtcctgctctaaccccccacgccccattccctcccaaccgcaggctcatttttgctccttttgaacaacttcctctctaggcctggcacccccgaagatagcagagttgggattggctacttgattgaggggcgtcgcgactgttcgaggtttaagctggagtcgtggtctctgtgcgctttcctcttctgtgggttctctgaaatccatgttggatccaccgaggggagggccatctccgaagcggctgcccatgggggggcctgttcgccggtcgcctgggcgactacctcccctgccccctaagaagtcatccctgaagcctctgtcatctggtccaccttttctgaatccaaagccacctttatcttgttttctgccttctgcaatgtccacacgaagtgaccgatcgcccaacagtgcaccatcgtatgtcaaggcttccttaagggaatccacttcatcgaattctacatagcagaatcctttaaatttatctgtgtctttgtctctgactagccgtacactccttatgctgagatccttaaagatagcatctatgtcgccccgaaccgtattgaaaggtagatttcctacgtatgctgtgtaggggggctctgtgggcaactccttctggctacgggaaccatggccaccagcactgccgcgggacc

SEQ ID NO: 2413 - DNA, 2348 bp, Homo sapiens
cagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgactcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttca

SEQ ID NO: 2414 - DNA, 605 bp, Homo sapiens
gttcctgcctctacaacccccatcacagaagcattgtcacttgtcttcaggcatcttctctcccatggcagcccataggaagaagaaaaaagagaagaaaatgacactgataatccacaaagaggactaatacaaataaaataagcgggcttaagaaaacagaagaacacagcggacaccaggactctaagatagcgtcagttgtaccagtgaaggacaagaaacttctggaggtcaaactgggggagctgccaagctggatcttgatgggggacttcagccctagtggcattttcggagcgtttcaaagaggttactactggtactacaagtacatcaatgtgaagaaggggagcatctcgggggttaccatggtgctggcatgctacgtgctcttcagctactccttttcctacaagcatctcaagcacgagtggctccgcaaataccactgaagaggacacgctctgcacccccccaccccacgaccttggcccgagcccctctgtgaggaacacaatctcgatcgttgctgaattctttcatatcctaatggcaattaacctccaaataaaagatgactggtaaaaaaaaaaaaaaaaaaa

SEQ ID NO: 2415 - DNA, 279 bp, Homo sapiens
atggcgtaccgtggccagggccagaaagtgcagaaggttatggtgcagcccatcagcctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggaggtaatattactctgctgcaaagtgtctccaactag

SEQ ID NO: 2416 - DNA, 507 bp, Homo sapiens
taacagaggaaggcgagtcactcaccgtggtcttgacaggcacgtagagcacttgcttggcgccgccgcctcccccgcggacctcgtccggctggcccagctggaagcccttcgatttgacccagaatttaaatttggcgttgtccgtggagctcgactcggagccattgaggagctggacgatccgttcgtattttttacgggtcaccgtcttggtcttgcctgagtccccagctggaaataggggagttcccatcctcctcgcgcggcggctgcggccgctcctctttattctactctcacccgaggcccgcgcccgtcccggggagcggctctgccaggaaaacggcccgaccagtgcccggcgcctgggctgcgtccgagcccaccttcttccctcgtcgtcgtctcccagactaaatcccggaaagggaaagcgggatgtttgcgcccaccgcgctgtagctggtcctgacacttgcaaaatggtcagtggctcctgctcgg

SEQ ID NO: 2417 - DNA, 2208 bp, Homo sapiens
agtaaagattaaatgtgcttctcaaaggcagccacttcatgctgctatgtcgaaagggccattattattattatattttaatggtaaaagagaaaaggagagaggttgagcgagcgagagagaagctaggtgtgatgatgacagactagcttttctgagaggaaaaggaaaagggaagggagagaaaaaggagagcctctgagctcaacggaggattgtgcctgagaagaacccacagaggtgagaaaaaagttgtcttgaaggtgggggtgggggggctgctaaacagacactgtacagagggagaagagacataatttagctgtgttgctagtatgattccatttttaaaggaggggagggggagagtctagagctctaactgtttttagttgcatatggaaatatctaaaaaaatatttagcatttttactaagtgcgttgaggcctctccagtgtcctcctggctgtggctgctttgtcattctctttgactagccagccatctaccttgctcaggcctggaataaaagaagaacaagaagaagaaagaaatgaaatgaaaaacagaaagaaaaaggagaagaaacatttgtaaaagggtcatcttcccatctgcctcccctccttttcctttcatttttggtggcggcacaggaaagccccacttccagtctgatgaggaaagcgacaatctatcagcctggtgctcgctcttggtgatttggccttgacttcagccaagcagctgatgcagacgaagcctccgtttgcaggactggcaaagtgcacgctaaagaaagaaggaagaaatttttcaaaaagcagctctggggaggtttcatactccccccccccccccgcctttttttaatttttaagtgaatattttccaaatttgatcagttccagcccctccctccactcccacccaactgcccttttttctctcgtcaaagcataagctacagagttacagtctcgagatttggtgtatcgcttcctgcccccgcctcccctccccgcccccgttctccgtcctctattgaaacacctcgcccagcctagcgcactgagagctctcattttccccccttgctcgggatggtgccacaggaggctgtgcgggccccgctccgcttcgaatggatacagttaagctaatgatctcgagaggatatcgtcctggataagggtggagcctacgcccaaaaacaagattacctgaaagagaaaagaaagggggaaaacacacagagatacagtcggggaggccacatgaagatggaggcagagacaggagtgatgagcctgcaagccaaggaatgccaagggctgccagcagccatgagaagctgagagacacagagaacgagtcctctgccagagcctccagaaggaactaaccctgtcaataccttgatttcggacttctggactccagaactataaccctccttcctccacctcacaaaaactcacaagctgcaacccttctgatgtccactcccacacaaaccagcttcaggcctttttcaagtggatgctgtggggcaccacctccttgaggaccaaggcactccagctgccaggaatttggctgctaacctcacacagctgagccttccatgaaaattgctctctgccaaagagaacttcctagtccaaggtcatgtctactctccagagatgtgactggagtgatttgcacccggatgcctagactcgccatctgctcaaagactgctcagaaagccctcccatgcattcccctgctgcataccagcccactctgcctgcagctgctgtctgcaggacttcatatctatgccacactgtgtaaaagctgtgcttcaagaaatcacaaaaacattttcctgcacctactacacagcctgagtgcggcataagttgaccttgcttgctaagaaatggggcaagaaatgcttttttgtgtgtgtcatgtctgtttgtttttcaattaagagaggaaagcattaggcagatggaatgtacatgtgaggatgaggagacagaaaacaagtagccctttccatcaagatagagggttttctggggttgctggctattgaatgtcactcctgatttctctttccaaggcactgtaccaccagcctactgagattgtgtgggagctttcatgggggttgtatttcactgatgaaaataaattttttgcataatgtg

SEQ ID NO: 2418 - DNA, 1605 bp, Homo sapiens
gtcctcgctgcggaaagttggggcaacctgttgctagtctggtcgttggtgacagcgaggcttccgcgctcgctgctggtgagcagccccggcgtgccccgcgggctggaagaggcggcggcgtgatgcggcccgtggacgcggacgaggcgcgggagccccgcgaggagccgggcagcccgctgagccccgcgccccgcgccggccgcgagaacctggcctccctggagcgcgagcgcgcccgggcgcactggcgggcccgcaggaagctgctggagatccagagcctgctcgacgccatcaagagtgaggtggaggcagaggagcggggcgcccgggccccagcaccccgcccgcgtgcggaggctgaggagcgggtggctcggctgtgcgccgaagcagagaggaaggctgcggaggcggcgcggatgggcaggcggatcgtggagctgcaccagcggatcgccggctgcgagtgctgctgagccggcgaggccgcgcgggtctggagcggagcgcggcggggagtgtcccgcgtggaaggcgctgggtggccaactgacgaactgtgttcacctgataaggagtcgtggctgcttggacaggctcaaaccaagagagcctttcgttttgtctcccctgtttttctgcctgcgttttctccacattagccactcaatttccagtaccatcctggcggatgacttcagcattagatggtcaggtgtatttttttattaataggcgcattcagtttggaaaagacagcttttcattaatgtcccacgtaaaggaatatggcctatacagtacgtacgctgctgcgtggtcatatttgttcctgtgatcttattgtattttcaaagtttggaagtatactcgtgtgctttgctgtttttttatgcttcctggaatttggggactcatgagagacttgaggttagagttctgcaagtgagaagacactacatggttgcagctgccacatgaagaacccaagctcctgtcaaagttgtgaatgcgactttggatgagattaagaaggcccagtggacggttggtcttgaagagtggcagtgtgtggatttgaggacctctgcagaccatcagatcaaaggagggagagctgttttgggtgttttgttttttttgtttttatagcattttgctttttcttggaatgtaattttcctatggcatgttaactggtgcacatcgtgtaacctgtctggtgagcaacctacaattgggatgagttctaggtacatgtgtttgctgactttggggtaaacaactttgttataatacagtctctgccacagatgcatgtgacctcttcaggggcccagagtggctgaggaaggaaagcttcaagctggccatgggggtcccaaacagtcattccaggcttagatgatgactagcctaggtcatcagagcccagactccacagagactaaaatcagagctctgtcttgttatgataaatttcatttgcttggaaaaagaaatgctgaaagccagtgtttagaatctttgtgcagatgaccaaagcaattgacttggccaagaaaaggtaaggtaaataaacatttttcaaaatga

SEQ ID NO: 2419 - DNA, 656 bp, Homo sapiens
attgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggaccctaaagtaaattggttgaagaaattagatcccaaagattcttggtgaattttgaagtcttcatcagtatatccatattaaaacgagatgacagaagccaaagtaattatgggctgacaggacaactggatcagtttcattaaaaagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagt

SEQ ID NO: 2420 - DNA, 4505 bp, Homo sapiens
cagaaactacctgggctcggccgacctgttgcctcatattggccaaagagggggaaaccagaaggagggaattctgctgcggcgacttgactttccaggcccggagcagaaaggtgcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgcctcatgccagaagcggctggacagtggctgcctcatgacccttgcagtctcccacatccagggcctgatgacatgcccccttgtcccaagtttcttgggaacccctgaccctgctggcccctctcatccaccccaaccctatccaccctggaccacctctgggggtctgtcagcctgctggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccgcaggggtctctgccctcaaagaccccccactgcagggagccccaccccataagagggtcacggaagtccatgtccgcccacccccagtggcttctggtgtggccgtattggcctagaggggctgactggggagggtcagggccaagccctcagcatctgctcctgtccctgctttttcacccctgctgcctgaagtggtagccccgcctgctgcttctccacctcccctccccacctcttctctcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaactggaggcctcccgtgtctggtgggggtgatgcagtggccccgggtggagaggccccatggtgaggtcaccagctcccatggccaggagttggcagggagaagcctctgagggctagggctgggggaggctgtggcagggaccgtgtttcctgttcagaggctgtgctgagaaccgacttgacctggaccactgccccatgagaagcaggcagcatcctagcctggccccgagaggtagctgcttgttctgttgacaacctttgttcaacgacccaaaacataagtccctttcctttttagagtctggcgatcaaaagtgtcttaagtcagtagaatcctgagggtggactagggtgaagtgaactgaaacagactcgacacaggtcattttgtgtagcactgagactcctctccctgcctgaggccacctcccactgcctccctaccagcaaggttactgcagaatcttggagaagataaaggacctggccctggaagcctgcttccctttcccaaccttggaagcaaattctgtcccatcagagcccccctccctagtggctcccaccagagacctccctagtggctgctgtaagggttggcaagcaggcaaaaggcgggggagggagggcagagggtagtgttagaggaagccccatagggcccctgggtgggggtggggaggcatcctgaggacacagggctatgctcagacttaggagtgaagactgggtttaggggccctgggggcactcctgttgccaagggctacccaggggtcagagcatcctgacaaggaggacccgtccaaacgcactggtgctaatgccctatggcatctgccaccacaggagaaatggaccccagtccttgatcttccctcccctttgtctagatggtcctctttatccccactccagggatcacatgacttggcaaagcaagatgggaaatgatcctcccagagcctggctccaaggcttcttgaagagggaggatcacccctcccatccctgctacagaggaaaaggcaggaaggccggttctgctccgatgggactccaggagaccaaagccctgagccctgagcccagctcttccacttactactgtgtggtgccaggcaagctgtgcacaacctggagtttttagtaaggttccgttgggatgcttgtaagcagtgaatacgatgatgtctgttcattgtttgtcatcaggtctcacctggagcagccttgttactgtggggaaaaggaaccaagtgaagggaatcggcctctgatgagagcctgccatgtgccaggcaccatactaggtgctttgcattcctaatctcatcattatcacacaaccacctaaccattatccctgttttacagagaaaccaaagacaggaaccaagtctgaaacagagccccaagaagaagctcttttcctgagctaccagtgccccttggagaggcagggaattgggctggaagaatggtggaatggaatagcaaagatggaagatgaccctgtcctttctgggtgaggtccagaagaaatccagggcttggatgaggggtagacctgagagccttctccaaatggaactccccagtgggagcagctgtggccaccctgagatgggtctacctgtcttccttccattccacctccagagattgattgggacctaagagactgagtcaggagagggcaagaaagcagctaagtgggaagtttcaggggcactagagcaaatacattgagaaatgggaaatacaaacagcatgcaaaatcacatcctactcctacccaccccactcccaagggaaattgctgggttttggacgaattttcactttgtgtgcaccttttatgtatgtaaaactacaaacatactactttgaaatctgattccgctatttcatgtttgtcttaccatgttattatgtattttcctacatccaaagctacctagtatctcttttgtatgaaggtttcatcatgtatcccccagtgccctttggttgtttttctttgttgtcatttattttggtgggggttggtttgctttttgttgttgtttttccttgtttttataaatgatacagtgacagatgccgttgtggataaatgctgtggcatagtcatcaattccttgatatatattcctagaaagtgcaccaaagggtatgcatggcttagggcttttgatactctccagagttgggataccaagtcacactactcactggagtcaggatgagagttttttg

SEQ ID NO: 2421 - DNA, 4506 bp, Homo sapiens
cagaaactacctgggctcggccgacctgttgcctcatattggccaaagagggggaaaccagaaggagggaattctgctgcggcgacttgactttccaggcccggagcagaaaggtagcattggcatttgtaggcggtgacccgccccttctctggccttgccaagagtcacatccctgcccaggggcacctctggccctggaacttgcctgggcagaggcagcgtgaagggcctgaacaagaggagaagaagggccttcctagtagaggcacagcatggacaaaggctcacaggggtgggggtgcccagtgatcgagtcctggcttgggaaggaaggtctgagttccctgggaactgaaatctgctagcagcactgtgagagaggtgtatttccccctcctaatgacagaggaaactgaggcttcagggaggggtggatttgcccttgacatgcagataggaggaggaggaactgcgtgtgcccctgggcctgcaggcccccacacccctccccagtcttcttcaagacctggcatggtgggaggagggagggggaagtggagaggggagcatagggctcctggggcaccaagggagagaggggcccaggggtagggaatctaggaatgtcgctttccttggagcagtacggaaagtcacagggaagatcaggaggacggacagctgagatgggagacaggagagatgagccccaggacccctggggagccaagctgtcccccacatcctagcctctcaccccacctggagcttcaccaagggctcctcagcagtgaagtggcacaagcctcccagtttggtgggcaagtgggggtgatcttggtgttgtggctcctggagacacgacataaccaggagggtgaagggataaacctggggtgggctggggctgagacccatggcatgaccccaattctctctcctcaagctcgaccccccatccccaggatcacacaggagaatctcatcctcacggcttggattgctcctgggggccccctggtgtgctgctaactggtgtacaatgctcaggagcagcccagaggggagccgggaagggaccctcgcccttaccatctatccccatttccgcatctcttgcactggtaccccgggcgccacgttctcagttcctgggactgaaaactgcagcagtctggccagctccagggacagagtggcccagccacctactatgtaccctcctcagctgcccactggactcaggtcctgaatgaagctgtccgcctgcctcatgccagaagcggctggacagtggctgcctcatgacccttgcagtctcccacatccagggcctgatgacatgcccccttgtcccaagtttcttgggaacccctgaccctgctggcccctctcatccaccccaaccctatccaccctggaccacctctgggggtctgtcagcctgctggtccccccaacagatctttgggggcagcctctatgggacaagagtgacacagggctggagaagaggagtgaggagcctccttgtgtctgatgcacagatgtggccctttcaaaccctggtgtcaccctctgggtgactggatccccagctccagcctcttcctgggccagccaggaaggctggaggaaagctctttgctgagtgcatgcatgggagtgtggggggtgactgagccctccccatgcaaggggcttggcctgggaccctggaagctgtttccctactgggataaagttgcgtcagccgcaggggtctctgccctcaaagaccccccactgcagggagccccaccccataagagggtcacggaagtccatgtccgcccacccccagtggcttctggtgtggccgtattggcctagaggggctgactggggagggtcagggccaagccctcagcatctgctcctgtccctgctttttcacccctgctgcctgaagtggtagccccgcctgctgcttctccacctcccctccccacctcttctctcccagatggggcccttgctgcgtgacggggtctccatgcgctttatttatttgcagtctgttttctaggcggtggagctagacactgaccggaatgacatacttttctgtgtgtgattcactgtgtactggtcagcacaggctggccagagagctgttcttgtttctggtgttgtcacgtcttcttgttttctctaagtttaaaaaaaagtccttggtttaatacactaaaatcccaactggaggcctcccgtgtctggtgggggtgatgcagtggccccgggtggagaggccccatggtgaggtcaccagctcccatggccaggagttggcagggagaagcctctgagggctagggctgggggaggctgtggcagggaccgtgtttcctgttcagaggctgtgctgagaaccgacttgacctggaccactgccccatgagaagcaggcagcatcctagcctggccccgagaggtagctgcttgttctgttgacaacctttgttcaacgacccaaaacataagtccctttcctttttagagtctggcgatcaaaagtgtcttaagtcagtagaatcctgagggtggactagggtgaagtgaactgaaacagactcgacacaggtcattttgtgtagcactgagactcctctccctgcctgaggccacctcccactgcctccctaccagcaaggttactgcagaatcttggagaagataaaggacctggccctggaagcctgcttccctttcccaaccttggaagcaaattctgtcccatcagagcccccctccctagtggctcccaccagagacctccctagtggctgctgtaagggttggcaagcaggcaaaaggcgggggagggagggcagagggtagtgttagaggaagccccatagggcccctgggtgggggtggggaggcatcctgaggacacagggctatgctcagacttaggagtgaagactgggtttaggggccctgggggcactcctgttgccaagggctacccaggggtcagagcatcctgacaaggaggacccgtccaaacgcactggtgctaatgccctatggcatctgccaccacaggagaaatggaccccagtccttgatcttccctcccctttgtctagatggtcctctttatccccactccagggatcacatgacttggcaaagcaagatgggaaatgatcctcccagagcctggctccaaggcttcttgaagagggaggatcacccctcccatccctgctacagaggaaaaggcaggaaggccggttctgctccgatgggactccaggagaccaaagccctgagccctgagcccagctcttccacttactactgtgtggtgccaggcaagctgtgcacaacctggagtttttagtaaggttccgttgggatgcttgtaagcagtgaatacgatgatgtctgttcattgtttgtcatcaggtctcacctggagcagccttgttactgtggggaaaaggaaccaagtgaagggaatcggcctctgatgagagcctgccatgtgccaggcaccatactaggtgctttgcattcctaatctcatcattatcacacaaccacctaaccattatccctgttttacagagaaaccaaagacaggaaccaagtctgaaacagagccccaagaagaagctcttttcctgagctaccagtgccccttggagaggcagggaattgggctggaagaatggtggaatggaatagcaaagatggaagatgaccctgtcctttctgggtgaggtccagaagaaatccagggcttggatgaggggtagacctgagagccttctccaaatggaactccccagtgggagcagctgtggccaccctgagatgggtctacctgtcttccttccattccacctccagagattgattgggacctaagagactgagtcaggagagggcaagaaagcagctaagtgggaagtttcaggggcactagagcaaatacattgagaaatgggaaatacaaacagcatgcaaaatcacatcctactcctacccaccccactcccaagggaaattgctgggttttggacgaattttcactttgtgtgcaccttttatgtatgtaaaactacaaacatactactttgaaatctgattccgctatttcatgtttgtcttaccatgttattatgtattttcctacatccaaagctacctagtatctcttttgtatgaaggtttcatcatgtatcccccagtgccctttggttgtttttctttgttgtcatttattttggtgggggttggtttgctttttgttgttgtttttccttgtttttataaatgatacagtgacagatgccgttgtggataaatgctgtggcatagtcatcaattccttgatatatattcctagaaagtgcaccaaagggtatgcatggcttagggcttttgatactctccagagttgggataccaagtcacactactcactggagtcaggatgagagttttttg

SEQ ID NO: 2422 - DNA, 740 bp, Homo sapiens
gaggtgactggaattgaatgacatgatccaggggaggccggccacaaatgcagtaacatgaccaggatgggccggtggggctggtcaggtcacagtgtgagggacagaacggaccccttcactctggcctcctgtaggtctccaggtgtgacaggatccagcccgctggcaggaggaaggtcacgaagcaggaggtaagcccaacggccaattcctacacagagcacaagaaagaaggcacctcggagtcagtattcccctaggctctctaagtccttgcagttcccaggcagcagaaagccccgctcagggagccaggactcagaggcaagtgggaggccccgcatcctcacgttaaaggaatccacgctccacggagcagacagagcaggtccaaagctacgctaacccttgaggtaaagggtcagttataaggagggggaagagtgagaggaaggagagacagctggggttagggttcagggagaaatgcaccaccagatggtaaaggaagggacaggaagcaggatttattgaaacctgttttaaagctggtctgggccgggcatggtggctcacacctgtaatcccagcaatttgggaggccaaggcgggcggatcacaaggtcaggagttagagaccagcctgaccaacatggtgaaaccccgtctctactaaaaatacaaaaaattagccgggagtggtggcgggcgcctgtgatcccagctactcgggagac

SEQ ID NO: 2423 - DNA, 1269 bp, Homo sapiens
agggttggccaccttgagaagctgcgaagatggcggagtaaggcgtgccgctgcaaactggcctctgggccgggggcgagcagcccccgggaggccgagtgcatctgttggaccgtgcgaggtgagccgagaaggccagtgacggtgggacgagcaggcgccgaggaggtggcgtggcccagacgggccgggtacggaagcgcgcaggaacctgcgagttgcgggcagccggcctcggcctcggctgggcgggggttccaacctcggcggctccagggcagccgtcacccgccttctgggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccag

SEQ ID NO: 2424 - DNA, 765 bp, Homo sapiens
ggcaatccctactccctgccaaaggagaacccagttactgaacatcggatgagaccatggatagtaaattgggagtgaaggtccatacctgggtctcagaagcacagtacaggtttttagaacaagccaccttatacaagttaaaattcatgaaggaatggatacaggttaagttacaccagcctcctgagtatgacagcaacattccttcagggattaaagaaaatgcttcagaagattggaacactgctcagccttcccaaccttcttttaccactgatgtttctaccttagtgatcttcctccttattttaatgcttctttctctttacaattaaaagttcataaaatctttcaacattatttttcactacaaaagtctgaagttctctgtgaaatgcctacatgtaagaattaagatagattttaaagactgtcagtctcaaaattccatgctcatcagttagtgcatgatattaaattatgcttttttcctccttttaaatataccaacattatattgctgatttttttatttacctgggtaagagcactgactcggttctcactaggaaacaaaggtgggtcttctccaacttgaaaatcaaaatatacagttttatgtgtgaaagtagaaaattcattgctgaagcaaaatttgtatgtcccatttttggaggctgtgaaggtaaaactatcatactgtttcttcatctctttgtataacactttaccatcaggatcttctaatcgacaatctacatc

SEQ ID NO: 2425 - DNA, 3476 bp, Homo sapiens
acttgggcaccgcaccgctgggggcgaaggcaccgaccgggcggcacgggccgggaccgggcgctggaccagggcggccccgaggcctggcgggcgacccgctcctagcaaaggtgcgcggggggacgagcgggtgggagcggcctcgcaaacaagcctccgtcccagcccttgccttctgctcgaaattgatgatgccctgcactgggccgtcgcccttcagcacgcacacggccttcgtcgccataactcgctaggccacgccgaggtcctggttccgaggactgcaacggaaaccccagacgctgcaggagactacgacgcaaaccagcaccccgtctccgcgactactttataggccagacctccgcgcctcgcccactctggccccaaaccaatcgcctcgcacgcgctcagcccgccccctgcggcagcctcgggtcgcgagtggccgggaatgactgggggcggggccaaggggccgcgtgcgccggagactccccccgccccgcagccgggaaacgtccagaaccccgaaatgtggagaaaacaaccttcttttcacgggggcgtggcccgccggttgcagtacgcgaaattggcaaaatgatgtaaacagggaagttcggcagatttcagttcattgtaaacttgccaagggatccgcccacagacacgagagagctgctttgggacagtgaattactcttcttttgagacggtctaatgatgcctgggtggtgccttcgtaggatggtcgtcacacctgaacaagggggtccctggccccaggccccatgctttactgggccctgttctgtccctcttctggcatcatctcccatggagaaaagaatgtgttgaagccaagaagatgctccccccgcaagaatatcatctctgctagaacaggggctggagtgtaacggcatgatctcggctcactgcaccctcgacttcctggattcaggtgatcccctcacctcagcctccctagtagctggtgtgtccggaattggtgggttcttggtctcactgacttcaagaatgaagccgtggaccctcgcggtgagtgttacagttcttaaaggtggcgtgtccggagtttgttccttctgatgttcagatgtgttcggagtttcttccttctggtgggtttgtggtctcgctggctcaggagtgaagctgcagaccttcgcggtgagtgttacagctcttaaggcagcgcgtctcaagttgttcattcctcccggggggttcgtggtctcattggcttcagcagtgaagctgcagaccttcgtggtgagtgttacagctcataaaggcagtgtggacccaaagagtgagcagcagcaagatttattgcaaagaaagacaaagcttccacagtatggaaggggacccaagcagcttgccactgctggctcaggcagcctgcttttattcttttatctggccccacccacatcctgctgattggtagagccgagtggtctgttttgacagggcgctgattggtgtgtttacaatccctgagctagacacaaaggttctccacctccccaccagagtagctagatacagagtgtcgattcgtgcattcacaaaccctgagctagacacagggtgccgattggtgcatttacaatcccttagctagacataaaggttctgcaggtccccactaaactcaggagcccagctggcgtcacccagtggatcccgcacctgggctgcaggtggagctgcctgccactcccatgccgtgcacccgcactcctcagcccttgggtcgtcgatgggactgggcgccgtagagcagggggcggtgcttgtcggggaggctccggcagcacagcagcccacagagagggggaggctcaggcatggcgggctgcaggtcccgagccatgccccgcagggaggcagctaaggccggtgagaaatcgagcccagtgccggtgggcggcactgctctgagtacagggcctccacagccgctggccctggtgctaagcccctcattgcatggggccggcagggcctgccggctgctccgagtgcgggcccgccaagcccacgcacacctggagctccagctggcccggaagtgcccgcacagcccctgttcccgctcatgcctctccctccacacctccttgcaagctgagggagccagctccggccttggccagcccagaaaggggctcccacagtgcagcggtgggctgaagggctcctcaagtgctgccaaagtgggagcccaggcagaggaggtgccgagagcgagtgaggcctctgaggactgccagcatgctgtcacctctcactgggactacaggacttcctatggcgtttcttgaaaggcaaaactgttgtcacttccactgacagtgccataggtgtgggcatcacctgctacagcaaatccagtaagccccctccaacctggcagcaccactgcaggtcctcatgcctggtcctgccctggcagaacctccacacccactcggctagaggagatgggagcagtcctaggaaagaacgcttcagacatccactgttcttacccaacgttcagcatgttatcaagcttaaacacttctcagattgttgtatgagttttattgatttccagagcaccaaaatagttgttcttgtcaattttgttcagacttatagttgctttctggggagaggatttgctgacttttcacatggctgtagctggaaatacgcttccacccccagtgtttctgattcattagacccggggtgcaactggagaatttgcatagcccaaaaaagaagtgtgttacagttcctcccccactctctctcttgctcctgctttcaccatgtgaaatgcctgctcccacattgccttctgccatgaataaaagctccctgaggccccccccatgaagctgagtgatgttggtgccatgcttgtacagcctgcagaaccgggagccaattaaacttcttttctttataaatttcccagtctcaggtatttctttttttttttttttttttgagatggagtctcactctgtcgcccaggctggagtgcagtggtgctatctcggctcactgcaagctccacctccaggattcaaacccattctcctgccttagcctcccgagtagctgagactactggctcccgccaccacgcccagctaattttttgtatttttagtagagacagggtttcaccgtgttagccaggatggtctcaatctcctgacctcgtgatccacccacctcagcctcccaaagtgctgggattagaagtgtgagccactgtgcccggcctttttttttttttttttttttttttttttgagatggagtttcactcttgttgcccaggctggagtgcaatggtgcgatcttggctcactgcagcctccacctcccggattcaagggattttcctgcctcagcctcccaggtagttgggactacag

SEQ ID NO: 2426 - DNA, 2469 bp, Homo sapiens
tgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacaccattatgaatggtttttgattgatctcacaaagagcatgtgctttagacattaatgcagcgactaccatgaaacagagtattggattacctaaggaaagaagcagaggatggaatttgaggcaatcaggatgagtgaaaaattgatttgcagctgacctgcaaatggaatcatcaggaacatccctttctcatggagtcccttaatttacaagttaactgcaaacataggagatgatagttccaagaaggaacattttatcgtctttgtttttaatctcaagaatggtacctaccatcagtgaatgacctgttgcagtgctttcattgaagtgttcttcgttccctcagcaatatgattgtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacaggaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaagttatagctgaggtggtaccagtttaagaagtgagaacttcttcactgactgaaatttgcatatcaatccaaatcattgtgcttatttactatttttgtagacgtcattcttcaaaagtgctgcatcttcaatagtcaaggaggacaaagacatctttcctgcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcacc

SEQ ID NO: 2427 - DNA, 4444 bp, Homo sapiens
gtttattgtttgaccaacatgctgagtcttttccacattttacacagtttaatgtgaaatcaacatggcggctatgtcttctgagcccataacagatggaattgccaccctctgtgctcctcacagccaatcactttaaagggatgggtgaggggaaagtgaggggagaagtggacacacaccgcgagatgcaggctggccttcaatgctatggaggcttcccacctcctgaaggaaccatctaaacccctgctgcaaggatttcctgatgaaaccacacactgctgggagtgccaaccagacaggggtctggagtccaaggagtttgcacattgagatcccaaggttttggaacacctaaatagttcatgtcaaacaaaaattcaaagggtgtcctgatctgtgtgggtgcccatgacaatcaatcagagtagacttggggactggcccttgtgcagtagaggagcccaaaataccaccaatattctcactcatatgctgggaagaacctagtgtcctaaccaaaaagagtagagatggtctgaggaacacacccacacacagcagtccttgctgtgtaataaatatggagtcacatttgttcacacacagggcagcaatggatgaaaaatggaaacttcactggttctgatcactcctaacttgctgggtgatcttaataagcaagttgcccttctccatcctggttttcctgcctgtagacaggaaaagttgtgacagctctgcttcacatagctgtaacaaggtgacaatgcctcacattctttggggagaggcagttcggaaacgagtgtgcgcacaatctgctcggttgatgcacacagacatccttctgttcagctgcccctcaagtggctcagacatgcctcactgtcctcggctacctggtcccatctcatcctgacatcctcacctgccttccatcttgtgaaggaatgaggctgctctacctgcaggatgctgaagccaggagggccatccctttattgtcacaactggtatcccagggcagggcctccccgcactggctagccaccaggatgatgcagacgttgcaccccagatgtgtctgcactcttaactaccaccatttcaatccttgtttctgttgccagagatactgaaactggtctggccattgctcccctcagacctgggaacatgactgaatgtttaaggatgacaagaagagagcagcgatagatagcaaggaggcctctgaccaagggaaactgctgccaacagctaccaagccaactagccttggatcacacaactgcagccatggtgctcatgattctgatgtcacaccttcatgttgatgtatgtatgatcacccagcaagttaggagtgatcagaaccaatgtgtttccacttgtaaataggctgtttgctttttccatcttacactcaactttcctgatgcctgcagaacaggagctttgttgataagcttttaagattcacccccttcactcccaccatccccaaaaaagaaggccaagaggatcctgctaatctgccaggtcacgtctagtctttggggagagggactgaattgctcaattgagaacatttcctcaaaggaatcctccaatttgccctctgctaacccatctggattcagcaaagatgcaatgctcttgctggggtgctgaggcaatgccatgacatcttcttcaagagcacctaacagtttattatggaaccttaactctgtgccaattctacctgcaagcaaggggacagggatggtgcctgctcaagacaaaaatcagggaaccaacaacttctgaaaaagaggtctggctgcctttccacaccccaggaagggaggggcggaaaccgcacgtgccgaagggagcgccatggaaccactgagatgggaggatgggaggaagccaccctcagcctcagaggccaaggggctggggagaacccaaactcaaagagaggatgttgtgtgcatgctaggaaaggcaggactcactaaggccatgtcaaaccaaatgctatcttttactgctcctctaggccaggatggaaacacagtccacggtgccttggatgtgtgtgcccctgagaagggaactgagtttctactgttttatgggatgtttttttaaaaaagctaatctttagtgccaagaaaataaaaatctaccatacgttcattcactgagacccagtgcagattcctgtaaatggggcggtctcagaggccacaggtgatggcccccgctgccaaccaggcaggacactgtcatgtggactcctgtaaattctctcgaggtaagtaagcactcttccaacaagcaccacttgggggtgtgcccatggtggggggacactggcccacacaggcatgcacacccgtgcatataaagtacatagagaaatggtggagatattcccgtgggctatgtttgcctgtagtttaacacaactatgcattattttattgatggcaagacaatcacaagttatttgacaatattaagtatttcttatttcaacacgttgcagtacttttgaatttccaaaacttatcacaatgcaagttccaacttgagagcaggagaaacaagaatatacattgagcacatgtatctccgtgaggatgtgtttgtggaaggtgtatacacaagtctatctctatatataattatgtacacacatataaaaactaaacacatgacatctgaaacacgttcaaacattggtccttgccttctgcaagaggtgctcagtgggatcctgcttcctctcttcttcacctgaagataaattccttgctagagatgagctctggcatacagcctcctaggcagagggtgtgtggcaggcccactgcacaaatatcagtcctgccagattctgctgcacttactgcctgccatttcagattaatttctgagaagtttcaaaattcattccaacgaccttgtggagttcagcccaccataccccagatggtcattcatcccatctatgacatgcccagcagcagcctggagggagagccaatgacagcagggagggtggggtttacattttggccagactcactgcccattgcacctggctctgtgcaggctcagggcagtgagtctgagtctatttggaatgctggccaagtaggttatatcacttagtgggaagagagagttctcttcagagactttgcagattctcaggactaagccattctcaggaatgaatcaaaaatggaagagatggctctctgggggcaagcagccttctggagaccccacctgaaccacatcctcaggtgaccacagcgcagccacagtagccacaaagatatgtccacaaagacttcaactgcgccatgccactggggtgaaaacatagcaacaaatcagcttttccagaaagcactcaacaatactgcccaacatcacacactgagtttcttagacttggcccaggcatgtgtactgactgctgggtgggctggttaaaatattttcagaagtacacatggcaccccagtctataaaccacgcaccacgcagctgcaattgccaacagcacctcgtccttctgatggcctcttgctctgccagtccctgagggcacagagaacacaaggttgcctgtaccctcaacccccttcaaggcttttcagggaaagagaaggagaggtgggagcagttcctctgggggctgctgccgggctgcctagagcccacagaccttggtctcagctccacacgaggttgacgacccactctggccatggaaagacaagagtcagagctaccttttcagaggctgatgtgttcaaccaatgtttgatttaactggagtagggcctagagagtggggccagatggccccagactgaagcctaattaatttgctcagttaattgttttaatttattgggctggggataggaggaaggcagaggtgatgaatggttcaaagagaacaggaaggaggaggtgtgtggaaaaggttctctataagtttacaaatatacaaaaacaaaaagcacatctttcaaataaaaatgactacatttttatctggcaaaaaattgtatacacatgatttaaattttttttaaattttaacagtttttggcaatcttaataaagtacaatatattacaaccaaaccaaaaaatagttgtttaagtaacagccgttaagagtgatgtgatccctgatgcccagcctccctccccatcccaccctactcctaaagacagagagaaaagaaaaatcctcccatcttgataactcggttccctccccccttaggaagctagccaataggaagcaacacaacaagcaaggagtgtcatgggaagccacaggtcggctctgcattagcaggagcagccgccctcgctggccgggggctcctggggtttgtccagcttgatgtcga

SEQ ID NO: 2428 - DNA, 1328 bp, Homo sapiens
actctgtgctatgctacatgagaaacgcagagaaagtcatcgctcagtagaaatacagtaatagcgcatgcgtaaataggagagggaagtcgctactttacctagagattaacacagaaaagcaacaaattaccagtttacaagtaaaccctttatctaacgcgaagatttatttattttttgagatggaatcttgctctgtctctcaggctagagcgcccgccaccaggcctgattcacttttcttttggttttttagtgaagacgggatttttcacaccatgttagtcaggctggaattacccaatccgcccgccccaacctcccgaagtgctaggatttcacgcttgaaaccccgagcgcgacctaggtttaacacatcaaacgcgaaaccaggccgggcgcggtggctcacgcctgtaatcccaccactttgggaggccgaggcgggcggatcacgagctcaggagatcgagaccatcctggttaacacgttgtgaaaccctgtctccactaaaaatacaaaacaggccgggcgcggtggctcacgcctgtattcccagcactttgggaggctgaagcgggcggatcacaaggtcaagagatggagaccaccctggccaacatggtgaaaccccgtctctattaaaagtataaaaattcgctgggcgtggtggcgggcgcctgtagtcccagccactcgggaggctgatgcaggagaatcgcatgaacccgggaggcggatgttgcagtgagctgagatcatgccattgcactctagcctgggcgacagagcaagacgacgtctcaaaaaaaataaataagaaataaaaatggaaaacattagccgggggtggtggcaagcgctcaatagttccaactaccccagaggctgaagtatgaagattgctgaagaccacatggagatactacgctccgtgctcagttataaaacaaaaccttctctcaacaagacactcaaacacgcgtcattcaacacactagcgataaaaacacctaatccaactcaaacaacaagaacataactatttagcttgtaccctaactgatcgaaatcttccattaaacaacggttgttctctccccgaagggagagtgcaccgttcctggaagtactgcaataccaggtcgatgcgtggagtggacggagcaagctcctattccatctcctatttccaaaaatccatttaatatattgtcctcggatagaggacgtatcagatattaaactgataagaacagatactacacttgatcttagccaaaaggccgagaagcgatacctttacttcggtcgcctcggcggc

SEQ ID NO: 2429 - DNA, 1165 bp, Homo sapiens
tcggtcgcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacgtcaaggtgcctgacttctctgaataccgccgccttgaagttttagatagtacgaagtcttcaagagaaagcaccgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtacgtcatagaacccagaaggaaattaagcaggaagctgcagttgaattatcacagttgagggacccacagcatgatctagatcgagtaaagaaacctgaatgggttatcctgataggtgtttgcactcatcttggttgtgtacccattgcaaatgcaggagattttggtggttattactgcccttgccatgggtcacactatgatgcatctggcaggatcagattgggtcctgctactctcaaccttgaagtccccacgtatgagttcaccagtgacgatatggtgattgttggttagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagccactgttaagcactgttatgctcagtcatacacgcgaaaggtacaacgtcttttagctaattctaattaaaaattacagactggtgtacaagatacttgtgaaatctgtaactgactttattttcttgcccaaatatttgcttcctgctttgcgtcaggg

SEQ ID NO: 2430 - DNA, 448 bp, Homo sapiens
ccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccac

SEQ ID NO: 2431 - DNA, 912 bp, Homo sapiens
cggccggctcgccgcctgccttctcttgtgctggtggtgctgctggtagtgaccgtcgtcctcaccttcaactgctggagcatctcttcttgccacgtcctgcttcaggaggaggtggccgagctgcagggccaggtccggcgcaccgaagtggcccgcgagcggctggaaaagggcaattcggacctcttgctgttggtggacacgcacaagaaacagatcaccagaaggaggccgactagggccgcctcaacagccggctgcaggtcagacagggcctggggaagagatgcgaggatgacaaagttaaactacagaacgacatatcatatcagatggcagacatacatcatttaaaggagcaccttgccgagggcttcgtcaggagtttcttcgacaagaagaccagcttcaggactataggaagaacaatacttaccttgtgaagaggttagaatatcaaagttttcagtgtggacagcagatcaaggaattgagagcacagcatgaagaaaacattaaaaagttagtagaccagtttttacaggaacaaaaggaagaggccctcaagattcaatcaaatgacggaaaagaactgggtataaacgatcaagtagtacctaaaaatattccaaaagtagctgagaatgttgcagataagaatgaagaaccctcaagcaatcatattctacatgggaaagaacaaatcaaaagaggtggtgatgcagggatgcctggaataaaaaagaatgacctagcaaaagtcgatgatcttccccctgctttaaagaagcctcctatttcagtttttcaacatgaaagtcatcaggcaatctcccatcttccaactggacaacctctctccccaaatatgcctccagattcacaggtaaaccacaatggaaaccctgg

SEQ ID NO: 2432 - DNA, 2044 bp, Homo sapiens
cgtttatatgtctttctttggaaaaggccctttaaaaatagataaagataattttgttaggcctcaagaattatattggttttggtttgtaataattaggctttttgattcctgcatatgattcatttttatgtcacagaagtatgtaattttaaaaatcaaatcaatatttcaatcatgtccttaattactatactttttaaagttttcaaattagaacatatataattattaaaaatcaactggaaagtttagaattataacttctaaagtaataaaatattaaatctcccatcaatcctatttcttgccaactaattccccacaggtatcattgtacagtgtgtatctgtcctatttctccatttttaataatatatacacacaatcaaaatgttttaccaagatatacatcacgcaggctgaactcctacttgttttgatagctcagccagtcttccttggtttaccctacccagggacaaacatgaccctacacctgtactctcttccacctaccactcttgggcccactctttacccctgatcgcactcactatatcttacaccaatttctccttctcaagaaataaatcttcttacctatctacataggtaaattaaaaaatcttcttacctatctacatatcttgtaagtattttaattttctcaacactttttactcatacttatggttcttttcctttaaaaatattaaggaaactctgctttaactaccctcctccttgaccagagtgctacatcatctgcagaaatatttgagtttatatactaaaaactgaagaactgtctaagtcaacaaaataacaacatagtgactgggtcggggagggagaggcaacaagaactctcaggaacaaatgagcataattgcaaacatacacattttgaaaagttgcataattaaaatcttgtatcgaatatcctaatttcccagattattttaagtaaagcaatttggggcatttgaaaatacagaggaagcaaaataaaaaagctcttacggtgatgattccagaacaatgctattagcttgtgttgatgacggagatctctgatttacaaacacttcgcttggggaagtatgaaccatatggtctaccaaatgaccaactgaagatggtcgtaaccgggttccttcctgcgtgaatgtagaatttcgactaaataaagagggagaaaaactgaataaaaatatgcttcaattcaaaatttccaagtttcttaatatatggttacatcagaaagggggtatgtgtttttaagtcaagccatgttgactaagcaatctctgaaaaagacagtgtgatataaacagagggaacagagaatgggaagtcagtgatctgagttacaatcaacaatctgccaaggattctacccataaagttacctactatctctaagtgccttcatgtttctaggtgttagtcactatgattttgtcttactcagcatttataaaataaagggattagaataaatcatttagaaatatattctagtctgaattattttttaattgttataaatgtttttatttatgggactttctttgaagccttagagtagatactgaatactatattgccatcctcttgacagtcacacaaagtagtgttattacaatttttaattacaatatttcagtatttatgtatgtgtcagacatttctctaagcatttcatttaatcctcataacagtactataagaaagacattattataaatataattttgtagatgagaaaaatgagacagagattaacttgcccaagttcaagcatacagtgattccagggcccatgctcttaaccaccaccttgtactatctcttcagaattttaaaaaatctttttagattatacctgaaattgtttcattaaccagaaaacttaaacagagctactgttaattagttacttgagtactttggcttaacttgctattattttctataacttgctattattgtttagtgttgctggtacaaatggagaaatggctgtttgtgcaaaagg

SEQ ID NO: 2433 - DNA, 2685 bp, Homo sapiens
ttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtg

SEQ ID NO: 2434 - DNA, 13871 bp, Homo sapiens
agagccctgaagctcaagcggagcccgctggccgcaggggccgcaccacgccccagaccctggagtttccgggtgcgcagacccttgccatcagcagaggctgccgctgcgcgtcccctaggcgcggaagaggcggctggtggtccctgacggcaaggttttatacattacgaataaagctggcacgtttccatttctcctgggcaaatatttagaagaaaagttgctgggtaattggtggagacaaggtttcgccacattgactgggctggtctggaactcctgagctcaagcaaccggccctccttgacctcccaaagtgctaggattacagagtcacccaggctggaatgcagtggcattgtcatggctcaccgcagtctcaaactcctgggcccaagtgatcctcccactcagcctcctgagtagctgggactagaggcacatgcaaccacatgcagctatttttttttaaattttctgtagagacagggtctcactgtgttgctcagtttgtctcaaactcctgggctcaagtgatcctcctgccttggcctcacaaagtactaggattacaggcatgagtcaccacactcagctgaactctactctttatgttcaggaaagcactggagaagagagaggacaagagaaacaggtccgtagtgacaggagcctaggaatagagcaggccttcagtcttggtgaaaaaataaatggtattctaagccttcctttggacattaattcagtactacccactctttttctcttgtccattcctcccttatattttttttataaaatgaagaactcaatcccttattttttttttctatccttcaagtgaagggcaagaacaaagagtgtgggggagattttttttttttttttttttttgagacggagtcttaactctgtcacccaggctggagtgcagtggtgctatctcggctcactgcaacctccgcctcccaggttcaagcgatcctcctgcctcagcctcccaagtagctgggactacaggcctgcgccaccgcacgcagctaattttttgtatttttagtagagacgaggtttcaacatgttggacaggatggtcttgatctcttttttttttttttttttttttttttttttttgagacggagtctcactctgttgcccaggctggagtgcagtggcgtgatctcagctcactgcaagctccgcctcccgggttcacgctattctcctgcctcagcctcccgagtagctgggactataggtgcccgccacgatgcccggctaattttttgtatttttagtagagatggggtttcaccgtgttagccaggatggtctcgatctcctgaccttgtgatccccccgcctcagcctccaaaagtgctaggattataggcatgagccactgcactccactgggggagaatttttttttttttgagatgaagtgttgctctgttgcccacgctggagtacagtggtgcgatcttggcttactgcaacttctgtctcccgggttcaagcatttctgctgcctcagcctccctggtagctgggattatgccaccacacttggctgatttttgtgtttttagtacagatggtttcgccatttgaccaggctggtctcgaactcctgacttcaagtgatctgccagccttggcctcccaaagtgctgggattacaggcgtgagccaccgcacccggccacatgtagtattaaattgtgtatttgcgcctggaggcagtggctcatgcctataatcccagcacttggggaggccgaggcgggtggatcacctgctgaggtcaggagttcgagaccagcctggccaacatggtgaaaacctgtctctactaaaaattagccaggcatggtcgtgggtgcctgtaatcccagctactcgggaggctgaggcagagaattgcttgaacccggtaggtggaggttgtagtgagccaagattgcgccgttgcactccagcctgggagacagagtgagactccgtctaaaaaaaaaaaaaatactacacgtgtgaattagaaattctaagctgagaaagctacttaaaattggtcaagaaaaagatacacattaagtataagaaagttggcatggctatagtagtatcagataataggcctcaaaacagtgtatatggcaggagataggtaacagtcataaaagagcaggtcattaggaatttgcatatacatttgtcactacagggatacattctgagaaatgtgttattaggtgattgcatcatgcaagcatcatagagcacactaacacaaacagcaatggggtagcctactacatacctaagttatatggtatagcctattgctcctaggctacaaacctgtatagcatattatatagcatatagcatacctgtattgaatgctgtaggcatttataacacagtggtgtttgtgtatctaaacatagcaaaggtacagtaaaaatactgtataaaatattaaaaaatggcacaccggtataagatacttgccatgaatggagcttgtgggactgaatttctgggtgcatcagtgagtgagttgtgagagaatgctaaggactaggacattactgtatactgctgtagactttacaagcagtacacttaggcttcactaaatttatttttttaagttttcttcaataataaattaaccttagcttcctgtaatatttttacattataaacttactattttttatctttctgaattgtagtgactcttcacttaaaacgcaaacacattatatagcaacacaaaaatatttctgtccttattctataggcttttttctatttaaaaatttttttgttttaaaaatgtttgttactttttaaactttcttgttaaaaacaaacacactttagcctgggcctacacagggtctagagtatcaatatgtctgtcttttaccgccatatcttgtccaactggaatgtcgtcttcaggattaaaaatatgcatggagctgtcatcgcctatgaaaacaatgccttcttctggatacctcctgaaggacttgcctgaggctgttttacagttactttttttttttaataagtagaaggagtacagtctaaaataataatacaaatagtacaataaattacataaactagtaatgtaatcacttattattatcacctattacgtactatacataattgcatgtgctatacttttatacaactggaagcacagtaggtttatttacagcagcgtcaccacaaacacctgagtgatatgttgcatgacaacgtccacaagtgataggaatttttcagctccattgtaatcttatgggaccaccattgtatatgtgtccatcattgagtaaaatgttattacatgacacatgactgtgttcatcaggaatatgtatgctagtatgaacctataatgagagtgttaaattttatgaagcaaaaactaacagaacaaaagaaatagatccacaagcataattggaaatccacaattatatctcagtaattgatagcacttgtaggcaagaaattcagtagtatatgtaatcagctcttcatatatgcagattcaaccaatagcaatgcacaaatattcagaaaaaacacaatgacagtaaaaaaatacaaattttaaaatacagtataaaattatttacatagcatttacattgtattaagtattataaaaaatctagagatggtttaaaatatacagaaggttgtgcataggttatatgcaactactacaccattttatataacaaacttgggcatctgtaggttttggtatccacaaggtgtcctggaaccagtcccctgtggatagcaagggacaactgtatagaagatatgaaccacaccagtcaacatgacctaattgttgtttacagaacaccatacccacaattgaaaaattacattcttttcatgtacctgaacagtccccatgatagactattggctggaccataagtcacaataaacttcaaaagattgccacattacagggaatgtgcattagaaaccaataataagaaacctatacagtccttcaatacatggaaattaaataacacacttctagatctacagatcattgaataaataaggggaaaatgttttgaaatatgaaaaagtgacaacagcatatcaaaattggaaggatacagctaaagcagagttgagaggaatgttaagtacttaaataaaaaaaggagaaattcatagcagcattattcacaataaccaagaaatacgtacaacccagatgttcatcagtggatgaatggataaacaaaatgtggtaatatgatttggatatttgttccctcaaaatctcacacggacatgtgacccccagtgttggaggtggcgcctagtgggaggtgttggattatggggtggatctcatgaatggcttggtgtcctccacatggatatgagttcatcctatagctagttgtttaaaagagcctggcacctcctccctctcccttttgttccctcttgccatgtgatatgctagctctccctttgccttctgccataattgtaagcttcctgaggcctcaccagaagcagatgctggcactatgcttcttgtacagcctatagaaccataagctaaataaaccatttttctttataaattacccagcctcaggtattcctttatagcaacacaaaacagactaatacatgtggcatatacatacaatgtaatattattcagccttggaaggaaattttgacatatgctacaatgtggctgaaccttgaggatattctaataagccaatcacaaaaagataactacttatgattccactcatatgaagtatctagagtagtccacctcataaaatcagaaagtattactggtctcccacttttaggctattaacgcttgtagtgagagtttgtaggtttcttgtcgtggttgccaggggctgggggcagggggaaaagggtagttattatttcatggatatagtttcacatttacaggatgaaaaagttgtggatgttggttgtacaaaaatgggaatatacttaatgctgctgagctgtatactcaaatagttaagatggtaaattttatgttacatgtatactttgccaccatttttaaaaatgaggaaaggcttaaacaagaataataaacatgctatatgctaaaccaaaagtcaaaaaaaagaagtaaagatgggcataaatcggctgggcgcggtggctcacgcctgtaatcccagcactgtgggaggctgagacgggcagatcacgaggtcaggagatcgagaccatcctgactaacatggtgaaaccccatctctactaaaaatgcaaaaaattagccaggagttgtggcaggcgccgcctgtagtcccagctactcgggaggctgaggcaggagaatggcctaaatccgggaggaggagcttgcagtgagccgagatcgcgccactgcactccaggctgggtgacagagcgagactccatcttaaaaaaaaaaaaaaaaaaaagatgagcataaatcaattaagtagaaatagaaagcagaccattaagaaaatgaacaaaacaacaagtttatgtgaaggtattttaaaaatggataaatccctagtaagcataattaataaaatagaaaacacaaattgcccatgtcaggaataaaaatgaagatgccactacggatcctatagacagtaaaatgataaggcaatattatgaacaattttatgccaataaatttgacattttagatgaaattcatccattcctttaaaagcacagcttctcaaaactcttgactcaaaatgaaatagaaaaacagaaagtctgtatctaattgtttgtttgtttgtttgtttggagacagggtcttgctttgtcagactggaggctagtggcatgatcatgactcactacagcctcaacctaccagtatcaagtgattcttctgtctcagcctcccaagtagctgggagtacaggtgggcaccactatggccagctaattaaaaaaaaaatttagagacagggtctcactttgttgtgcaggctggtcttgaactcctgggctcaagaaatcctcccaccttggcctcccaaagtgctgagatttcaggcatgtgccatgacacctggcctaaaattttaagttttaataaataaaaatccatacatacagaaccaggttcagctccactgaaacccctgcaactcagccaaaagtaaatgtaacatggttttgaatgctgtcttaatccagggcacatgaaaaacccttaaaaacaaaaacaaaaacaaagcatacctctgccccaccgagatgagctcaaaaacaaacattacaaacaacgaggaaataaccatcacaggagggtcagcagagtaaataaataataaagttggcacctacaagaactgcatataatatgacaatatgaaagaatatgaaatgttttaaatggaaaaaaactcataatgaaagcataatacttaaaaagaatcagtagatttaaaaaataaccagagaaaatttctagaaataaaaaagatcttaagtatagagaacataacaagcacagctcaaaattaatgaacttaaagatatatctgaagagattacctataatgcagcacagagataaaaagtgaaatacagatgagaaactgagacatggaagaaaataaaagggcccaagacacatctaataaatgtcataaaaggagaaaaaggaggagaagcatcagaagaaaaagtggtttacaacttttcaaaattaaactcaattttaagatgaggaatcaaaatgagtgtcaagtaggataatgaaagtggatctaacacctagacacatcacagtgataatgcaaaacagaaatcttgaaaagaaggaagggagggaaggaaagaaaagaaaaacagaaaagacatgctacctaaaaggaaagatgattgggcacaagatgtcagaagacaggagaataataccttcaaactgatagaggaaaagtagcaattaagagtggggcaaaataaagacattttcagacaaagataaggtttttttcatagactcactggaagaatttctaaaggatgtgaatcagcaaaaagaaaaacccagaaagacagaatgagataaaattttaaatgatgagcaaggaaattggtaaatatgttggggattctgtttactaagtaatgatgattactttttacggaatttcaaaacaaattagatcaaaagcaccagacaaaaatagaaagaggccggatgcggtagttcacacctgtaatcccagcactttgggaggccaagatgggcagatcacttgaggtcaggagttggagaccagcctggccaacatgctgaaaccccattttcactaaaaatacaaaaatcagctgggtgtggtggcgctcacctgtgatcccaactactcaggaggctaaggcaagataatcgcttgaacccaggaggtggtggttgcagtgaaccgagattgccccactgcactccaccctgggtaacagagggagactctgtctcaaaaaaaaaaaaaaagaaagaatgtacctacagcattctaaggtcttttttattgctcaagaaggagataccaattagtcattaagtcaaagatgcaaggttaagagtaacttccgatagtaaagcaatacaatatcttatttttaatccagtgcaggggaaagtagaataaggagcacttaattgatctcatagaagtcaataaaacataaaagaagcagcaagtataagcctgattaaacagaaagtggggaaagagatgggtcattgagctaaggggaggcctggtgacagctcttggaagatgaagtctgaccagaatagcacataagtcaatcaggttgctgtggccaaagtgcatcgtccttgcctctctgagtttgtagtggggagaaacaacaaacccaacactaaacatggaggaaagaattaaagactcaggcctatcagtttccactccctgccctcccgttactaccagtttaaaggcttacaggggctcatggatgagtgggaagtttttgtgacgtttgatagagaaatgagctgcctcttgaccagcagagagccccaggttcatcctcatgtggagtaacagggctgcagagcagtcagtgttccagagccctgtgctcacagatctagctacaatccccacctgcactgtttttagttgtgtatatcccttaatgttactgaacctcattctcttctgatgtaaaatgaagacaggcatttctgctcaacccatttcatctgtaaatggagggaataagtctttatgaaatgagacaaagtatattcagtgtctgcagtgcagttaataaattagtgtctttctacctgtttctcacaaaactgaaataaaagctggaaaattgctttgtaaaccataaggcactctgcatacaaaagagattactatgaatttttcctaagtgattaactcatgactcctttccatactcctcagcagtggcaacattgggaggctggattttggtgggatggaagataatgaggggactctggtttctggccagctccaggactggatgtgatggttaacgatacttaacatcaccacacagctcattccctagctggctcagtaactatggatctctaagcaatgtcttaacatttacgcttacatctgctaagctaagtatgtactgttccttgatttacatgccacattgattttttaaggggtttcaactgtggatcatgaggcagaagaggtgacaatgaaaggtcaggcaaagacaggagtgtccagtgtggaacacgaaatcccatcctgactataaaacattatatgctgtttattacattttaacttcagaaattatcgactccattttccatttccttgcaatatgtattgagcttttcagtcctgttttgtcatcatgcaaacaagtaaaattcttcaggatgcagacccacctaatagtactaaaaaggaatctttaaaaaatatggagatgtcttctccctatggagctacaggggaaaagacaccactctgtgtcataaaatctatttaaatggttgccgggcgcggtggctcacccttgtaatcccagcactttgggaggccgaggcaggtggatcatgaggtcaggagttcaagaccagcctgaccaatatgatgaaaccccgtctctactaaaaacacaaaaattagccgggcgtggtggtgtgcatctctaatcccagctactcgggaggctgaggcgggagaattgcttggagccaggagatggaggctgcagtaagctgagatcatgccattgcactccagcctgggcaacagagcgaaagcgagactccgtctcaaaaaaagaaaaaaaaaaagctatttaaaagaacctgatatgataaagtattgaattgagaacactcagtgaatatcagcattactctcctgttcagtagagagataactctgatcatcctcagctattttcctgtctataatttgcttatttgtattatttgtgcaaagaagtctttaacacctcatatttcaatagtaatcctaaatcctgttgtttatgtcataattcgctgccctgataatgcttaaactcatctctgtttttctaaaagacataaatatgtataaggtttctatattaagaaaaaagacgagtatgctgtttctgtttacttctatcagcataaaggtataataaaatcccatgagtggctgggcgtggtggctcacgccggtaatcccaacactttgggaggctgaggcaggtggatcacttaaggtcaggagttggagaccagcctggccaacatggtgaaaccccatctctactaaaaatacaaaaattagccaggcgtggtggcgagcacctgtaatcccagctactcagtaggctgaggcaggagaatcgcttgaacccatgaggcggaggttgtagtgagccaagatcatgccactgtactcgagcctgggtgtcagagcaagactccgtctcaggaaaaaaaaaaaaaaaatcccattagggaaatgcacaacaaaacaataatgagatactatgaatacacctactacgatggctataatttattttaaagtgttgggaaggatgttgagaaataaaaactcttttaccctgctagtgggaatgtaaaatggtccagttgctgtgaaaatcaatctggcagttcctgaaatggttaaacataatgttagcgtataatctccagttctgctcctcagatctacctgacagaaatgaaaacatttccacactaaaacaggcacataaatcttcacagaagcattattcacagtagccaaaaaatggaaacaacctaaacatccgtcagctgatgaatgggtaagcaagatgtcatatccttaccacactttagaatattattcagtcataaaaagaaagtaataatgatacacgttacagggacgaaccttcaaaacattatggtaagttaagctagtcatgaaggatttacatactgcatgactccatttatatgaaatgtccagaacaggaaaatctctcaagaaaaagcacattaacggttgcctagggctggagggcatgggggtttgaaagtgacagctaaggggagctggatttctttcggagatacatacgatctaaaattgtggtgatgcttgagcccaggagtttgagaccagactcgccaacatggtgaaaccctttctttactaaaaatacaaaaattagctgtgtgtggtggcatgtgcctgtaatcccagctatttgggaggctgaggcaggagactcgcttgaacccgggaggaggaagttgcagtgagccgagatcatgccactgcagtccagcctgggtgaaagagcaagactctctcaaaataaaataaaattgtggtgaagaatgtataactctgtgaatatacaaaaatccattgaattgtacactttaaatgggtgaattgtatatgaattatggctcaataaagtggttttaatgtgtctcatgccttaagggattactagtttagtatatggtctccagtagtggtttaatgaaattccgtgggagatctcttgagctttattcagagcgttgttttaccctcctagtgtccactccctgctgtctttgcataggagaaccacagtcctgtattcagaggtaaaagtggataagtatctcatgatttgaggatagataggtgtgatggaaagagagttgtcattcacttggtctgccctgttccctaagtgtatgtttgcaccccacacctctgtcatccttgttctgaaatgagtgctattctacctcaggaacatactgatgacccccagcactgtgaaaatcagaacagtgaatggcaagattcaaaggggccatgacaaatattagggaaatggaaaagtagaatgagatccatccattgtggatcaaacctaacagacaatggcagcaagaagtggggagagaagagaaactttctctgaagtcttgcctattctgtgcctccaacaatatgccccttccccataacttgcccaacgaatctcttcaactgtatcctttgtaatatcctttataataaaccagcaaacataagtgtttccctgagttctgtgagcacttcagcaaattaattgaacccaaagagggggttgtgagaaccccatcttttttttttttttttttaagacaggatcacgctctgtcacccaggctggagtgcaatggcacagatcactgctcactgtaaccttgaattcatgggctcaagtgagcctttcacctcagcctcccaagtagctaggactacacaggcttgtacctccaggcacagctaattttactttttattttcttgagacaggtctcactctgttgcccaggctggtcttgaactcttggcctcaagtgatcctccagccatgagccactgtaaatgtctgggaatgccaacttgaagcccagctggtcagaagttctagaggcccagacttgcaactggtgtctgaagggatggcagtcttggggactgagccctcaacctgagggatctgatgctatttccaggcagatagtgtcagaattaaattggaggatacgcagttagtgtctgctgcagaactgattgcttgcttgctggtagggggaaatccccacatatctgggggtcattgaagtctttggtgttgactcttactgtgtttgttgttttcatgtgagagcagaggaaaagcaaggaaatgttttcctctggtcagttttccagaccagtctttacagaaacacacacagagcttcaaacaacactacacttacacagccctaaaagttagtaagtacctctttcagttctgcactccaagcacttcaatgatttcagccttactgtagtcctggtgttgatttttaacatccatctctcagcaactggcaaaaaaaaaaagacaaaaaatatcagtgaagatatatggattatcaaccaacttgataaaattaatattttgcacaataatgcacctaacaactgtaaaatacatgtccttttcaagtgcacatgttatattcaagacagaccacatactaggccataaaaaaagcatccgtgaatttcaaaggatcaaaatcgtacacaatgtattctttggtcaaatgaaattaggaatcattgacaatgaagtacctagaaaacccacaaatgtttggaaattaaacacacttctatataatccataggttaaagaagaaatcaaagggaaaacgaaaatagtttgaactaactgataatgaaaatgcaccatataaaaatttgtggggccaggcatgggggctcatatgtataatcccagcactttcggaggccaaggcgggtggatcgcttgagctcaggagtttcagaccagcctaggcaacagggtgaaacctcatatctacaaaatacaaaaattaacaggatgtggtggtgtgcaattgcatggctgtggtcccagctatgtgggaggctgaggcagaaggatcgcttgagcccgggaagtcgaggttgcagtgagccatgatcacaccactacactccagcccaggtggcagagtgagactttacctcaaaaataaataagtaaatacataaataaataaaaagaaaatttgtggaatggagttaaagtagggattctgtatttaaatgcttatattagaagagaaggcctagaatcaataactacaggttctactttaaaaggctagaaaaggaaaagcagagtaaaccctcggtacccagaagaaaggaaataagatgagagaaaaaaataaatgaaatatataattagccaaactaaaagtgaattctctgaaaaatcaacaaaattgataaaaccttgggtgggcatgacggctcatgcctgtaatcccagtactttgggaggccgaggcgggcagatcacctaaagtcaggagtttggaaccagcctggccaacatggtgaaaccccatctctactaaaaatacaaaaattagccaggcatggtggcatgcgcctgtagtcccagctactctggaggctgagggaggagaatcacctgaacctgggaggtggaggttgcagtgagctgagatagtgccactgcactctagacttggcaacagagcaagactccgtctcaaaaaaaaaaaaaaaagagttgataaaaaccttagctagaattatcaatttaaaaactgcaaagacaaattacatgaaagaacttatcactaaggagcattttagatattagaagtctaacag

SEQ ID NO: 2435 - DNA, 2908 bp, Homo sapiens
tttctctcacacacatgtgtgcatgcacagacacacacacctcatgttcattctctttaccatgatgatccttggttcttttacacagcttctttcagtttaccttacaatttagctcaacacaaattttaaaaaacttatagttacaatttaatttggcttggtccacacctctaacaaatttgatacaatctccaacttacggttgcaagttagttgattatattcacttccaagtatttcccccaacatttcattatgaaaatatatccatcaattaatgctcttatctataaaataattatttttttgcatttcaaaataagttacagacatcaatgcacttcatctttaaaccctttatcatgcatatcaggaagtagagtttaatatttctatatttcttgggggagaaatggagctaaaattatatactgtatcatatacaaacctgttaggtatatcaattcatgtgtattgacaaatgcgtgcaccatgtaacagaaactcctttcaagatatagaatattcctatcactacaaatattaatcaccaaaacaatggggagaatgtctctagggcatgtcagagaccttcactgcagcctctcccattataggccaggaggccttgaaggaaaaaaatggtttagtgggccaggcctcaggcacccccccttgctctttgcagccttgaaacatggtaccctgcgtccccagctgcttcagcttcagctgtggctaaaaggggccaacatacagctcaggccattgtttcagagagtgcaatccccaagctttggcagcttacacatggtgttgggcttgcaggagcacagaagtcaagaattgaggtttgggaacctctgcctagatttcagaggatgtatggaaatgcctggatgtccagacagaagtctgctgcaggggtagagctctcagggagaacctctgctagggcagtgcagaagggaaatgtggggttggagctcccccacagagtcttcactggggcactgtatagtggagctctgagaagagggccatagtcctccagaccccagaatggtagatccaccaatagcttgcaccatgcacctggaaaagccactggcactcaacaccagcccatgaaaagagctgtgagggtggctgcatcctgcaaagccacaggggaagagctgcccaaggctgtgggagcccaccccttgcatcattgtgacctggatagatgtgagacatggagcctaaggagatcattttggaactttaagctttaacgactgccctattggattttggacttgcatgggcctatagcccctttgttttggccaacttctcccatttggaatgggtatttttactcaattcctgtacccccattgtatcttggaaataactaacttgctttagattttacaggcttataggtggaagggacttgctttgtctcagatgagactttggacttggacttctgggttaatgtttgaatgagttaatactttgggggactattggaagggcatgattgtgttttgaaatgtgagaacatgagatttgggaggaactagggtcagaatgatatggtttggttttgtgttcccacccaaatctctccttgaattgtaataatccccatgtgtcaggggtgggaccaggtggaggactgaatcatgggggtggtttccctcatgctattctcatgatagtgatttataacagatccaatggttttataagcatctggcatttcccctgctggcactcattctctctcctgccaccctgtgaagaggggccttccaccatgattgtaagtctcctgaggcctccgaagccatgcggaactgtgagtcagttaaaactctttcctttataaattacctagtcttgggtatttctttatggaagcatgagaatgaactaatgcacagggtaaaaatttaaaaacaaacatacaaatgcaagtaaacaagccaatatttcaactgttcccattgcattatccttattctttatctatggtaccagaaaataatacatctgaaacaatttttttttcctgccatgatgtacactcaagtgggtccactggggtttctttcagtttcccaaatactagatatgactcttccctataccttatcttcatatgaagaaagctatgagaatatattaataactgaatatagtaacactactataggaataagcatgtgtatattccaactgatcttttaaaacttttattttgaaatatttatagattcaaaggaagatgcaaagagtatagggaagtgctatatgccctttatctagttcctctagtggtatcaacttacataactgcagtatcatatataaaccaagaaattggcatctgtataatccacagacattactcagacttctctagttttacatacactaatttgtatgtgtgtgtgtgtgtgcgtgcacgtttatgtgtgtaggtctatgcaattttaccacatgtgtatatttgggtaaccactacaatgatcaagatatggaactgttccgtcaccactaagatcccttgtgctattcctttataaacatctccctgtcatcctttttcacccataaaagctagtaaacactaatctgttcttcatccttataattttattatttcagaattgttatataaatgtcatcatacagtatataacacatagagattggcttttgtcactcagcacaattcccttgagatgcatccaaactgttgtgtatatcagtaatgcaatatgtttaatttctgtgtagtattccatggtagagatgtgccatagtttaactattcacctgttgaacaacatttgtgttctttctacttttgggctattacaaataaagttgctatgaacattcatgt

SEQ ID NO: 2436 - DNA, 1569 bp, Homo sapiens
gcgacctcgggagggtccggtccttccctcggcccccgcgacgccgcgcccgggtgaggccctgggcttcttgccggtgaccacgcggccagggtggcccccagcccaggacggctaccaagggcggcccagccccatccccgcgccgcgggtcccggaaccgaagagctgggagcgggcgctccctgacaacatggcggcggcgcccgggcgcctccccgggtcccgggtgtctgcgtctccccgcgaggccgtgggcaaagccggtgccgtccgacgacaggaggcgaaaggaacccaggaccagacccgcggggcgaacagtgctggaggaccatgcaccgaccacgcccgaagcagaaccaaggcccgccctgttgccgtggcgactgcgcgcggggtagacgcaggcgccgcaagccgtgagctctcagtgcaggcgcataggctgcggggttgaggcgcattgcgtgcgcgtgcgcgctgctcacacgcggacggttctgtgcgccgcaatggctgcccgcgagtatcggagaggcggagctctcagtcttttacaggaccgggtctcctgatgccgccggtggttcctcgaggcccccttccacgcatccgccgccgctgcttcatcaggacttcatttcggtgacgcagagctttggcgagagctacggcaacagcaagaactgccggcggctcttgtgctgcagggtgaggaccgcgccgggcggaccgaggcccggggtcgctgcgcccgccgccctcccagcctgcggctccgagcggggcctgggcgggcagactcgactccccccgacgccgccctctccacccttaccccgcaaaaaggggcaaatctgctttccgggccggggcagccgtggtcggcacgcctgcagcggtctcagcgacccaaattctgcggggcggtggtggtgggaggaagggttggagccccagcaggttgtctgggcttcgtttgcttttcggcaaggtcctggcccaggccccagtccctcttggagcggaagcctctggacctgttgctcctaagaaagcaagcggcccctgacgcgttgctgtggcctggtttgaccctcgtagccagcccatgttctgtgaggcatgaagcgccacgcagacaccacgacaaagtgagatgaactaagacctcttcttgattctaagcagggaacgcacagctcaccctgtcacatgcagcgatcataagctgagaattaccctcttccttcccacagcgtctaatctttttttatgtttttgtggcaaggtctcgcttagtcgcccaggctggagcgcagtggcgatcatggcccactgcggcctcgacctcctgggctccagcgtgcgtctaatctagaaccaaatcctccttccttagatcatcccccaaatcacccaactacaggtgaaatcctgtaatagtttcctccgaacaccctgttgctgagacacctcaacgtctcaacctggtgtgtttgtacgtagagtaaaagacccaacttgtttaactacaggcgtgtttgcagtggtctttggcttaag

SEQ ID NO: 2437 - DNA, 3222 bp, Homo sapiens
atttctgtctcttctaagtgagcacagtaggtagggaactcaatggaagcagtgtgcacacacacacacccttagtagaatatggagcattattctttaccaaaagtagctattctctgccagtgtactgtttacagtgtaaattgattgtcctccgtcaaaatcaagtctaagcggcattttacttttcttttcttttttattttccatttttgggtgttctagataggattattatcaaaagtaggaggaaaaagaaatgtttgtgagtgcaagattaaagacagagcgcatgagcagagtactgatggtgtgcgtgtttgtgtgtgtgtatatgtgtgtgtataagagagaaagagaaatcgaaaagagagagaaatttcaacttgttttcttttaccagagaatccaagaagcagtttaaggaacctgatattggagtttaatctagaaactggatgatctcatattgattcatgatgcttaatctttcattgaaactccacaattaaaataacaaatagagaaagaaaactaactttcctaaatatggcaaagaaactaacacctcatttatttttatttctttgtaaaaatataaatatctcaatcaaaagtacaggctcatttgtaattatgtactcatgattgtaacagcattgagatttcatataggcacatgtatagcagctgtttgacagtgatggctcttccatgtaacatagcagttatcgtgtaatttagtgccacttattgcaaagtgttaccaaggggaacatttcaaatgccttttgtttttctttggacatcaaggtaatttagtggacaacaaatattaaattttacattatgctttttaattgtggagaaaatgcaaaacctcatgtcttaccacaactttcccatggtattgctaattacttagagtctctaaaattgcccaatattatttccctttgcaaatggtaatttctgataaaacaatacaaaacaaaaaaaaagcagtaatcacagccaaataaatgaaacacctaatgagaattactgttgagtaatgctttttattaagtggcacaaagtacacactaaaaactatgcaaaatataggtaactacagtgtacgtacatgtaagtatcttgtacttgctgtgtatggatgttggaaacccatgtaattataatatgcattttgaatattgggaaagaggaaatcttagtgtagataatagaatttgttttgaaatatacactggcaatattgaaatatactcagtgcaatatctgcagttctattgctggatacttaatgcaaagggattttaaagaattcttcagcaagatccaagaggttgctaatcttcacctctcacatactaaagcattcattaaaaatacaactaattcaaggacaagttaagtttttcttattaatgtgacacagtaacatttttatttggattagtttttggtgttattgcagagaaagaaataacctgagttttaaatttcgattcatatctcattgaattgggaattcttcaattttgtttgaaatgtgtgcatgttttcatagattgtagcaagtacaaatgtattcaatgaaagaacatagggtagttttaatagttaaagtcactatatcttaatgggaattttaaaatatcttttctttttctattcattttttccctttctctctctattctacccccaaacaagccctttgcactcatacccttccaaaggcaatggattgaaagtagcaagataataaagagagttaaaggggacaacatataacaatgggttctaaaatcatcagcatttttatgtattgagattattaatattgaatgcaatagttattggatatagctggtaagttctctgccatgcatacttacaataatccttctacctctcacttttaacatgggctatgatacttcaatataaatagaggaaataattatttaccagatatcccaggaagcattcttatggaactattataacagtgcactccccaccccctgggaaatctcaaaagccaagttcttcagtgtattctatggtgtatgaatctgcatttgtttttccttttctatcattagcttttcctaaaggcaaaatattataactttataagaatagtccttctcctgcctatttaatatttcaatgttaatataattgtattggtttttaaaaataattaaaatggcaacactttgcgatccaatctgatatttaatttttaaaatgtaacaatttcttataaattcatgctgtgttttaagtaaaaatcatgtatatgaattattttaccaagtagtattatctgcacgagacaaatttaagtattttaaaaatcatccttattaataaataatcctcatataatgcacagtattgccacaaatgcccacttcattttgtctgcatagacatattaagaatttttcaatgatgtaatttaattatcctaaaagaaatgacagattcttctgtaggaaaaaataaaaacatgaatatctcaaattataatggttaatctctaaaatatgcttaaagtaagatgtttctatgttatgtggttatgttatcaataatatttggttgatcttcacatattttatatgcatatatatatcaagaagttatatatatataactcaagaaactcaagttatatatatatgtcaagaaatgtatgattattttggagagaatgggcccaaatgtgaaaaagatataaaaaaaacaaaaaaaacaaaaaaaaaacactattttcccctacgaaatatactgtatatttcaaaagaagaaaagttaaaagatatttgaagattgcaggggcaaaacaaaaacctaccagggctcagcacttaagcacttttcccacatccagggtcaaagcagcagtaactacatggacttttaagtgcggtatgaaatgcaacattacgcttacaaacagtactgtcaaacctcaaatgctttctttcttcagatgctttttcgtgtacatgatactagtagacacttttctctttatatttactgatagtgaaaatcatacgcaataaaatattgatgtttgaaggcagtggtcaccaattggttaaaaaactatgaaatgtaaactgaattgttatatctctatcctttttgcttttctctgtgtttttaatgtatggaataaatctcataaatagaaag

SEQ ID NO: 2438 - DNA, 3104 bp, Homo sapiens
cactcttgggggagctggtggcctggagctgcggccggagcctgctggagaacagctcagaaggaaggatggagatgaatggccgagtgccctgcttgctgacgcaccggtggatttttgcttctgctgttatctcggctcctggtctctccagtccaacaagaggcctctcatccacagaagcagtcctactgcccagcagacctctttcagagccttccagacatggctgacccctggcaagcaaggggctttttgagctgagaggcacttggctgggacttcaggaattcatggacagggctggcagatactgcatatgtttgagctgtagatgggattgagaacagaaagttgaaatggagacttattaaagttaccgtggagaactgctcaaaaattcattttgaattaaggaaacttaaattcattttaagtttccttagatctaaatgcaactgcacattacactcaaatatgttccttccttctcacacacaggactcccttgtgaaactcaaggggaagttcaagttgtccatcttcatctatgaagtagtcactttatcactgtctttacagattgcacagtctggggttttgtggtttctcttgtctcactctccagccaggaagaacttgtcatttgagtttttaaaatgtatcatttcttccccacctcaaaccacttgtatcccagtttctcatttaaagggagaaatggttatatagtcctctctttgcacctgattgaattataaatgatagaaacaagatggctatacttatttaggaaaaatctcttaccccaaaatgagtgtgtgtgtgtgtgtgtgtgtgcgtgtgtgtgtgtgtgtgtgttttaatcaaagatcttttctggaaaaaactttccacatagttctctgacccattagagttgaagaaactatgtattttgggattcagagtagaattggcctgcaaatctggggtgtttattccttttacaagtctatcataattgttctacatttaattttcctttcttgcttaaaagtaaacaaggagagtcaggagtggtggctcatgcctgtaatcccagcactctgggaggccgaggcggatggatcacctgaggtcaggagttggagaccagcctggccaacacggtgaaaccccgtctctactaaaaatacaaaaattagtcaggcacagtagtgcgcgcctgtagtcccagctacccgggaggctgaggccgaagaattgcttgaacccgggaggcagaggttgtagtgagccgacatcatgtcactgcactccagcctgggagacatagcgagattccgtctcaaataaaataaaataaataaataaataaacaaggagaaagattagtttttagtaataacattgtgtccaatttccatgttttaaaacaaaaattgaggcattatatgtcacaactgaaatggaaaagttgtgtttaaaaattatggacaaggccgggcacggtggctcacgcctggaatcccagcactttgggaggctcaggcaggaggatcacttgaggtcgggagtttgagaccagtctgaccaacgtggtgaaaccctgtctctactaaaaatacaaaaattagctggtgtggtggcaggtgcctgtaatcccagctactcaggaggctgaggcaggagaatcgcttgaacctgggaggcagaggttgcagtgagccgagatcacacctctgcactccagcctaggtgacacagcaagaccccatctcaaaaaaaaataataataaaaacataaaaattatggacaagaaaaaacactattctggaagctttgttttggcaacaaattatatgacctgacctttcataagtcatttaaactttagggctaggccaggtgctatggcgcatgcctataatcccagcatttagggaagtagaagcaggaggatagcttgaggccaagaattccagaccagcccaggcaatatagcgagacccccgtctccacaaaaataaaaaataaaataaaaataaataaatacataaactttaggtcctctgtttattctgtcaaatgaaagtgttaggccaaggtcgcattatctctttggaaactacatcgagaacagaattcccatggaacgaactcttaatagttcactggtagtcccccttttctgaatattcttcccaacatgacactttataacaaaaatttaactgcaaaactctttttttttcaccaacagccagattttgatgagaaaatggccatatttatttactccaaatatatattatgtctgtgataatttgcctaaactgtttaaggaatattaacaagtatgatactgcatcgtggtatgtagcaaaaagataggtaatctgacatacatggatgcaagcagcatggctgtgaacctggatatatttagaaatgatcttcagtggagtccttgatgtgacattttccactaaaacattcttctaactctggtatatcttagtgtttcgaactataatttccgtcttcaagccaagacagcagctctacatccttacctaggtaattcaggcatgcgccagtattttggaggggtccaaattagagttagttatgatggtatagatctttaaagtatagtctaaccaagcttgctctggtcttttgtgacatcaaggcttctcagtctgtattcacataaagttgaaacaactaatcaattcagtgaaaaaaaatcagcagatttcactcatacactggtgatatataccactggtattgggtacaatgtaaggagagaggattacccatctcttcagttacttgtaaaatatgattttaaaaaaataaatcaatacattttggaaaaattatatgactttgtgcttatatttatgcaacaatatgctagcttataacagggttttactgtgttattttgatagttgtttaaattttacatttaaactatttgtattttggcatcccaaaacataataaaacactgcaaaaagttacctctgtaatataagattttgtataaattttataaatttgtgtcatagggtaattttgtccaataaaatgtcaatgagataaaaac

SEQ ID NO: 2439 - DNA, 6109 bp, Homo sapiens
gtgtcacgggccgaaggaagtcagctgtggggtagatttgtacgagatcgctggaccctaaggaacccagaaaatgcaagcaagatgactaaatgactagcaccagtctatttgggaactaaggaatcaaaagaagaggagaaaggtactatttttcatttcccccaaaccctcacaaggacaataatgtttgtgtgtatatgcatgggtgtatttgtgtttacacaaaaaggggtaaaaatgtaaagcattaataaatataagtgctgctaaactgttagaataccagttagaggagctaataaagcaatattcaaagattgaggacttttaggtggtcattagaatgagccgatgaaattgcgaagttcatgtagctaaacataagatggcaaaatgttgggatttttattataaaaaaagcagcaaacatgaaaatcttttatcaagatatccaaactcttcttactttataaagttaactccaaattataagatacttgttgagcttttataccatgatatagatgacattaaggactgaatctttacttgcatacttcatatgtggcttaaattgtcaggcactcagtctgtcatttctcactgcagaaaattttatcaaacacattttccctagcattttatgaaatttaatggaatgcagcactgcaactgaaatataatactgtccaaaagccatgtatgactttataatatatactttatggtatcacttaactttgtacaataacttcacctatctccttaaagctgggattaagggaaaaagaatcagtcaacaagaaggtaagttcacagaattatcagccataatagtgtaaatttgccattaaaattagaaaaataaatagatgaaatttttttcattcaaattttcataaattttctgatgcatatgaactttcaaagttaattaaaatgctatgaacttatatttttaaaaacttactctgcaggctcaacaaaataattaaaattgtattttctcttaagcactgctttttttttttttttaaggtaacatttctaagagcaagttggttaagctctccagttttcctatgacagtatgttgtttagtttaacctactaattcaatcaggcatttctattgattcacctggaaaaggggatacaacagaacatttttaagaggtcattttagcagttttattcaacagatgccataaattaactacattcaggaaaaaaaacttaaacaaagaacaaagccaccctatctagcattctctcactcacaaagaagtatcaaagatatgtttatgttccattaaccgagtatgaagcaaaatcattaaaatattacaactgctaaacacagaagactagaaatcaaatagtttcatatccagtatacaggcatcaaaaacttcaatttccagctgttttttttttctaattcatatcatggatttacttacaaggagcttattcctatgggattaattcaattactcaatggtaaatagattttagctcagaatttttaaaggatgacttgctttaagttactattctacgtgctgctctatttctgctcacacttgcatgtggccaaacagatcatgctctgatcagataagtatactgtaatctacttatatgtttaggagttggcatagggttaaaaggcacaaagctgtattttagtactcatttttcttattacttatttgtaaaggaacttctttggatcctgcttaaatgatcaccaagaaactgcaaatttctatgggggaaaatgtgagtcctcttcataaattttagcagcccttcaaggacatatacatcaaaatttggtggcctttaaagtattggaattttaaatgacataactgcactttactgttgaagacccttttagtttaatatttatagccatttcctcatattttctttaaaatttatcagtatagcatttcatttctatgcatgtatatgtatagtaattcataaaactaaatagcaaactgatattctacaccagttcatttatctcaatatatattttggaatataacggcaatattaaaaatatcaattccctctaagctgataatactataagattttacacaaagttaaagtttttgttttttctttttgaaaaagtttcattgtttaaagtccacatatttgacaccttgataaggaaaatgtaaatgtgtcatataacatttattccatcaatttaaactgaagtgtctcatggagctaaacactaaaagaatttaaataaaaaagcagtaacctgtatgtacacaaaatgatcattccataaatatttacatgacaagggaaaaaatggagaatcactaaaactggaaattgctacaggtgtgataatcctttctcatgacactttagttaggaatcatgtaagcttttaaaatgaaaatacttgtagaagcgttaactaaaatattccattttagttttcagttactatttaaaggagccagtaggtcataaacagtccaagatttcaggaaccaactattcagtttagttttcagtatcaaatcttttccttcatccctcatgatgaaaccaaacttacttacagaaaaaataaagagtacgctaaaaggtataaataaaaattccagttcatcctcctttataaagactggtaagccgctctaattctttacagttgtccatgctcaaggcatctgccttccttcggagtcgatcatcacggtatacttttgctgcatactgcatatctgtttctgttaataaagaaaaatattttgctaattgaataaaatttttgtcacctagttgcttaagctcaagtgatgctttacaggagccctttgatatattttgattaactgacttaaaaaaaatcaaagtacaattcctaaaagccattttagtaggaaaaaaattttaatgaaaactttatttgaagtatagcaggtaaaacaaacacagaaaataaataaggatagaatcctgtcaactcacgttggaatcctttctctctactcctgttccccagtggtttaaaaactattcctctgaagcatcatcttggactcttttcctaaaaatattatatgcttttcaatactgccagtggttgtttcactgtggccttctgttaagatttcagattatcccaagacttaagtatttaataaaaaatttaaaatcttgttctgagtttacttaaattaaaaaatacatataataatattactgaaggaacacagataaaaaaaatgcttgttatacgatcgtaatattgctattcagcaaataagtacttctgaggcttccttcagtgtgtgggacagcacagctactaatgatatacagactacaaatcaaaattcttcaaggagtatttcttgttttttcctgttactctcagtcatttcactgtttattaatacctgtaaagactaggagcacttaaagaagatgtaacagaaaaagaaatcagttactttctggaacacaatggccaaagtagaagacatctggtttatatggattagtcaagatcacattcaagatatactcacagttaagacagtattccatttgtaaagatctccagaaataatctttactaaatcaactggactaggattaacaactcaatcaatattatcctatgccttttatttacacataatgcgcttatatctatttacagatgactcttcccaaagaagaaatttgagacttagataaaccgaagttcacactgctaacgaatggcagagtctagattccagtccaactctccaatgcctagcctaatattctttccattatttcaagtactgcttgggctggataatttttttgttgtggggggtctgtgcattgtaggatgtttagcagcatccctggccttaacccgctagatgctagtagcaatccctttccattcccatcccatgatgacacacaaaagtatctccagacgttaccaaacatctctagggatgggtggggtgggggaagggtggcaactcactcccagctgaaaacataaaaatcactagtctaatgtaagcttctccacactgaggacagactgatttcacaaactcattgagttagaagtcaaagaggtcacatctctaactgccactaaatagaggagaaaaccaagaccagagaggttaaggactctcttagaagttacattttatcaacttttccctagcaagggggagatgatgataattgctgacattttctgagcattcactatgtgtgaagtactttattgcctgatttaattttcacaacaaaccccataaagttggttatttctgagaagacgttggagcacagggcctggattctagagacaaattgtctggttttcaatcacaaacgacctctatgaccttgggcaagttagtaatctctctttgcttcagtttcttcatgtgtaaaataagtataatctcacagggttgttgtgaagattaaatgagttaatacttacaatgtgcttgggacagtgactgaaacaggcattatataaatgatagctattatttcctcctcccactcatcatcacccattttacacatgaaactcatagaggttacaattcgtcagctaaaaatttcagagctaggattcaactttactcagtttaattccaaagtcagttctcctaacactacactatatggtctacattattattcacaacaatggtcacaaaaacaagaaccacaacactcaattcacatgcaacatctcagcagattcttatatcaatctttatagatggaactgttccttaaattaagaaaactgaggctggaaaagcctaagcaaatgaagtgttctgaagagtctctctgtgtacaaagtaaagaaaaaagaaatgtcaacaaaactcattgtacattaaattctaaatacaaaagctaaattaatagagtttcaaacttaactctgaaaacagtatgcatcttaaaattgatgacatagtttatctgccaggatattttttgtttcttggtggtacataaaagaatgatgtgtcttatgatggatattatcaatacaataaaatttggtattacttattcaaccaaatatttattgataacaatagacaagtaccatttattaagtccttactatgtgtcaattccgatgttaggccacatgtatataaaacacatgatctcatttaagtactgtgctccaattatgtgccagggaattccagaacattccttgaatagggaaatctacattaatcagttccaaagactgcgaataagttttaaaatgttaaacacatgacaaacttactttgttgtctttctttccagcagttatttcgaatattagtcacataatcttcctccacactcttttctaccttttgtaataacattcctttatattcatttttgaagtccttgttgacataataaacaacacccaagttttctgtttgcattttaatagtttgcccagttccactgtaaaagagatgcatcattattttaattaaaattggacattccaatatgctgctataaaccaagcaaacaaaaacaattaaaaatcattgaaaagttaatattggtaatacaggttgagcatccctaatccgaaactctgaaatccgaaatgctctaaaatctaagactttctgagcatcgacaagatggcacaagtgaaaaattccaaagctgacctcatgtgatgggtcaccttttaatcaaaacacagcatcataggtggaaactaaaagcctgtagttgtttgtcgttgctattgtttaacagctgacacgggtattctggtgatgctaatatgctggtggttatttaaacctgaatacattattttttcactgttaaatacttatatgtgaattagagtaagaaaattattgcttatcagtagcatataaattcagagtcaggaatgatgccaaacaaccacaggttgtccacatgggtggctgagatagtgatacctttgctttctgatagttcaatgtatacaaactttgtttcatgtacaaagtgactaaaaatattgtataaaattaccttc

SEQ ID NO: 2440 - DNA, 3618 bp, Homo sapiens
gcccgcggctacggggctggcgctgccggagccgggccggaccggggtccgagatctgcgtcgcgctgggcacgctggccacccggtccggaatgagtcggggctccgggaggtgcccgtgggcagagcgttaggggcgcggccgtgccggacccgccctggggacccgctggagctggaggaggaactaactagccagcttccgttcctcagcctttcttctctaaacaccaagttccaccattgacagaacactgagtcctgcacagtcacatggacacgagtaaggagagttcagaggctgcagtggagttccacacgaagcacaggaggtgaaacccctttttcctggctcctcaggagacatgtgaagacaacgcgattagaggtccttcaggcacggataggatggcttggcatcttcttccgagcaagcgcagctctcaggccgggcctgagcctgcagcctgtgtgccctccatcatcagggccccctctcaggacaggctacaccgagggtgggacggcggacttccagggacacttccaagtcgtgcccatgcagatacctcagtatacactgcccacagttaagaaaccacgacctgagacattgttttgaagaggtgaaaatgcctccactcaagtggcccaggagcgtgatccaggaagacgaacacacagaaccatcttctgcatggtttgaaaattcagtggaaactaggactccaagctgctgtcccctctctgccgcatctgaggctgggaaaacttcctaggagaaggcaagagaaagccaccagaccagagccgaggactaaactttaaggtcgaagacggcagaggggcaggttctcccctgcacaccccaaggcctctcctgcacccgcgaggccttccttgagcgcccaggcccccgaaatgcctgccctccttctgacaaaaggagggggtaggatgtgaaggggtagtgcaaccaacaatgtttttgtaaacacaacaacagggaaatacatggaggaaatctatttattgggtgtgtcatttttggtggggggcgggattgaaagtggcgccatctagacccaggaaaaagctacggggtgggcggggtaagcgggggactcttggtaaatgtggataattttgaactgggacaccattttgtttccttcctagagcattgtatgatgtggcctgaaggctctggaaagtcacagatcacacccagcaggaggttcttcatgtgtgccagcccctggctgggcctgggcagccttgcccccatcctctggccccagctcctgccaccccacctgcagacaaggctgccaaaggctagggacagggctccaagctagaggccggctttttggagatgtggctgtgggaggggaatcccaggaagttgcatagagagggagtttttgccagcctgggtcactgatggccagtccgggtcactgatgtctccccaggggcaaggggacagtgcctggctaattgtgggtttcaaaatctgtctgttgaggggatgcagaggtcatcattggggggtgaagctgatggtccacagaagctctgggcacaggttggacctctttcctgcacaaagaaccctccagggtgcccagtggttctggccagcgccggagccagtgacggttggcttgttctggccttcctccccttctcacacatgcattctcttgcacacgtgtcacacacattcctacacactcacacaaattctcacacaaattcccagaatcaatctcccacatacacatccaagtcacacactcattcttacatgcgattcacagattcacacgattcacagatgcaacagactcacaggcattcactcttacatatgacacagttgcacacttgcacacacacacacacacacacacgcactgcaatccccttgcatctccacagtgtcgaaggctggctgaacaccaaggtggctcttggtggcaggacttctcatgggagggaaagtcacatagctggaaggttactagcttagggacataatttccttattgactataatctccttatagaaattcaacaactatagcagaaaatggagaatgaggacattttatttctcaaagtcaacagttccttttctcctgcaccttcggagcaggctcctgcctgaggctgctgaggtgctctgggttctcgctgtttgttttcagcatccaggttcaggcttttctcagtgcattttcctcggctgcccttggacttgtgttgtccggggtggtggccactggcccccagtggctactgagcagggagagcagggcccctctgtggtgaggcgtgctgctcagtgtaaaacacacacgagattttccagatgcagtactcaaaagcatgtgaaactcctcagtcatcacttaaaatattgatcacaggttgaaatgattatattttagataccttaggttaagtaaaatatattattgaaatttcaccttctttttgctttctaaaaatgtagctcttaggaactttgcaattacctacatggctatttgtgtgttatcttcctgctgggcagtgtgagaccttctcacagatccttcagaaatgtcaaaggaaaagcaaaaatggtggagaaggctgagcacgtggcctcgcgggaggccggctcagagctgttctgaagttgcttttgtaacacaatctattctcaaagctccttttctttcaatggggcaggttgggggtgggggggggggggatattacaccttgtattttacttctcgattcattttctttccattttaactttaattccgtctaattactgtattgtgagctcagtcagcaatcttgcatgaactctgcagtaacttctgaagactcttgctccaagtgtttgataatgaggagatgtgcaggactaaggcgactgtgtgatgtctgcacagttcgaaagcccgctttcctgttactttcaaatctcgggtcagcattttggaacttttctgctttaatttttccacacacacctctcactgcgaccacctaccatcaccacaacccaaaacaaagcaaacaaacagaaagcttgaacaagaatttacatctgggaaaacgcttctactcatcaagagtggaattcctttttattcctataattgactcacagcttcaaaaatctgtgaagtcatactttggtcacggaagttgcaagaaaccatatttgcaaacgttttattttaaagaaggtatttaaaaatatttcacatattagccacagatttctagaagtgaagttataaaaattagaaattatattttgccttttgatgatagcaagtgaaaagagattgctccaagcatgttttcaataaattcagtataactgcaacacaaaaattctgcatgcaggcttcatacacacacgttataattttatgcatttatcttgagagttgtataattaattttaaaaatgcaacagaaatgtgaagttaagtctactttgccaataatggaaatgtctcatagataattttgaatacaattaaaattttgtttttatcataaaaggaactgtcctgttgctcattattagtatgttgtc

SEQ ID NO: 2441 - DNA, 1109 bp, Homo sapiens
cccagctgaaggcaataagctgggctcaccgctgcagcagagttctgtgctagccgggcataggggcgagagaaggcccagaggcgacgtcagagagaagcaactgcgccccggtgaagagaagctcgcccatcaccggctgggagccagctttcagtgaagatggcagggccagaactgttgcttgactccaacatctgcctctgggtggtcctacccatcgttatcactcttcgtagacatgatccgccactacgtgtccatcctgctggagagcgacaagaagctcacccaggaacaagtatctgacaggggacgaggcacccacagtccctctcccataagcctgccaagaagattgatgtggcccgtgtaacctttgacctgtacaagctgaacccacaggacttcattggctgcctgaacatgaaggcgactttttatgatacgtactccctttcctatgatctgcactgctgtggggccaaacgcatcatgaagtgagcaaattggggtttcctggggacaagggaagctctccactgggcccttttcagcatgcaagccacgggccacgtgctgcttcacctcctgttacctgcagcagctcctcgatgccacagaggacgggcatccccccaagggcaaggcctcatccctcatcccgacctgtctgaagatactgcagtgaaagcccaagccctagctttccccagtgaaggactagactaggggccccacgctcaactggtagtggccacaagcctggcagctgtagagccgctaacctcccgacacctccctcaccacacaggaccctgagtgaggaggaggggctggaaacctgggatgggttggccaaaggagaacctcaggctcctggcctggcccagctccttcctgcccaaggtagcttagcccatccagactggtcctgaagtctgtccctccattggcatgaagtctgcccctcagcagtccggcctcacaggctgtactttcatggtgctctctaccttctggcccccatcccagaacattcgtgagtgaattcgcaagcatactagcatgtgatattagggagtttgcaataaattattgatgctgat

SEQ ID NO: 2442 - DNA, 832 bp, Homo sapiens
gcaggatggacgcgttggctgtcatgatgtaggacctcctgacctagaaccatgcccggcgcagggagaacaacgagcttacggaccgggtgcgggggctgctgtgcgagaaagcctacctgctggcccgggagcgttcgccggcccacctggtggctttccctggacgtttaacggcgactccgcccggcctcccgactttttgatgcaggcgttctcttacatgactttcttcgaggctagattctcgaaagacatcctgaaggtggctttcttaattagctgcctcaccggctggcggagcagttcgtagtcgcctacatcgagagggagagccccgtcctggctcagtactggggcttcgtggacgcgctgtagcgggtcttcgccgtcgtgggtaggaaacagtcgggccggatccccggtgtctggggagcggctgccggccgggcccgcgcgagccgcttcactcctacaagcccggctcactagttccaagctgctggactttgaccctcgctgggaagcttgatcgccgcctgttctcgccaatctctatgcctttgcactgcccagcaacccggtcactgcccaggacctgttaaaagttgaatggacctcccagaatcacgccgctgccaccgccgtttctagagacggcttttggccacctttgagaatcagggtcaaacttggaagggcctgcatttgtcacacttcctcggacactaatttggatagttcaggcccagagacggcttcccggaaccttctggatttcagctttggcaagcttcctctgtttctgagacacctccatcacctgggttac

SEQ ID NO: 2443 - DNA, 1929 bp, Homo sapiens
atattttgtagctcagcattgcaaacaacagtaatactgttttaagaatgagtgttataattgcatagcatttgtatgcactttatactttgcagaggtgagttaaattattaatcattttgcacatgaaagctgtggggcatatcttttttctttttttaggtgaggaagttatgctacgactctaattaattccacgattctattgaaagttgaggaatgctgttttacccctgcgcattataaagaaaataactagaattactttagtcttcagattttctccctgttaattctgtatcttgagaggtttcttttttttttttttttttttcttttcttgcaaatgcattcttttgcattaagatggtcacaaggtaaagccctgtggcagaacctggtactttaccttaccagaggaaattaccttagaataagatggagcgagaccccagctccccttaaagacaagaccttgaaatcaaatggagtcagctatacctatcaatcaatcacagttcttggatataagaagcccatagactctcttgtttacactgtaggctttttcttaatagggttgcatttgtcagtcattgcatttacccttcttggcctggaagtagaggagatcaatgcgtagctttgaccacttccagccacagggtactaacatcagacataagttgcaaccaggtcacattttaggctgagatggggctaactgaaagtcagtgtgatgaaaacccaagggcgctattccacatgtctcaaatgattggcaggggctaacttattagtaattctcggttttgtgcactgagatatctaagacctatggcatttttttcccatttataaagctcctataattcttaagtaagtactaggtgaatgtttgaatagatgctggagaaattacactggaaaaccccacccctagatttagataagatcaatcatttaatattccccaaattaattcaggttgaattaagcatgtaatataaattcagtgaattacaaaaacacattttgtgtaggattgatcagattttaaatacagtgaaacttcattatatataatagacctagaccctcccaagcattttcccatcccataaagaattaatgaaatgaaatgcttatagagcaacgattcctgctcagaaaaatttccttataaacagctccaaaccaggggtgcctgagctagattttaaagttataaagaagtttcattgtatttttaaaacctttttaatgggtgtatttggacaaaaataacccccttttcacattttatgatgtgcaggtattacattgctttttacatgtggaaaagtgagcctgcatttatttttaaatgcagttattaaaacatttttgtattccccatcaatgaaaattttcagtgtgaacaaatggtgaatcataagacagttcagtgcttattttctgtaggttttagcaaaaaaatttataaaccacaaaatatttatacatcaggatggtaaatttacatcataaagattgcagatttaatattttccattgtctctgttctgagtgccatgcttgtaacattgataggaggtggacactaggcaactggtattagaagttcatttttttactgaaaaattcaggtacattagccatttgttattttatagtgaaccgtttcaatgtttgtttattgttatttgttggcaaaataaaagtgccttaagttaaaagtttgttttgagatccattaaataaatcagtatcatcagttcataatgcatttatttacaagtccttttattttgcatgttcattgtaaatttaatactgtaaatgtattcaaattcatttacatgcctatggctgcctttgattaaacttcttccaaaaaataaattctgcccagatgttgttgacttt

SEQ ID NO: 2444 - DNA, 804 bp, Homo sapiens
cacgttttccttgtacctgttaaacgagactgccaggtatcacatgtttaaatatcagactatttctagaaccatcggatttcctggctccattccacttttatgcttcttcttggaggcagcttcacctccactcacattccggagataagcatgaactttggtaatacgatgaagacatgcttctttcttcttccatgcccagattttttcttaatccaaaataagttttaaagtgattgggggaggtgagggggaatactaatgatttaaatttttaccaaaacccatttacatttggatggtttcactttccacaaagaaaagcaacaaccctgactctcccaaaaaaacaaaacaaaacaaaataacaaaaataaagccaaacattaactacctccccagctccactgaaaacaaaaccaaaaacaaaacaaatcaaagccttaaggatttatcaacctggagagagtgcagcccttctagactgagctgcaaagatggccctgcctccatgccttgttgaacatgatgatgcccctgggaatgggaggtgatggttttttacttcggccctagtacagagtatgctcttgaagctggattccatcagcaggttttggaaatcactagtgggtaaaaaagaccaatttgcaactaggctctcatgctctgttgaaaactatgtcacaatatcacaatactagatgctgggctcaagacagcaaacagaaagcagcaagggcagtgactggaagctgggagagagggtcaacagctgaatctcagcctgatggaggccac

SEQ ID NO: 2445 - DNA, 402 bp, Homo sapiens
gcaggtgaagaaattaatgaagactatccagtagaaattcacgagtatttgtcagcgtttgagaattccattggtgctgtggatgagatgctgaagaccacgatgtctgtttctagaaatgagttgttgcagaagttggatccacttgaacaagcaaaagtggatttggtttctgcatacacattaaattcaatgttttgggtttatttggcaacccaaggagttaatcctaaggaacatccagtaaaacaggaattggaaagaatcagagtatatatgaacagagtcaaggaaataacagacaagaaaaaggctggcaagctggacagaggtgcagcttcaagatttgtaaaaaatgccctctgggaaccaaaaccgaaaaatgcatcaaaagttgccaat

SEQ ID NO: 2446 - DNA, 681 bp, Homo sapiens
cctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtaagtgatttgtcaagcaactatgtctgctgacagttcagaaagtatctgataaacttaagggtgggggcagattcttgttgaagttgcttttgcatgtgtggtattctcaacattagttttttgaggggcacttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactct

SEQ ID NO: 2447 - DNA, 1596 bp, Homo sapiens
ggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaa

SEQ ID NO: 2448 - DNA, 968 bp, Homo sapiens
accaaccataatattacactgtatttagaacaggcttatgtaaaatgccctcatttatctaaataagttgattttttggttattgtaatctagtaaggtttttgcatcactactggtctgtcatgaagtttttctgctggcttattcacttatttagacttcatttagggaagctatttcagaataccatctcataaaatgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccataagattttcctgttccattttaaattgtcttgatatttaaaaaaataacttctacattctcaggaagaaatacatgaagtaaatcatatctccatgtctgtttccagatttctctaatctttttactatcccaatacattcctaattcctataaacgtagtggcttaaatactgaatacctggcagctcttaaagatcccttaggcagatgatgataattttcagtgtttcgtcatgtttaatagaaatcaaactgacttgtgttttaaaatacaagttgtctgctagtaaagttacatgatttaggtgtgttttaggttttctgcaacaattagctgtgaacccctaatgtagctaagtttatacaaattttataatcaaaattatttatttttatttttttagagtatgtcaaaaacatatagtgtttgctttgtgaaatacatttgcttagagttataaaatatactgtgactcagaaattgtaaagtcagtttgcgttgtaaaaatgaatactaccagcatgtcaaaagaaaaataatttacatttgtaatataaagtaaaattgtatttaatat

SEQ ID NO: 2449 - DNA, 483 bp, Homo sapiens
atgcagcctgcttctgcaaagtggtacgatcaaaggcactatgtcttcattgaattttgtgttgaagacagtaaggatgttaatgtaaattttgaaaaatccaaacttacattcagttgtctcggaggaagtgataattttaagcatttaaatgaaattgatctttttcactgtattgatacaaacgattccaagcataaaagaacggacagatcaattttatgttgtttacgaaaaggagaatctggacagtcatggccaaggttaacaaaagaaagggcaaagcttaattggcttagtgttgacttcaataattggaaagactgggaagatgattcagatgaagacatgtctaattttgatcgtttctctgagatgatgaataacatgggtggtgatgaggatgtagatttaccagaagtagatggagcagatgatgattcacaagacagtgatgatgaaaaaatgccagatctgcagtaa

SEQ ID NO: 2450 - DNA, 1539 bp, Homo sapiens
actcacagcgcttgggtgaaggcgctgagcccctcgggcacggccgtcagccccttcccggagcagtccacccgacggtcgccgtcgcagctgcagggcgccgcgcagagaggcggcgccgcgccgctgggcccggccgagccgagcagccccagggcgaggaagcagagcagccctagcgggcccggcattgctgcggccgcctcccgcgccggcctctcccgcggcgctgctcgctccgctgccctccgatgtcccccgccgcccccgggcagccggcctgcgggctggagcgggggtctcttcctcggcggtccgcgcgggctcggccccttcagcagtccgccgcagcggcgcagggacgcggcgctccggagtttcgcccttcccgctgctccatggacgcgcagaggcagccccgctcctccggcggctcacgccagccgggccggcccggcgcagcggcgggggccgcgctctgccatcgcaccggtctccctgtccctggcctctcaatgcagcggctcttcaaggttgcagagcgcagccttcagccatgccggccactcgccccagcccccgccgtggctctcgcacaaacacccagactctggctcgctgtctcccagccgcggctcaatctcttcccgtccttttcccttctagggttgcacgctctggttcccaaacccccggccgctggcttatgcaaatcacttaggtacatgcaaaagtatcccttctcccggagcgccattggcccggggaggtctcgagctcattactatgcagagaggagagccgccattggccaagaggaggaccagaggggcgtgtttctcgggcaaattggatctcctaaattggatgacctggtaagtagaacttccctccagcgttcagttaagttttaaatgactctccgctgttccaaagggcgaggacgtctggagctctgcaaacggaaaaaagattttgaagaggaggaaaaaagtttccctcgatctgacacacatctttgggttttagctatacactaagttaaaagtgtaccctctccagtgcctcacttcacctgggatctttacacctatcttgatacacatttggtagctaagtcttagcaattcattctccccagtcctctctctgtatttggtgtttttggtgactgcaaattagactcctttctcacgcactttaaaatcctgaaacacaggaattttgtaaaaggtcagagaaagtgatgtttctgaacactggacaatttccaaaacatctgagtgggaggtgactacggctgagaagccagcagcaacgttggtgttaggtaattatcagcattccctcctcttctggattttgagtccctgtggcctaatagaccccacggaatcattacctgtaccaactacggctttaagggtacttcgtttcttgctctctgccatggcgttgagtcgttttactctataatggagacatttttaatgaatacattaaaacaagcaggattcggccgggcgcggtggctcacgc

SEQ ID NO: 2451 - DNA, 15732 bp, Homo sapiens
gttgctcttgggtggccgcggcgcccgctccctctgaattcgccgggcagggatacagccgcccggggcctcttgctcgtgcttggttttccggaccttgcttcctaaagggtctttaggggttcccggactcctccgcctgggagcctctatccgcctgggagcctctatgcgccccgcaaagcccccggcagagccgaggggaggcttcattggcgacctggtggggcctcgcggccctgctccctgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggcaccacagatataaaaatctgattcttttaccatgctcagagttttttcacttctgtgtccccaggaattgactcatcctcatatctgagttctgggatattgttggtgataatctcagtgctgtatatttgtttttggttttctggtgtggaagtgaagccagcttgcgtctacactgccatttttgaactagaagtccacctgatgccatgtgggtctgctctaacaaagatgcctgtagctgtctctgtaggtacaattggagctactacctcataaagtttgtggtagcccactatctggtttttggaggggctagactggtaaattaaatggagatacaatttgaaccatcatccccgaatcttttaggtcttttaggatggcattaatttctgccattccctgaaatattattttttgatttactgtattggtatggagaagaggtcaatttttaaagcttccacctggccacttggcctttatcactatgttagctcttaccacacacaccgagaaacctggtgccactaatcaagtgtatttatcacaattatacactcaaggactaggtgggtctgtggatatattgtgagccagacttgggccaggacaccctaggacttggcctccataacccttactctaatcaagggcatatagtgagagttctgtgatatcattgttaactcagaccctgtttccaacagatatcaaaatgttgagtattcccctttcaccactgtatgatttcctgagtaatggtgataggtccctttggagaaggactagaggaatcattattgtgcacacttgtggtattacacaatccttcctcctggggacccagattcttctttagttaatgggcctggatccaaaaacggactcaggtctggaaatcggacaaggggtcatgattattttttatttttatttatttatttatttatttatttttgagacagagtctccctctttagcccaggctggagtgcagtggcacaatctctactcatggcaacctccatctcctgggttcaagcaattcttttgcctcagcctcccgagtaactggattacaggcgcgcaccaccttgcccggctaatgtttgtatttttagtagagacagggtttcaccatgttggccaggctggtcttgaactactggcctcagggaatccaccctcctcggccttccaaagtactaaatttatagtcatgagccactgcaccccgccagtttaacttttttttaattggcttagttgccaagagaggaagttggggaggatcctgaggagtgtatgttttgtccttggagagagagctcattgtcttcaagcaaaagagggagcacactagcccttattagagaagagaggggcacttctgtagccttagaaggttctggaaacctgaggattgaagatttttcaggtgcatcaacccagatggtttcatcccatgtgtcagggttccattttttcccaatcagggtcctgacaacagcacagtagacctgcctagcttgggtcctaacttctttggagttttattctcatgactaagtcctgggcctggtcctcagcttcctctcctcattggcttgagaacctgagagtctcatattctacgagggaggctttctggccctcacactgagtttttgtttgtttttgagacaagatcttgctttgtcactaaggctgagtgtgtagttgcacccaggctgggagtgcagtggcacagtaagctactgtaaccttgaactcctggacccaaattatcctctggcctcagcctcttgagtaacagaacaacaaatgcatgccactatgccctgctgattttaaatttttgtggagatgggccttgctatgttgcccaggctggtcttgaattcctggcctcaagctatcctcccttttcagtcttctgaggcactggaattacaggcatgagccacggctcttggtcccacactcagcttctaattaccaactaatcactctcattcttttattttgagacagggtctcattctgtagctcaagctggagtacagtagtgcaaatatagctcactgcagcctcaaactcctggggtcaggtgatcttcttgcctcagcttcccaaatagctaggactacagccacaagctactgggcatggataattttttaaatatttgtagagacagggtctcgctatgttgcccaggctggtctcaaactcctggctcagcctcccaaagtgctgggattacaagtgtgagccactatgcctggcccattctcattcttctgttatctttttccaaggtatcggtctagctcagtaataactcttcagttccactgtctacactgtttcccacctgatcttcgtgcctgccggtgcatttctttgtgttgacatgccatctcagttcaccactagtcaaagttttaataactgcactgtcagggtgtgctagcagttaacttctccctgccccagtgaggagactctcatcctataagtgagaaggcaagagaaatggctccaaaagcacactggagcacctactttcctgcaacccttctgataccaagtatcacagatgctgagatgaagattagtgggtaggagatttggattgccacctgtggaaagaaaggaaactccactgggtggaggaagaatatggactatgatgcaatctcaaaggtggccttagctgacactaaggggaactctgaagctaggatggtctttcagattgttctaatatggggcaatgggactagtctttgcatgcagcctggcccaagaaggaagtgtgacttcagatgaggtggctcttttcacttaagagggcaattctactgacagctgagggccgttgggtgcacactgccagagcgagaaaacaaaatcctctgtagggaaggggactgtgtggcatatcacagcacaccccgagaacaagggagcggctcttcatcaaataacacaatatgggcccacatattcccagaggctgctatagtgctgggcacattagtgctcaataacttattgaattagtattatcatattgtgctattgccatcctcatcttttaaagtcacttatcacttaatggatgttcttgttagaactgacactatgaagatgactatgacacaattacctgttgagcctatttgagaaattaacctatatttaacaagtttgactaattagattggttaagagccttagcagagggctaaacaaaatggtgttaaagaatacacctgatggtccaagaaaatccctaactccctagaaggtctggatagtctgagaagtgacattcgaacagtgtaatgcactttcctccagagccagaagcagggaaagcagaggcagcagcaattttatcttctgggcaccttatcctcagacctcattttatcaatacatacggactgtctacaaccacgtaatatccttttcatcagccttatgaaattttcccccaatttatccaagtcaggatttcagtatgcagaagtctaatgtcatcttggagagttcattgtgcctcccccatatccaagaccatttactaaaaccttagttcagtctttaaagagtcacaagatcctattatgcctagttttttttccagtcttttaagtctattccttaccttgccaaaaaagtacctgtttctatggtttaacaaatggagcttagaatatggaactatgacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaatacaattcttattattgtctttctttttaagcctccatggtatactacaccactcgcaatctttgttttgcttgtacaaacaaaaaaccacaactgctcagctgtagcagttttcaaacacattacacttcataatgatctgacagtgttaaagacatacagatatctaggctgcactctagctcactcaatcagaaatatacagttgggggtggctgattcctacacttaaaaaaataacagctcccaaggcaattctaatatagttagttgaacactatttggaaattactgaaccacacagtaactttctcaaaagggaaagaaccatttgctagaggactggagagattgtattttccactaggaagtcattttcaggaggcatttgaaccaggaataacttcggtcaaggcaaaacctcccttgtgtcttctattaaaaaaaaatgtttaattgatacataataattgtatgtatttatgctgttgtccattcatgttcctaggttttaagtctgtgcagagtctagttctttatttatactgtaaatgggtcatggtattttaaaaacaatacctgacccaggaaacaaacgttcttcccatcaactgatgagccactcttactaaagatggctgaaatgagggcaaagaggaagaaatagaaacgtgtgcggtatgatttatttgaagtaggcataataaaaatgttatttttgatactctatttagtggaaaatatccagatacaatgggattatttaatgagtaaagaggctttctagttctagtatctaggttcttttctcctgaccctccagcttctgcttgaggctcatccatgttgtagaatgtatcagaacttcgtttctttttacagctgaataatatttcattggaaggacagtccacaatttgtttatccacttattcactgatggatgttttgggctgtttctaccttttggcttttgtgaatggtgctgctatgaatatacagatacctgtgtgtataggcatttgtttaaataccagttttttatttatactcctaggagtggagttgctgggtcatatggcaattcatttgaggaactgagaagcttattccatggaggctgaactgttttatattcccaccagcaacgtgtaaggttccagtttatctacatcatcaccaacacttgctattttccatttcattaatgatagccatcctagtggatttgaagtggtaccttattatcgtggttttgattgcattctctattgactaatgatatcgagcatcttttcatgtattttttggtcatttggtcatttttcttttttaattttaaaattttgagacaggctctcactatgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaactgtagacagtaataaatatttattggatgaatggtctctcatcagccaccttttctttttttttttttgagacagagtctcactctgtcactcaggctggagtgcagtggcgcgatctcggttcactgcaacctctgcctcccgggttcaagtgattctcccacctgagcctcccgagtagctgggattacaggtgcacgccaccttgtctggctaatttttgtatttttagtagagacagggtttcaccgtgttggtcaggctggtctcaaacgcctgacctcaggtgatctgcccgacttggcctcccaaagtgctgggattacaggtgtgagccaccgcacctggcctccagcctcttttcttttttttttttgagacaagtctaactctgtcacccaggctggagagcagcggcatgatcatggctcactgctgcctcaacctcagaggctcaagtcattgtccccacctcagcctccctagtagactggactacaggcatgtgccaccacacccagctaatttttcatcagccaccttttctaaccatctgtctgcactgacttcccaggttctgcatcattattggtttactgagacaatgcacttcacccgtccttcaatcccaaagtagcacagaatatcaggagttctttgagcccctaagtgccctactttcccagggtcaggggaccctgacaagcaaggtccccacatctttctgtggttggatagggatataaaatttctcacacatgttaaatcaagatactttggccaggcacggtggctcacacctgtaatcccagcactttgggaggctgaggtgtacagatcacttgaggtcaggagtttgagacaagcctggtcaacatggtgaaactcccatctctactaaaaaaaaaaaaactttgggaggccgaggtgggtggatcatgaggtcaggagtttgagaccagcctggccaacatggtgaaaccccgtctctactaaaaatgcaaaaattaggtgggtgtggtggcacacagcagtagtcccagctactcaggaggctgaggcaggagaattgcttgaacctgggaggcagaggttacagtgagctgagatcatgccaccgcactccaaccagggcaacagatcaagactccatcttggggaaaaaaaaaaaaattagccaggcttggtggtggatgcctgtattcccagcttcttgggagactgaagcaggaggatcgcttgaacccaggaggcagaggttgcagtgagttgagattgtgccactgtactccagcctgggcaacagaaacaatactccgtctcaaaaaaaaaaaaaaaaaaaaaaaatcaagacaccaaacacacacaactaattagctctataaattgaattaaaagaaaatccatactgacttgctttcccatctgtccatatttgtctatccaaatgattaagggctagagaaaatacagatgatgatggctgagatgggataaaactataaattgacttggttccatttacctcccagaatcagcatacagtgacaaagtagagagaaaaggtctgggcaccacaaacttgtacttgtgctagaaatgtaggtgccttttcatttgcccagcagggctagtttaacagccagggtatcttctgggactcttccccaaatcttgctctaccgctgactagctatgtgatcttgggcaagtttctcaacctttctgtgcctttcttcctttacttataaataaggataacagaatttgcttcatagagttagtctgaggattcagtaagtagatacgtgtaatcttagaacagtgtctggcacacagtaaaactctatctttgctattgttgtttttgttataactgtatagatgttagctattattactatccacaagaatgggacatatcaattatatatattactggcctagtaattatatatacttagaatccctgatcaataaaataaattgtaatagaaatttttattcctcaaacacatttttgttcctcaaacacatttttaaataaacatgtcttgggaaagccaaagaaaaaaaaatcatacctatatccaaatatgttatattaaaaccttgttccttggcaatttcactaagcagctggatgtaatctgtatttggaatactaaggaggcttcttttcagtaagttgatcttttcaccaggagaattcctcaaggaatgccaagtacatcctaaagaatgtcctactacatttgtctgaaaaacagagatgaagatttagactcttgactaggactgggttccaacacccgtaccagtatcattaaaagtacttattaagcactcacatttaatatgttataaagcatgtttaaatggataacatttggttaattttccaatttaaacaagacaacattaaaaagtacacatttaacaatactatatgtttttaagaagcacttgcaataatatactgaaagcattttgtattttgtatagtacaaatgtttctcagtcaagttttctgatggtcacattaagaggtacaagatatctggaagcaccataagtaaatccacaaataattaaatctgcctaatggagcaatttgcagattaaaatatagaacaattttcatatctttggttttttttgtattaaataccaatcactataactgacagctatcaaacaggaaaaaaaacagaaaaaaaaactaaaaaaaacatgaaatgtgcgcgttgggtttgaggaacaagtcattcaaataaatgacaggatgtcaaaaagttcttatcagacttctatcccagaacccaactgagtatttttttcctttttctttctgcttttcctctttcctttatcctcccctatatccttcccttttcatctctgtccttagaatgccttatatttccatattagtttatggttctcaaattgctttcatatgccattaataaaaacaactactttctgaagtaagtagggttactactcttaatattgttttattaatgagcacgacagaggggaggcaatttccaaaagattttagagatggcatgatatggaattaagtaatttattagatttaccaaataaaaatttacattatagaaactttaaaatactgtttttaaataaagaacactatttacatggttaaaaatatacatgcactaagaacaaatatataatgaagagtacagtctcttttccttaccacccattccctgaagacctctgttctatttcttagacatactgttaaacatttttcagtatcttcccataaatgttctatgcatatgcaagcacacacaatcttttaaagcaaatgataacttactcctctacatcttgttcatttttcttttatcagtgcacatatatgcactgtatttaccttacggatctccaactgtgagctttaggttgtttctagtttcttgcttttactagcaataaacactcttttgcacttgaatgagtttctctgtagaattatttctagaagtggaactgctaagtcaaagaacatgtacacttttaattttgataaatacttccaaactgatttctgaaccaatttatactcctaccaactgtcttggagggggcttgttttctcataccctcactaataccagctattatcaaattttgtagtttttgccaatctaaaaggtgaaaatattttatcttgcatgaataaagttgaatattttttctttttttcccttaatcgtttgcatttcttctactgggttgtctttttaactgatgcataagagctttttaaattttctcttttttaagagttaggatcttgctgtgtggcttaactctcaaactcttgggctctagcagtcctcccaccttagcctcccgagtagctgggactacaggcatgtgctgctgtgtgcagcagatgtgtacaaaagagctttaaaggtagtactgaaaacagttcctttatagttctatgttgaaaataatttcttcccacttttttattgtcttaatttacagattttttgctgtgcagtaggttttatgttgtcaaatgtattaatcttttaacctaggttttaagttaaaatgctttccccatgctaagatttttaaaaagaaaaactcttccatgtttcctaatatttatactgtttcaaatttttatgttcaaatctttgatccatctgaaattcactttggtgtaaggaataaggaagcattctaaatagatgtcatacacatcaacaaatatatatatatagcccccacccaaatgtggatgtaaactgtttctacatcattattgaataatccatcctctcacccactgatctgaaatctcactgttgctatatactatggtcctatgtggattagcatctacgcctggattctctattcgctcctctgactattcctggcccagtaacttgtctgacaagttcagttttacagtatgttttgttctctagtaaagcagcacacccttgctctcccaactcttccttttcagttttcttggctattcttgagggtttttttccagataaacttcaataaacgtgtatcaaggtccaaaatgaacgctggtaggtttttttttttttcgagttggggtctcactctgtcgcctaggctggagtgcagtggcgtggatctctgctcactgcaagctccgcctcccgggttcatgccattctcctgactcagcctccggagtagcggggactacaggcgcacgccaccaggcccggctaatttttttttttgtatttttagtagagacggggtttcaccgcgttagccagaatggtttctatctcctgacctcatgatccgcccacctcggcctcccaaagtgctgggattacaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagttcaagctgtcatgtctcacgtgtcttctgtaacagcactctcgcaggtctctttgatcctaatttcactcacttaccataatgcagccaagtgatttccttgtaatgtatagactagatcctgtccttcccagattaaaattctttaatgactttgtactacccttgggataaagttcactttccttatataggggtccctttaagatttaatccctctttactttgctggcctcattgagactccctccctccaacactatgttctacacacaacaaatcacttagggctcctagactgcatacgatgtttcactcctggcctttgcacacgctttttcttctctctggaattcttttcccccattctacaggtcttggcttagacattacttcttcctggaatctgtctccaaacctgtttttgttggatgccttcttctatgttcccacatcacactctgtaaggactagcctatagaattccttcctttcagtagtctataaactccttagaggcagggactgcttattcactgcaccccagtacccaacacaacacttagcacacagtatgagctcactaaatgtttgctaagtgaatgaatgaacaaacaaagggatggaaatgcgctgtcactttgaaggcaaaaatggcactactggcctatcatctttagatcccgtcctattattctgaatttgactgtgtctcccaagctctcttacctaattgcctctgtgatcctgactcacaaacaggaagcagctaaaaatggggtagggtataactgaataatgaagagatttctaaaaatcacaactctgaagtagctatagaataagaaatcaaggaaagtttcctactgcaagaaatgcttaatgacattaacatcatagctgtcaacattactcactaaagaaatgtggttctctggagaaatattactaaatttggcaagaaatttctcagcagcattccttttggcttgcttttttgatgccccctttcctgaacaaagaaaaagaaatggtagatttagaaaagaaattagtgtccacagaggatgatcaaacgtatgaagtactgtgtttaatcagagaacctcacggtttttattatatactagactatgttcttactgacctgataactttgtttgttatgctattttgtttgtatagctattaattctttttttttttttttttgagacggaccctcactttgtcaccaggctggagtgcagtggcaccatcttggctcactgcaacctccgcctcctgggttcaagcaattctcctgcttcagcctcccaagtagatgggattacaggtgcccaccaccacacctggctgattttttgtatttagtacagacagggttttgccatgttggccaggctggtctcaaactccttacctcatatgatcggcccacctcagcctcccaaagggctgggattatcagtgtgagccactgtgccaggcctgtatagttactaattcttacacttttgaagacatttgttttaagtttttctttaatagttatgctttctgtttttctataataattgtattttcctatgtctagcattactgaaccatatttggtttaattctgaccaattatttagatttattaaaatacatctgaattataactcctctctctcaatgtctatttcctgcttatgatcttctctaaactgacgattatatgaaattccttttaacaggaataagaaaggcacaggggatggtggagttgaaagataccataaatatctacctccatgcttttgttttatagattaaaaaactgaggtccagagaaattaagtaatttgcttaacttcgcgaatcaaggactgcatcaaggacggaagctgaggttcctgcttttggcctggtgctttctgtactggccacactacctcccaaaggcaaatagtttcttattacttgaaactattatctagctaagctaaaatcccattttaagccacttttgaaaataacaaaaacatgccagagaagttaacaggaattctcgctagtactttttaaagtgacagcgtttcttatagtttatatcctttataacatagaagttgctataattaagaaagataattttcatttttatctcactgcaattatttgccatgtagtctcttattaatcatataattttcaagtgtaatcttcctctagtcctattttctagatagaatagctgttaaaatccaagagatttactatagctttttctccaaattgaggttttttaagtcagtaatttatcaatgaagactgtttaaagtacagagccaacagttt

SEQ ID NO: 2452 - DNA, 8745 bp, Homo sapiens
agacacaccaggccgccatgttgtgtaaggttagtctctcagcctccgcgagaagaaggcgaaaaatggggaggagcagcctggttactttcaaacgagaaagaacggatatgttaagcgtggagggctcctaatggtagcggtttgattttcagtgagtttggcgcggtggagacgtcaccgcggtctaacagttccgacgtggtggcgtcatcactggccgccgtaggaggtggagctacgttggcctcgtgaccgggccctgtagcggaagcccaggtcaaggccctaacaaaagggcccgcctatggccacagtttcaggccctcctttcagtcatggactgttgaagcacgatttcctggtgctttcgcccctttcaccgaccatttcaagagtccgtagttctcgcctgggtttggattcggtataagtgagcctgtttaccatcaaagaaaatggtgaaatgtcttctggagacgatgttctcttctggttctaaccctgtcactcagtgagacccccagagaagcctagttttcagattattctagtccttggcaggctcaagatgtcaacaacacggttggaaacaacccctgagaggtcacatagcgcgcactcagctttacagatcgtccaaggcagcgacccctgagaggtcacatagcgcgcactcagctttatagatcgtccaaggcagcaattagaatcagcaactcggagaggaaaaaaagctgttagcggaatggaggctgaccattatctgtagtaaagaatcggaagtacagtacaaaaataaattaccgaaacgcaacatgcgtgaatttcacacaaaaaaatgaagttgagggaaagaagccagacatggaagagttcatattgcgtggttccatttaaaaactagcccatggtgttaatgagcatagtggggaggacaatgacatgaaagagccaccagggggcttttgaggttcaggtaatgtttcttgatttggacactgattatagataggtgggttcactttagaaatctcattgagttgtaaacgtatatttatgtacgtagttttttctgtagattatgcttaaggcccggcgaaggggaatttgcccaggtaatggaaatattacaccgatacatagaattgtcaaagttcatgggatgaactcctaagagctgtgtattttatcgtataaatttttttaagtgtccaaccaatagcctggaattattaagtacataattaaataaaaacaaatatcccatggacctaatgcagtgaacagttacctcgttctcttaattgctcaggctaaggactcatacctgagtcttctatctcaggccttacatcttatataacaagccttactggcttaatcttcaaaatatgtagcgaatttaacgagttctcacaacctctgcttctaccacctgacggggtttgggacatgctacccaaaaatatggcacctagacatattgaatactttgaactgaaggaatttgagaaagaacatatgcaggaatgtctctaactttcttgcacctttctgctctgaagcaggacgtaataccctcatgtgagaattgccctgtctatacctggaataaaagtaacatctttatctctgaaaacacagggacgtagagacgaatatgaacatcaggccttgctaagtttcccccagtttattacccttagatcacagtcttttagccccatcacattttcccacaattctccattcttcttcaaacctactctaaacaacactaaggttaactatttattcgggtcttcatttctttatgaagtttccatgttatgtaaaactaacattaatatttatgcttttctcttgttaatttgtcttttgttacaggatccccagccagtgagcctaaaatgggtagaaggaaaagatatttcttaccctacgcacccaggtccaagtcatcattattttgtctgaaatttatcttcctaactgatttctctgcttccccattgtgccttaagagttagttttccacagagcagctcgagatatcttttcagatcattatatccctttgcttaaaaacctctaacagcttcctattaggcttagaataaagtacaaactccttaatgtgaacttgagtgttttacgtatcttatctcacctttatgagcttcatgtcagaacccatctctcaccactcttccttccccgctccctgatttaaacagtctggcactttacttattcattgaacccactgggtttgctcttgcctccaagtctgtacccagctttctctctacctgtaatcctcttcctctaggtcatcacacagatcgtttcttcactctatttaggtctttcagaagtaacactaagggaggcttttccagacaatattatgcaaatataaatggacatgtgacaaatactttattcgacttattagttactgagagtgtatttgagtagccaggtatttataggcaatttaacaatgtaatgttagtataaggtggcaaggttagatataaacctgttaatgtctcacagggtaataaactataacttttggtgttatctgttccactggaaaggaagtagggatttgcattcttactggacaaaaatctacaagttaatgtatagattcagtataggacttttaaatcaatagtgaacgatgaaatgaacaaagtacaatcccctagtccttggtttgacactgaaaggacatgccactcacctttttgccttgtttccaaagtttggaataattttcctttcaaaatgaaattatttctcattcagttgtcctattgcaggcagcctttactgcttcccccagttaatgtacctgtcaagcttactcatgatttcctaactgccaaattcaatggatatttttaattttttttttgctatgactcatactgttcccttcgggcttgtcagcagataaatgaccttctggggactgtgcaaaatatggaatgcttaatgaatttgtgtgttattcttgtgcaggggacacaacagtcttctctgtagattacagttttagtgtatgtgctgttgaagtgagcacttctgagtaattttgattgttttactttttatgtaaaatttcacattgtttaaaacaccagatgggggccaggcatggtggctcatgcctgcaatcccagcactttgggaggctgaggcgagtggattgcttgggctcaggagtttgagaccagccttgccatgtggcaaaaccttgtctctataaaaaatagaaatatcagccaggcatggtggtgtatgcctgtagtcccagctacttgggaggctgaggtgggaggcacttgagcctgggaggtggaggttgaagtgagctgagatcacgccactgcactccagcctgggtgacagagcaagaccatctcagaaaacaaacaaacaaaaaataccacatggccaaatgaaagatgtctgtggtctgaatttgggccaaaagctgtaatcttacagtctttgattattttttaatacatgctgaattccaagaggagctgacaaatctcttgagatttcacttgggttccatggattcccagcacaaaatgcaaatgcaaatgagatatgattgggattctctgcacactatctccactttcataagtgcctctgaagtttagtttgaattttatagtatctcctaccttgctgtaccttaaaggactaacagcagctacctgacccaggattagccagtcatattttttccagaatttgtaattggaacaattgagatggtagtcttctgctggtagtttgaagagaggatatgtaaacttggtagctgtgtacttagaagcagagaaagcctgttttcagagagaagaatgaagcaggtaagtcatctggaaggacaagcagaagcacaattttgggaacagttgctttcagagtcctgatggcattccagccccttgtcctagtgccagttcaggcccaagtgtttggcctttgggacctatgatacagatatcctatttccttttaattaattgcctcttaaaattactattattaagctagcttgcaagggtttctgttacgtggaatcaaggaacctcagtagagaggaaaatgaagcactttgtggtggtgctgcacagggtatcattttgcagggtatatactgtgtgttttctacgttgactggagtctggggtcaggtgtaagaagtgttacataaacattgggttcaaatgagtcagaataaagtcaactaaaaaaataaaaaagacatacatggacttcagaacaaatgtttattactgcttaatggggccaaaggggcaacacaaagcattgaaaacatcactggctcacaaaaacagtcaccttgttaccttctcagttgcatttgtttatttcacaaggcttcattcacacataaaaacaagatactaatccaattcaagttcataacgattataaaagtaaacatttgttgggacaatgtacaataaattgcactttttagacaagcattacatttacatttatagagtgtactatacataatacatggaattacggaaacgtctaattggtcattgtttatagaggaagaggctgatcactaacgtttattttgtagttaattagtactgttcagactaatcaactcctttattctagaacctgttttcattagagatgccatggacaaaataatggaattcataaaaatagacaattccagaatctctactacctcctctgcaagggaaaggtaggagttagaaagaaaggaagtggggctgactgagaaactttgtccctcatttgaactaaggatccatgcattatgcaaaataccaaaaatagagaaactgatacaaaaggcttttgggacatcttggatctgggaccatctccagccttattcttgtgctttcatgacaccagagtctttcgatgcatttatattctcacaattcagtccatatattttatcccatatataatatatagttattaaaagttatacagtttaatggaaaagattttacatgttaactaattgccaatgaaaaaggaaaataacttaaaatgttcactttctactcaatgattcttttttcttaagcttttcagaataccactaatgacaaaccagagatggaggtaggaagaatgggatatattaatgaaatgtttttatagcaggcagcaaattcaggtggagataagcttgacatatgtagtcttttagatgcaaactgagaaaggaatgccagacagctgactgcagtcactaaaatctcctatatgcccacttttctcattacaactcaagatcagcatctcctattgaggtgcagccaaggttgaagtcctcattttggtcacttttgaaagataaagaatttgctaaggtaaagggctttgcctgtattaaatggaagccattatgagagaggaagaatgtgttgggacagttctagttcagtgtgactatcagcatggcgacgagaaagagttttatatctggttgtaggaaacaggctgcagagctgtggtctggccttctggctttcatcatcatttcttgaaatctcaatgtgtatttggttgtgtggtacccaggtaaacaaaagcagcagagatactctatataaaattcttccaattaaacacacatacaaacctaatagtgttcaaatcatacaacagaatttcttcacactcatttgtaattggagaaaaggagtcagtattttggagtgtttttaagggcaagttatataatataatcatcttgctaatcaagtaaaagtgttctttcccagaagataaaacaaaaccaaggcatttaattttttaaaagttttttcccttaaaggggcccccctaatcaggcaggtacctaagtgtttgatgcaaaggttggtgggagagttagtagacagattttagtgaaagtatgaagacttaaacccctacatcagttacacatgtgattctcctgggtgactggctcactcctttaaagatgtaactctatctcctctgcccaaatctgtattgttttccgttggttttctcacttcagctaggaaataaagcaactagttattaactggaaaatattttaagaaaatggagcaggggttggagaaaaataaatattaatacatcataggaaaaaaatgaaacaagatacatactattaaatatccccacatccatacaaaggttgcttttctactttactcaggacatttcagaaagccaatgaagaagtactaatttaacagctgggagaggggcagaagacactggttgaatggcattcctattagtgttcctgataggcactcataaataaacagaacattaagtaacagaatttctttgcattaaattatatgtaactaaataaaaccaaattttgacatggttcaggatgtgggaagctagcaaacatatgcactgcaaaatccagcttggtttctttcagatttaaagacgtgtttagattctcaagatacaaaagctgatgaactgaattatgaagttgaatttcattcatttaattttttccacagaatttaatgaaaatagaaatgatcaattcttagatactgcaaatattagattttcagaggaatgttttgtacagagtgcatcctagcaaaggatgaaaaacactagaatgttttgaaactttcctggatatttggctggttaatctcttctaagtgaaattcaagagaagagatgcaattctcaaatatatctcaaaataactaaaattaaaactaggagttacttcatgctgggatgcatgagttttccaacaatagacagtgaaggacatattgtttggaatattgctattataacatattgtatgaacaatcatatcacataccaaattctgaattttctttgtttctagtctttactattgctactgactcaaaggcattgcagtgaaggagagtttaggcttatggtaccaacaggcatacccaagtatgatatggggctggagaataaaaaaaaaaaaaatatgtattgccctcgtaatcttttgaaagagctaaaagaaaactcaaaagatggacttatcaaacttgagaggtatgtacctggtgatttttcgagacggaattttgctcttgtcgcccaggctggatggaatgtaatgccgtaatcttggcccactgcaacctctgcctcctgggttcaagtgattctcctgcctcaacctcccgagtagctgggattacaggcacccgccaccaagcccggctaatttttgtattttgcagtagagatagggtttcaccatgttggccaggctggtctcaaactcctgaccttaggtgatccacccacctcagcctcccaaagtgctgggattacagatgtgagccaccatgcctggccaggggggatttttctcttctcctctttaaaaggaaagggactatgaagttgaacaaggtctttagataagggattgacctagagccattatgtttctccctcacctactattatttaaagaaaattacacactttaggcattctgtggaatgtacttatttttgtaaattgaaacaagctctgtacagaactatgaaattcacaacacaaaagagcatctttaatttagctggccatttgataaggcaactgcacaaggcttcttggaatcaaagcgtaaagtaccagtaaagctaacagcctatactaaatgatttacaaaaacaagcgccaagataacattttctagctattacattttacaaaaaaaaaaaaaaaaaaattagcttatctagaccaccatgtagagaatgttaaagccaacacagacacttggaatgctgggttatgttcctttttgttaagaaaataaattttgtaatgaaagatgtcagaacaacaatgaaagatttatgtaagaaaagtattatctgatgagtataacataacaatcacatcagttttatgggctgtagagaatataaacacagataaaggggatttcactttttagaacataaaagatcattttagaggaaaagatccactgtgagcaacttggtgcatcctcctgggatgtagatggctcttatttgattcttctaagggtgtgttacttttaattgcaaaatatggcacagatgagaatcattctggcactacagagtttaagattctttgcaaataatatgttcaacaatgaggccaatgattaatatcaacaaatgttattgtacatatctaatagtagtttggttggtttgaaaggatcagaggcctccaaaatagtttataaaataaaaatagttttgctcttatcaaataatttcctgcaaggactatttttataggcatgttaaatataattgaaaaaatatttccactaatttttaaacaatagctttacctttccatgagataagtatttctgtaaaggttttatattcaatcaaaaatgttacaaatgcatttgtatctctttatgggtacgaaggacacattttcagggaactacagaaatcagaaaaagttgcccagcattaaactaagatgatgtgagcctgacctctatttcccatttcaatactatgtcctttaacaaagttacagtattgttagtgtttccttagcaagtatatatcaacgttaaatgaaatactctgtccctggttctatatt

SEQ ID NO: 2453 - DNA, 708 bp, Homo sapiens
agcagcaggagccgccgccgccgcggttgatgtggttgggccggggctgaggaggccgccaagatgccgcagtcaaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatctttaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttggaaataagaaagacctgcatatggaaagggtgatcagttatgaagaagggaaagctttggcagaatcttggaatgcagcttttttggaatcttctgctaaagaaaatcagactgctgttgatgtttttcgaaggatgattttggaggcagaaaaaatggacggggcagcttcacaaggcaagtcttcatgctcggtgatgtgattctgctgcaaagcccgaggacactgggaatatattctagctgaagaagcaaactgcccgttctccttggagataaactatgcttctttt

SEQ ID NO: 2454 - DNA, 22232 bp, Homo sapiens
gctcctgcatgctggactcctgagccaggaggctctttcactccgtggcccttctgctcattcttcaagtccctgagtgaccagtggtcctcctttctgaaggctcttgctacaaaggaaagatgaggatattctatttcttgatccctctcagctactgggagctgctttgtgccttggaagcctcaagctgaaatggatgtcagcctcaagtttaactccaagagggttcaccttgtttctttgaacaaaatgtgctgcctgttgcttccctttgccaggagtggtgttcccttttccacaggtctggaccacagtgtctctagctcccgctcctggatacttggttactgtgtgtttcggtaaaaaagcatccacaacatgaatatccactaagctgtaacagggcctgctgcaactatagtatttcctgaaaaagtatcaactgccacaagggccacaaataaagtctgtgaacttgaaataaccatggagaatgaaatgttctgattcagatcatcggtgggatttcactgggaaatctcccactgggcaagagtagatgatggaggaggagaaacagtcactagaaaaaggtgatactttgtatcaagaaacaattaaaaattagatcacatcctgaaacattaagcatatgctcctttgtgaggcttgcctggctgaacttgaactggattgagtgaataatttcttaaaaacaatcaaaatcacagatttattctattttaaatacttatatttacttatatttcattcagaaattagttaacaaataatttttgagtatcctgggaactgttctaatcattaaacatgcaagtttgaagaaagtaaggatgaatctgcctgcgtggggctctcaatctagcgagaagcagataagaagacaaatgtcagggaagatcacacaaccttcaggtaatatttaagctgagacctcactagttgctaagactggatttcagaggtcaggtttggatatacaaaatttaggagctggtacatgacatttaaaaccatgggaatgaatgagatttcctagatagaaagaagaaaagaatattgacatttaatgttgaacggagtaggaggagctgaacagggagaccaggaaggagcagacagtgaacctggagcatgaataggagagtgggtgtcatggaagccaagagaaacaagaattcaagaaagaaagtttcttactgtagcaaatggcgctgagagggaaagtaaggccatggaatgatgacaatgacaacagtgacgaaggatcattgagtatggtatcatgctgacatttgtttctacccaggctaggtcgttactgaggggtggtagctaagacagggtgggttgaacatgaggaaatgaagacagaacatgaatttttggaaagtttggctacaatgggaagtagagaaatggggtaatatctggaaggggagggaattgagtcagtagggttttgtgttttgattttacggtagggcatctagatagatcatgtttatgtacctattcccactctgttctctcttcctgaagagtctcctctggcaaactccattctgtaaacgtccgtatttaagtgtcctgttctctgtcaaacattcttcccaggcctagtatgatgtttgtccccaggcttccatgccattatgtgtacacattatctgccataagcttaccttattgcatggcaatggaagtttttcctccttctctcttcttcattagacaagaacagggtcttgaaaagtagagactgtgtcttctcaagttcggactactggcacaggtaggtgctcagaacttggcaccaggaagatgcttattaaatatttgaagaacaaataagtaaatgaatgaatagactaactgagtttgaaggcagtgctatggcagatttttcttattttatgaatggaaaaactatggcatagaacaatttggaatctgataattttacaaattcgtaggagtgctggaaaacagtaaaatcttcagtcttgctccttgagctgttgcccaggtccctctctgggactgcactagcagccctaaaaaacacctggggctgataccctcacattcacaccaaaccgcagacctcaccacagaagcacaggccttcacgctggcgtctgcagtctacttgtagtttgattttagcaacattggccaagttgaggctgggaagcagctggtgaacaaagggtggatgcacttttctgaatctagggggagaccaggttagagccatgctaagtgaagctgctagggtaggtgggccaggcaggggaacaggcaaagatacccttggctcccttaaacttgggctagaaaaaacaaagacatggctcaaggagaaccacaaggtgtcactgttcatcctcagttaaacaaacactgatttgggcagggacttgagaaacactgcaaagaactttattttgcagatgaagaaacggaggcccggggaggtaacatgatttgactaagatcacgtaacaacttaatggcagaacaattatgagaaaccaagtctcttaactttcagactggcaggaccactttctcccattgctcctatgagatggcattttgagatgaggagtaagccttctctacaatcattcactcaagacaatggctttcaattagaaatagaacagaaaaaaaacaagagagagagaagaaaagaatgaaaaaagcgcagcattcactctcacatgtgccttattcaaagtgctgggctaagatgccagtgcccacaacgagagagtggcccacagggcctccgtctgtggcaggcttgaatacccgaatagaaaagtatcaggtaaaggatttcattctttttatggctccaacttaaaaagagtctggttcccaaggaaaacaggaagccaagttgctcagcaaagaattggctgaaacctaagtaggacccagataaaaacatttgctggatggaaggatgtgggcaaatttctgggccccgctgcttggggatgggaagctatgaggcagaagaccctttgtgaaacagtgacccgtgcaccaggcatttttgcggatgtctggaaactgcgaggcagtggaggagtcataagttagttggttttttaattccaactaactttactccaccaagtatctcaggagatttcgcctatgctctttggcctgactcccactaggcccttactccttccatggtggcttctactggagcctctttcttagttcccaggttattaaaataataataaattcaaagagctttgttgttttcttaggtaatataattaatatgcgctcattacaaaaattcagataccaagtagcagaatgaagaaaataaaagacatctgtagtctctccattcagaaataactgctgttagcataatgctgtatacattcaggctgttggcctgtggaacacctggtatatgtcctcggccctgggtttacagctgtaaagctggcacacactaatctcagctctcacagagcctacattctaattgtctgggagagacagacaataatattttgtaaaaaagtaaaatatataggatgtcagattgtggtaaatgctatgaagacagagaaggggatggggattttaatggtggtgaggtggcaatttaaaaataggatattcagaaagtgacatttgaacaaagatctgaagcagatgtggatatctgggagaagacttctttctttctttctgtacatagacaataatgcaattataacataaacaatatatgaatacatctttgatttaaaatcttcaaataatacagaaatatatgggaaacaagggaacaaccttctcaccaccctcctattaccttctcctctctcccaataagcactttggcaatggtgtgttccctgcccaagcttcatctctgcatttacattcatttctgtatatactgacacaatagctttattttatttcctacgtaaatgagctcatcctttgtgaaggtgatatctttttattttcagcaaaaagagtcgtcttaacattttctaaaattcaaaggtatgtgagagctataggcctcattactaaaaatgaaatagctaaatgtgattgctaagtgtgggtaaatgttttacttcttcctttgggctaataatctagcatatactgaattctattgaaataatttgtttctgcctctgtctctgctactacacagtgaattttttgtggccagggaattaggtcttcgcatctattaatttcctgtgcttggtgcaatgcccagcatgtggtgtttggtaaatgaataggcaatcaattatactttcatacattactgtggaaggcttccaatactgggtgagatattggctgagatcaatcatctgccctaatgtggtccaatcttttctccattgaaatatctatgtcactatgggacacagccactgtgggatgatagccaggatgactgtggtcagatcctacaaatcagatagtccgattttaagcattagaattaaaaaatcaagtaatgagagctacctttcattcctcttgctgcaagaaaagagttaggacacaaatgtgctaagcacttgacctaacacttcttgttcaagacacaaaagtctcaatgaagtagatattattttgtggacaaggaaactgaaaatcagtgattaatatggatattagttagatccattcatgtgtctaccatacagacttatcagatcttaacatttccctatgtttgccttaatttttttccccagaaatattacaccagaggcccacgatcacaaattcattgattgattgagacggagtctcactctgtcgcccaggctggagtgcaatggcacaatctcagctcactgcaccctccgtctcccgggttcaagcgattctcctacctcagtctcccgagtagctgggattacaggcttgtgccaccacgcctgggtcattttgtatttttagtagagatggggttttgccatgttggtcaggctggtcttgaactcctgacctcacgtgatctgcccgccttggcctcccaaagtgctgggattacaggcgtgagcgaccgcgcccggctccacaaatttaattgcaaacattggatggcacatttaaaaagccacttaaaacaactttgtcattttattcaatggacatgaactgagcctcggtgctgggctaagctgtacggatacagaaaggtataaagctctgtccttgtgctcacagggactcactttttagtgggggtggcagacgtataagttttacagttgagaaactgaggcacagagaggggtggttactctttcaagaggcaaagccaggtttatacaccgggggtcaaacaagctggcctcttggtggactgggaggcccctacacattcctggtctgttggaacagtgtggattctgagtgggggcacctcttctctgggtgggtccaactgggaaggggagccagtttgacacaatgaagccgaatctgtgagaagcactcatgagtgtttttctctctttccactaaccatctttttgctgcaaagaattaaattcttttctggtgacacacacttcctgtcagtatgaggcacacccagccagacaaaaccacccaaagtaaatgaagaaaaatccttttaattcctctaggtccacagatttggtttctgctggattgttgccattttcccaggggtaaagccagaggtggatttggggaacagcaaataagaacaatacactgataagggtaacaccagtgacatgaaaacattcactatttattatctccaattaaaattccatattcttataaaagcaattctcatcatagaaaactcagaaagctaccaaaattcgtgtttatgggttttttttgtaaaaagaaaaccaaaatctctcagtctaaactacaatcactttaacattttgatgtataaactttctttttaaatattatatttgtatgcattatttattctggtctggtcatataactttatatgacaaatacttccttatatattatgcactttgttttgttttgttttgttttgagacagagtcctgctctgtcacccaggctggaatgcagtggtgtgatctcggctcactgtaacctctgcttcctgagttcaagcaattcttgtccctcagcttcctgagtagctgggattacaggtgtgtgccaccatgcctggctaacttttttgtatttttttagtagagacagggtttcaccatgttgggcaggctggtcttgaactcctggcctcaagtgatccacctgccttagtctctcccaaagcgctgggattacaggcatgagccaccacacctgacccattatgctctttcaaatataattacaaatataatatttcattatacagttgctctataatttagttggtcaatctattgttggacatttaaattttctatctttcagttactatattattaccactttagccaggcacagtggctaaatatgtattatatataattatatgttatatatatattacttatatacattatatattagttttatatatataatatatattattattacgactctaagcagatatttgccttattgagtgacatcaccggcctcttttcttacattatctcatttccttataagcctccagagtagacattattactgtattattactgttttataaatgaaggaactagaattcaaagaggataaaaaactgtcccaagttcaaagccaggctttacacctaagtctctttaactcctgagccaacactacctattgccacactctgggtgtgcctggtgctccctaacccaccctgagttttctgtcttaccagaacatcattacttgtgatgtaagagttttcttctactctcctttgctcaaaaaacttaatcctagtctcactcctttcatgttcccatgaatcccctggcctcttagtaaaattcgggttttccaattaaacgctctccattttaaagttcccaggcagctggactgatgcgattgatggttcccaactgctgtgccatgtgctctggtcctccttccttctcagctgttcccagaaaggcaggctatgaggttaatcacgtctctatgctgtaaaactgaatcctgatacactcactaaagccctcgtggttatttgtgccccatttgtattcccatttatattctgaaactttttcaaaatctgagatgctctcagcaactcagtacattctaaacaggatattaaacttttaaaaaatgtataaggcttaaaactctcttctaaattccagacttggaacagtttaattgacacccactcagatgttttgaaacttaacacattcaaatcagaattattgaaagtttttatatgtgcaatgattacatgtcaactaaaaaggggaaaaaaggttctgccacattataatccttttttccaactgtttatttctgttattttgaaagaacaatcagatggtacttttttcaaagacagtcacataaaaactgaaacaaaatatagattaattacattttttgaaaattgtgtgatacacgattatgaaatttgtagaaattttatgtggaaaaagaacaagggaaatcgagtgaaatgctttgaaggcatctatgacataggatgctgtgctcttcctcaccttccattcactttttaaccctctccaatgtgccttttccaccatctgaaattgttctcacaaaggtcaccagtgactttccaattgcaaatccaatgggagttttttggacctcagcttacctgattaatttgaggcattcaatgttattaatcagtaacactccttttgcaactttctttcttttgttgttttttgttttttgagatggagtctcactctgtcacccaggctggagtgtagtggcacgatctcggcttgctgcaacctctgtctcctgggttcaagcaattctcctgcttcagcctcctgagtagctgggactacaggcacacgccaccacgtctgtgtctggctaatctttgaggtttttttttttttttttttagtagagatggtgtttcaccacattcgtcaggccggtctcaaactcctgacctcaggtgatccacccgcctcagcctccgaaaacatttggattacaggcataagctaccgggtctggccacaactttctagtctcagtgtcatcacaaccagtttccagcttctctgacttttcttagctaccctgttgtcctatcactccctgcctcttctccagggttcaacctctggtccacttcccttctcacacttcataggaaaataccactcaagatcattgcctcccctctcaccacaacctacatctctatccaaaaactcttgatattttagttcagactgtttttagctattttactgcagagttggaatttaagagtctggagcttgcaaatacaaactttcattgcacttgattgctgctgttctgtgaactctcattaccttttccctgggtggctgctatatatcctgactggtttctctatccctagtctcatttcagatccattctcaacactcctttagaatactttctaaaatatggaaatctgagtttccacttctgctactggcagaatagttcctataagaccaacccttccacaaataaaaacagtagactattgaaaaaaaaaaaaacaccaatacaaacctgaaggctatggagaagaaccaaaaacaaacgctagacaagagccagcatttggacaaaaagactatcatgtgtgaaatatgcatttttaataggtttttttttttttttttgcctgagggcagaccccagtgagtactaagcagggcagctaaaatgcagatagatgcagtcttaccaaatagaagaataagagggaagcattcagggtaactatagcagctgtaaattgggatcaagggcaggaggatccaagaaaggataaaacaatggaaagggagcccaaaattttatgtataaaactctacctaagtctctggcaattctctgaactatgcatgtgtaagacagacgtcaagcagcccaactaaggccaaaacaactaaacagagatttcacttggtgtctgttttagtgagagatagagattgaatttagccatgttaattactggctaaaacaaacaaacaaataaaaataacactttttggatgaatgtaacaaaagacagagtccttacaacatatcactcacaatgtccaagacataatccaaaattattataaagaaacagggaaacatgactcatatttaagagaaagggctaatagagacaagctctgagatgaaccatatgttggaattagttgacgagaattttaaagtagttattataaccgtggttaaggacatgagaatagacttataatgaattaacaaataggaaattacactagagaaatagaaattaaaaaaagaaccaaatggaattgaatcatatacaaaaaatgcaatatgagaaataaaaaattccctgattgaacttcacagtaaattgtagatgacagaagaaagggttagtgaacttgaagagcagtcagtagaaatcactgacttgcagaacagagagaagaaaaattggaaaaaaaatgaacagagcctcagggaaagtaggccaatatcaaaggcctaacgtgtgcaattggagtcccaaagactagaagctagaaaatggggcagaagacatttttgaagaaattatatctaaaagctttccaaatgtaatgaaatgcatatgttctcagatttaagaagtttaatgaatctccaatagggtaagtacaaagataaccatcacataattcagtagtaaacaacagtaacaacaatgacaacaaagcctatggttatgtctataatcttttggtgcaaaaccttcttgtcttgtctttttctgcttatcaccaccctctttcttattttcaccaatctggagatgcatatacaaaaacattttaaaatccactttttggccaggtgcaatggctcatgcctgtaatcccaacactttgagaggccgaggcgggaggaatgcttgagcccaggagttcaagaccagtctgggcaacatagggaaaccctgtctctgcaaaaataaaaaaattagctgggcatggtggcacatgcttgtggtctgagctactgaccactgagctactgaagtgggaggattgcttggacctaggaggttgaggctgcagtgagctgagatcatgccattgcactccagcctgggtaacagagcaagaccctgtcacactcacacacacacacacacacacacattcgtttctaatcatggtgtatagatgcaagcaatattgttggttctatgacaatacttttaaaactacaaaaacaaatttgaaagtgatgtgatgtgaaaaagaatgaaatcatgtcatagccacatggatgcagctggtggctattatcctaagtgaaataactcacaaacaaaatccgatactgcatgttctcaattataagtggaagctaatcaatgggtacatatgcacataaagatggaaatattagatactggagactccaaaagggaggaggatggaaggaggccagggttgaaaaactacctgttggaagttttggggtactatgttcactatttgggtgatgagttcacttgaagcccaaacatcagcattatgcaatatactcacgtaacaaacctgcacatgtaccccatgtatttataataataaaaagtaaattaaaatatttctatataaaaataatttaaaaagaaagtgatgtggtggaaagggataggattccttataagctaattatatataaaatactctcctgctcttttttatttataattcaatcattccctaattaatttattcatctaatcatgaaacttgtttagtcacctacttgggggcaggtactgaggacgtgatgacaaataaggaaatctttaccctttagaactcatcatgtaatgatccatactggtcactttgagattctggtacttctaaaaataacttattatttttacttcttattataaaaatcatacatgggacatttagaagatataggagagcaaaggtaagagaattcactgtgaattaattattcattgaacacctattttgtgccattgactatccttattgctgggagcacagcgtttaaaaaaaaaccaaaaacctttctcccactctaatagatgagtcacataatgggaaaacaaacaaatgtatcatctattaaagtgggagaacttggttttgtagttttaaaagtattgtcatagaaccaacgatactgcttgcatctatacaccatgattagagaggaagtggatggagagtgtgtgtgtctgagagagagaatatttagaatgccaaaagcgggcacttcaaggaaggctttttttatttaaaaaaaattagctcattctacatactttagaaattacctttgagtagcaaatgttaaggatataaatactttgcacgtatattccttgtttatagttaaccatatgttattttttacctgcaaaatactaaaacatattctacctacgtgcaatctaagttttgtagcagagtctttttacgggggccaaacaattctggactaatttttaaaaccctgaaatggctcactgttttgaggttattttgatggagtatgaatttacttctttgtcatttggagaaggtgcacagtattattatgaacagagaagagctgtatgaaaactgatcttccagcatctatcatctccttttagtctaatgagatactgccattatctcctgatgaaatattgttctagaaaaccttaccccatcatacgatttctgcagatcttacaggagcaatctgagctcaagcaatattaattactgtttcatttgtccatttgtctgtgtataatcatgtattttaatgatcttctattttctatggtttgtgtagatttggagactaattcaaaagagttgaagttttttggacatgtttagttgaatgtgcagttctcttttgaagaatcctgtctccaaatcctgttttgaaaagagtgttgatgagtagcacagcacctgtcatattgtgagtgtgcaataaaatcatgccttttcagcagaccttaactaaagagttaattttatttatttaaatccacctttcagatgactctcattctgctttgtcagtggttgacgagggtaaaggcacttgaggatgcacaacacacaggacagggagcaagcctttctcagtgcggagagctaggataaacttttgcttagaaaggggtacattaatgacaaaggatcacagcattatgggaggatactacacacctgttcttcagggagtactctggacatccctgttctttccccacatggcaggtgtcttttcaggtgctcccaaccacactaccctgaattcccatatccgggttgccctctatgccagcctctcctcttagccttgaatttagctttgttgcttaaggcaagtcacttccctctccgggtatgtttcttcttctgaaaatggatgcagttgaactagatgagagccaggtggcttcaattgatgtgcggtggccctctgccctgcttactttcatctccaccactccaaggtggctcacaaacacgaatcctcagccccttggattgggttcaggggagtgctatcaggaacccatgggagagacaggaatgttttcagaaacctcagcctgtcctctttttactgaaataggggcccttgttgatggtagtcactgcccatgctgtttagcctaaggaaggtgacagtgggtgggccacctcaggccatatggaggaaggcctggcacagaaacacaaggccaggcaggctgtggctagcctgaatttagctgtagcctcagaatcaggggacttgggcttgacagctgacattacatggtgcacaactctggttaagtcacttaacttaaatcttatcccctcatctgtagatggcttgaagaccaaattaaggagctccttcaacaaatacattaaaaaaaaaaaaaagaaaaagataagccataaggcacatacgaatcacttgggaatcttgataaaatgcaaattttggtttggtagatctggagtggggctaaaaattctgcatttctaacgagctccagggtgaacctagctgatattgctgctgcttgagtgggccacactctgatgaacaaggatagaaaccattacaatagttgaaaatgaaaataacaatgaattatataaaccccacccccctcacaccactttcacgtctgatatttttcagttaacctaaaaatgtttattattacctaataaacattttccatgtttctacagattatatggaccgcaaagtttctgtaattactattatggagtagctacacagtatcccatagtgttgaactagcatcatttatccaattgcttccctcacactggaccagtgagtcctaggaagtggctgcaaggaagcagcaggtttctgggacagcccaagggcatttcttatttcctcctgttcctccctgggatcaatctgtaggagtaaactgactgaagactgtgaacaccttcatgaactcctgtgactttggacttgttttccaaaaggccaaaattatagatatgtacatattttgattattaaaaatatgtgtttccttgtacattgttggtgagaatgcaaaatggtgaagctgctatggaaagcagtatggagtttccttaaaaaattaaaaatagaattaccatgtgatccaatcaataatcccacttctgggtatttattaaaaagaattgaaatcaggatcttgcactcccatgttcattgcagcattattcacaatagctgacatgtggaaacaacctaaatgtctgtagataaagaaaatgtgtcatatacatacaatgggatatttttcagccttaaaaaggaaggaaatcctgccatatgcaacaacatgaatgaatcttgaggacattatgctaagtgacataagccagtcacaggacaactactgcgtgattcccactgacgaggaatctgaaatagtcaaacttgtaggagcagagaatagatggtggttgcaggcactgggggtagggaaaaatagagctgctattcaactgggtataaagtttcagttatgcagctggataagttctagagaactgctctacaacattgcacttacagttaaaacgacggcactatgcacttgaaaatttgttaaggccagcgtggtggctcacacctgaaatcccagcattttgggaggttaaggcaggcggatcacttcagcccaagagcttgagaccagcctgggcaacacagagggactctgtctctacgaaaaatacaaaaattatctgggcgtggtggtgtacacctgcagtctcagctactcgggaggctaagatggggggactgctagagcccaagaggctgcagggagccatgatggcacagtgtgctctagcctgggtgacagagtgataccctgtctcaaaaaaacacaaaaaattgttaagaggatagatctcatgttaagtgctcttaccacaattttaaaaaagttccctatagaaaagtatttttaaaatgacaatttccctaacaccactgctaacattttgattgaaaaaaaaatcattaatttgttcaataaacatttatcatacacttagaatgtgccaggttcagtgttatgcatgaggatgctacagcgaacagtttttctttctaggcatatgtccaacattatccatcagtcaatctatataacaaaaagtagatacaatacaaaaatatacatgtacgtatatacactacaagatgtttttattcatgttttatgtgaatagcaagaccaaaaaaatcattaattgggcccagtttaggccagcaatggtattctgtcccctggatgtacacaaataaaaacaacgcagctcattccttttaagcatcttaaagtataccaaagtttgttaacagccaggtatgcacacgacagagaatgagttccctgacatcagccggaatctatcaccgggtaaaatggatggaaacctctccctgctacttactgcttattgctgttcaggcactgtttaatttctcggtgccttaatttgtacagagatacaaatgccatctctggttgtggctgagaagaatgaatgaaataacgtacctaaaatgttcacagggcctagcatatggcaagcgctccctaaatagacattgcttttgttgtcattagtgctagtgatagaggaccttgggtttgggcctcattgtgccactaaccagcagtgttattttgggcagcagtgctgtccctggacctcagctctacctctgggaaatgcagggtatggaggaaactggtagttcagcatttggagattcgtggcaaactatcaggcacaactccttgaaatcttccggagttggcgaggcactgcggggctgattagatggggggcaacctcgcggtcccagctacaacctcgccgagccagcctccagcccctaaggtgcgccggggtggcgcaggggcgggcagctgggcgaaagcgagtaccaggcggagggcgcagcctcagggggatcctgggcgaagagctgagggtggcgctggtgggggcctttgagaggccgcagccgagcccatggcttagggtttcgatgaaaacaatagctgcgaggtttggtttcctgggcacaagggtggagaaggcccgggaacccttccctttccaatcccggtgtggccttctgactggcagacaatattagaggtattagctttcctcttgcccccgccccccggccccgccaggccctggcccttcctgcaaggcaatagtgcgcctgagaaatccctgtggtgccttgttctctctacaaaggcaatgaattctcagcacaatttggcttggagtaggctctcaagataattgttgaatgaatgaatgaatgagtgaatgagtgaatgaatgtcatcagtggggatgggcctagggcaccagcaagatcaggagatctcatctttcatcctcaccttctttgttcactccatttgttcacatctgtacagaattttcaccgttgtgttggtcacagcgggttggtgcaaaggggtcatgttttcaggtaagagcagcattgcatagtgagcagaaaccccagatgagtgggacttctctgagttctgtgtccacaccttggggactcagacgtctattcctgccttctattaagcttgacagcaaactcagcagatgtaaatattgacaccttctggaaaagtgtgaaggtatttgttaaagaaaaccttaaagaaagggaggcagacattgtgagactttttatgcctttcagggtagcttcaggacttctggatggtttaatatgcttcaactcagcatatgacctaatgattcatttcttagaagttgaatctgaaaggagtgaggtttttagctggcattttattttgtgtctgcttgtggcgggaaataacagattcatatatgactctccacctcctgaagaggctagagcaagagtatcaatgatgtgccgtaggaagagcaccatacgtttgaatggtgccttatcactgtcctgggctttcacatgctttatcatgcttaaaacccatagccctgtggaatagccagaaagagattattattccaattttccagcattgttacttcagttattgaatagccactatgtgctgaatattagaggtacaaagagaaggaaggcctatctctgcctttagcgcacagtctagtgaaagagaaagatatgcacatggatcatttcggtatgacatgttacctgatagggtagatcaagcccaacatctgtttttgaaaataaatgggtttttttgtttttgttttgttgctgttttgagacagggtctaactctgtcccccagactgaagtacagtggtataaccatagctcactgcagcctctaacactcaggctcaaaggatcttcccatctcagcctcccaagtagctgggactacaggcatgcaccaccaggccctgctaattaaaactttttttttttttttggtggaaatggatctcaatatgttgctcaggctagtcttaaacttttggcctcaagcaatcctcctgcctcagactcccaagattctgggattacaggcatgagccaccatatctggcccagtggtaaagttttactgggacacagctttactcatttatttatatgttgtccacagatgcttttgtgctacaatggcagagtttagtgtaatagttgtgacagaggctatccggcctacagagcctaaagtattgactattgaacatttatagaaaaagtttgctagcccatagaatagaggaataatgctcaggtgggcgggtatttagagttggggtacatagcaccacctgggagttgagaaaggcttcctgggaaaggcactgcttgagctagaagctgaagggtaagacttgtgggagttagaaggataagatgggtactccaggcaaaggaaagccaagggactaaactgctagaaccacaagcagttcatgattactaggatacaacatgcaagatggggacggaagcagatgaggaaatcagtctcgacttgggtgatttgctggaggtgatgtgtctaggtggggcaggactaaaatccaggttttctaactggcagccctatgtgcttatcacaacagcaaggacagcaaatacacagcacccatgttgtcattccttcaacctgggtccacagtggccagtgctaagtgagcacagaagtcttttctgcagctttatttgtactccaggtgactgtttgtagagtgagtgtgcatgttcagacctatatgctatccctgatttacctcattccagccatagtgagaaggttttagatttatttttctctgaagctattagaaaaagccttcagaagcaaaagctatcaattcaagcagccctatttcagcacattctaaattattgcttaccctgcctatgccaggtcatacaccaggtggtttacacactttatctatcttaatcctcacttcaagatcatgagggaggtagaataaataagtcacttacccaggggtctggaagtaagcattttaattgttcaaaaagattttaaaagattatatgtagtccgggagtggtggctcatgtctgtaatcccagcactttgggaggccgaggcaggtggatcatgaggtcaggagatcaagaccatcctggctaacacagtgaaaccccaactctactaaaaatacaaaaaaattagccaggagtggtggtgggcacctgtagtcccagctactcaggaggctgaggcaggagaatggcatgaacccaggaggtggaggttgcagtgagccgagatcacaccactgcactcgagcctgggcaacagagcgagactccgtctcaaaaaaaaaaaaaaaaaaagattgtatgttaaaaattacaatacttaaggaacaacttggtgttgtggtactgtatagggctgggttgtaaatgaccagtgggcatgccagaggctcagcccatacatcgctagtggggtatgaaccattatgcatgattgcagtgaccttgtgacctgtagcttgtaaaacagaagctgggatgattattgtttgtttatattttgctggatatcatattttttataccttttaactgtgattgtggaaattgacactagacatccatcccttaatccatgtagtaggtaagaacatacagataaacacagggcagtggggaggggaaagaaaaaagaaaggtaggaaggaaagaaggaagaaatatatccagaagatgcaagacctggatcaaatggtagcaggaaaagttcttttgaagatatctaagtgttggaaatatcattcatccaggacaggtaaggtcctggacattccagtgagcaatttccctctgtgctgttatttttcatattttggagagaacactaaggcctgaagaggttagatagcttgcccatgctacttagtggtagactcagaatttccacactggccttccagagtccacaatccaagatcttaactacgattatattcatctttgatccttgggaagaagggaagacattttcaattcaggcttgaaaacataaagtagctgaatgaagcagtgtggaattagcagagagcagaaaaagtaagcaccagtctgtgtcttgatatcatgttgtttacatcttgctttggatttttttaaactgtctttctagaaaaaacataggtagtagcatcatgtacactaatcttttctcctcagttatccacatctggaagtagtttgatagctagatgtatgatatcatgcctgttagctgttatctggtggcagctcaccaattatccaatttctagggcatctctctttaaaatctgtttcagaagtcttggtctgacagaaagccaggtacacctgaagtggccgaagcttgggtgaggacccttatctaggtcatccaaagataagaatgagataagctgaataacaggtcttaagaaagaaaaaaattaagtaccaatgcctagtccaaggatagagaagactccagctgggagatattgccaaaggtcagaagacatgctgagtctaaatagagcagtagaaattgggagcaaatagataaggttttaggggaggggttgtagagaatgtccctatagtttctgagcacaggtggctcagtttataagtacataatcttcctaaatgaatattctaagggtcaactttatttcagtgaaagaaaactccacaaattgcttagacacactcccatctatccatcatctatgtagacattcagtagacatgaattgacaatctactctgtgctcagcaccattctaggctccaggtaagcaaagatgagcaacacccagtttctaccttgaaggatcacccatgcctggttcagtagagacagagacatgagtttcctttttatctattttcccccagaagtaccctggttttcataaatgaccatggcttgacatgccattatgataataatgtataattagtggaaaaccaaaggaatgactggaaattgtctttagttatgggaacagctgggcttctcaggataacgctggaaaatactatactatgtgagcaaggtctgtagggtccgggtttctctggaggtacagctaattcccttccaaatgccagctttaaattctgacattttggcatttatgtgaatgactgtatgactatatatgtaggtgatcggccctctcaagagactttgaattagaggctttctggttttgataaatgcaccttcttttcctcaaagtcctttataactttttagaccagtgacctcccttcttagcatctccttggctagaagcagaagacagtcaacctaccattttgactgtaattcaatttggtttcaggcacttttaataatttggtattctgttatgagatgaggtatacaggccacctctactctttcagttccgacagcaggaatagaaaagatggtagttttgttcaagccagccattcatttattctctaaacatttatcatgccctctgctgggacaagagctgttttcggttcttggtatataatgtagataaaataggtgcatattggtcaatgtccccatgaggtttactctccatcaggtgtagggtgtcagacatttggcaaataacctcacaaataacaaagtgttaataaggaaaagactaggctgttatgaatgtacaatagtggtgggcctaatttggattgggagacagggaagacctctttaagaaagagatgataagccgggtatggttgctcatgcctgtaatcccagcactttgggaggctgaggtgggcggaccacctgaggttaggagttcgagaccagcctggccaacatggtgaaaccccatctctactaaaaatacaaaagttagctaggtgtggtggtgggtgcctgtagtcctagctacttgggaggttgaggcaggagaatcgcttgaacctgggaggcagaggttgcagtgagccgagatcgcatcactgcactccagcctgggcgacagagcgagactccgtctcaaaaaaaaaaaaaaaaaaaaagagagagagataataatgctgaaatttgaaggagtgggtactagccaggcagagtctgagaaagagattccagggagagggagcagcatatgtgtagactctgagctgaaaagaagaggatgccgcctatatactgtcagaggcaaacacaggtgtgacatagtcatggtggggaagagtggcacaaaatgagcgtggtgaggtggctcagagccagaccatgcagggccctgtagcacctggtaaagaatgtggatttcattctgagtacagtgggaagtcacaggcaggtggcaagcagaaaagtagtatgatctgcttacattacaaaatatctctgaattctgtgtgcagaatggatcagatatgcatttaagaaaagcagtacacagcctgagtcatcaaatgcatattgcaaggtgggcacagagcctgagcatacgggcacatgcaagccgcttcctcctcctgcctccctgtaccaaatgtcccgcctgggaggcagaatgcagtttacagaccttgaaaccaagtgcaaagtgtctacaattagaggagaggaaagcattgaggaggaaataataaatcaagtattgaagatctcaacaacttagagaacaagataccagtcttaagtgaaaagaacacatttggcattaagtatctcaggaaacatgtccttcaggtccattgactcagaaacatctctattttcaaagaggcatttagtcagctccttccctcatctaactcaatttcctacttccctccatcatagaccatgcgttctttggttatcagatttgcctttggatttttttttttaaagacaactaaaaacatct

SEQ ID NO: 2455 - DNA, 2725 bp, Homo sapiens
taggaatggtgtatttgaagtccctgatgaggccattgggaagtctgggtttttctgctgtgcagacagtctttgcaagggctggcatgggcccagaaatgcaatcctcgtgcagagtaggtgcctgtggcaggaggccatgcaattgggctctagtcttgcttcattcaactgaaccaggaaagaaacagatccacgcactctgatacccatttccgttgttctaggaggtaaatgatttcgttcctacaagccagacagtagccagctttcactaaagaagaatcgactccttagtatcttgtcatgccattggttctgatgcataagtgaaccctgtttttaacggaagctccttttttttcacctcaggacctacccaagactgtctagatactggcaggacaaggtacaggagttttcagcagaaagtggagttgccaggagagatgctgggcacttgcactgtgactttggagtgccgggaaaagttccagggtccccagtgcttacttagataaatggcatttaaaatagtgcagccttttatcattgcttagtctaatttagctccccataatgacattctcactgcaaggtggtcattgctatcattttcttttgggtgtggcagttaggtatgccacgtgagctgaacgggtttcacatggaatcaaagtcagaatgttcgaaaaggacatttgtgtttttccttcaatggtgccttgaaattgggctccctccctcttgctgtgtggggaactgggagggtatagcccaagcttgctttgtgatggacagctagaatgtaaaagcttaaactatggggaaagtcttgcctgttttccaaggcttcctccaccctgccaccgaagaacttacctggatgccaacctgggacccctttgtctttgggcttttgccctttgaaactgtgaatgcttcaagagccacataaatgctctggcagtgtctccatgtaactagtaaattgtcctggctggattcgttgtgaaatggaactgtcccatttactttggttgcaaataaggaagatgtatgagtattggcctggaaatgagccctctagtgtagagaggttattctgagggtttaaactacatggataggccttgggttcaaggttacaggaaaggctgtaagcctgagattgtggggaatggccagagctgggctttgggtgttccttgtgggggtccctgtgaaggtaagacagaaaggcattctgggtgagctgcctcgggtcagcccaggggtgcaggctcctctgactgggaccacaggcagccacccgaggccactcagatgccgtgactctgagaccagagggaagggaggctgggcctggtcccctgtgttcctcagcaaagtgccacatcagtctcctgagaacacagctgtgtgttctttccagtcgcttctgttcccagacttcaggcaacatggcagctcccatacttgccagggtagttggaagggcagctctggagacaggaagtggaggtagaagcaaaggaagggagtccttggctgggaagtgcttgggttcggacagacagggaagaagggaaagtatgaggtgtgttcagggaagcttagaagggcagagaggtttcagtaggacatgtatgggctaaagggtcagttagaaccagagtatggagagtctgggatgccatatacaaaagtttgggctctaacagtctcctgatgaggagcaattttccaaaacatgaaagaattattctaagaatgacaaagggaagttaatataaattatgactaccacagggtttgaatttacacactgaccaccacaaattttataactgtagtcgtctcgatggttgtgatgcccatgaggtgttgggctgggggcatgatgacgctgaggcaacatgagaggggacgtctttgacaccagggccccagccacgtgtctcaggggctcccacttgccatgggactcgcagctggttccatccgatgccagccccagtgcatctatcactgtcttcacaaaacgggggtcctccaggagttctggacagctgctctgcagattcttatatacctttaatcgaaggccttggacttttgagaggagcgcagtgccctccttttgtgttcaggaaggccaaattagagccttctccaccgccggggaatattcatgtgggaaatggaggcctgctgcagacctgaaggtcaatgattgtttaatctttctttgacagcattatgaaggtataatgggcatacaagaaactgcacgtctttaaagtgtacagttggagggtttttggcatgtgtggacacccatgaaacctcccccataatcaagacagtgaattgatccgccactcccaaaagtggccttgcgcctccagcaacccctctttcctgctcctcactgtcccccatccccaccgccactgcttggcttgctgtcactatagattaattcccattttctagaattccatagaaatggactcatacagtgtatgtctggcctctttcactcagcacaattcttttttcatcaggtgtttttgtgcatatcagtactccatttttttttattgttggtaggatcccattgtatgggtggaccacaatacctgttgaatacctgttgatggacatttgggttgttaccaggttttggccatgacaaataaagctgctgtgaacatttgtg

SEQ ID NO: 2456 - DNA, 656 bp, Homo sapiens
ctgggctacagtgatcctcttctgtcagcctcctgagtagctgggaccacaggtgcacgccaacatgccgggatcatttttttttttttttttttttttacaataggccttcagctggattcatttattttgaaatggtggacaaccgcagctgcagacctcaatctatggtacatatcaagcaatgcaactttttcttgtcatgtcatgacttttgtctgcttcttgggagcacttccaccatcattagtagcacttgatatgggtcccatgatattattcaaattatttactgtattgtgctaaacatgatggaaaatatggaactgctagagaacactttttactgtgatacacaattgactggagagatgaactgctcatttgaagatgattagcgtcacgtggcattttaagtgaatactcccaacccttgagctcatcacaatggcaacagaaggtggctacaaaattatcagtcgtacagtatgtactacagttaattttatacagttatgatttcatactgcatctttatctctgtttacatttctctggactgtgaatggcgtcacgtagtctgtgtgcaaattgttttgataaattataattaaaaaaaacttgtgtatattttatggtagtaaatgataaaatgc

SEQ ID NO: 2457 - DNA, 2903 bp, Homo sapiens
aactgatgtaaagatatttattgtcaaaatatattcaccatacatgtaagaaagaatgtacagtataatcccaatattactttcattattatttttatctttcgaggcagagtctctgtcaccaaggccggagtgcagtggtgtggcctcggctcactgaagcctctgcctctcaggttcaggtgattctcctgcctcagcctcccgggtagctgggattacaggcctgtgcaaccatacctggctaattctatttttttttttcaagtttagaattcctggtttattgggaaaacttcataatgaaaacttcaattgcccttttccatgacttacaaaataataatgtgatatttaaaatgaattgtttttcattatgtaagtggaaatggtaaaaaatagtaataacccatttgatgcatcatatatatgctattcagggaaactcaaatccctgaattctcctgtggcatgttttacatcagacattttaaatctgtttaccaagaaagaccaggattttaactatatgtaggtttctacttacagttgcaatctatcagaagcctgtctatatgattagagcccagatacatctgaagtttagaaaagcaagccatttttctccttaggctgttttagtggcacttttgtgacaggaagggctctcctaatcctttagtacacaacttaaccagatctatcagtcatgataaattagactgatatatctaatctatcagtccatctttcaatccagttactctggttctgaacctataaacacaaaacactacagatttattaatatagcattttccaacaccctaaccctatacagaactttaaaagagaaaatttcatctaaatatttcacacctaagaaagccttactaaccacggcaacaggtttggaccacaaaacaatactttcttagatgatatatagagtcaacatgaagcttagcaagaatgaattattcagggctgggcgcggtattattctttcgtgcttgtcttaaagttgtacatatgcttagaaaaatgttggtaggatagtaactcttcactggtgggatcagggatgacttttgttttcattttgcttgtctttttctttaatgagtatgtattacttgtgtaatagatgaagtaaagcaggaagaagggtagacatggtatttgagatacagcattggaggtgtttgtttgtttgagatggagtctcactgtcacccaaggtgaagtgcagtggcacaatctcggctcactgcaacctctgcctcccgggttcaagcaattctcctgcctcagccttcccagtagctgggattacaggcatctgccaccacacccagataatttttgtatttttagtagagatggggttttgccatgttggccaggctggtctgaaactcctgacctcaggtgatccgcctgcctcacgtggtggctcacgttgtaatctcagcattttgggaggccgaagcaggcagatcacctgagcacaggagttcgagaccagcctggccaagatagtgaaatcctatctctactaaaaataaaagattagctgggtgtggtggtgcatgcctgtagtcccagctactcgggaggctaaggaatgagaatagtttgaacccaggaggcagagattgcagtgagctgagattgagccactgcactccagcatggatgacagagcaagaccctgtctcaaaagaaataaaggtcaggcgtgttggctcacgcctataatcccagcactttgggaggccaaggcaggtagataacttgaggtcaggagtttgagaccagcttggccaacatggtgaaatcctgtctctactaaaaatataaaaaaaattagctgggcatggtggtgcccgcctgtagttccagctactcgggaggctgaagaatgagaaccgcttgaacctgggaggcagaggttgcagtgaggcaagattgagccactgtactccagtgtggacgacaagagtgagaccctgtctcaaaagaaaaataaaggccaggcgtggtggctcacacctgtaatcctagcactgtaggaggccgagacaggcagatcacttgaggtcagagtttgagaccagcctggccaacatggtgaaaccccatctctactaaaaacacaaaaattagctgggcacagtggcagacgcctgtaatcccagctactcgggaggttgaagcaggagaatcagttgaacctgggaggcggaggttgcagtgagctgagattgtgccactgtactccagcctgggcgacagagcgagagtccgtgtcaaaaataaattaaaaaacaaagttttaagaacagcctttaggtttctatagcccactgcgaaaagggtatggcatgatcagatatttgcaggagtgagaaatgcaaatttaaacaatcaaacagcatctaacacatctttaacaattaaataccataaatataacaaaaccataaaaatactgataagcttctactatgaactacatgatagtgacagggcagtgacagcaaaggtcctatctgcccactgttgtattaccagcatctggatcgtagaattttgcttggcatgtgacagggctttgtcatttatactgagaacagatcctcaagttatcaataataattgataaaagcaacagtaatcagtattttaattgctgtaattggacatttgaaatagcagtaagattctacagagtggcaatgactgagttggaatgtaggtgtttccattaatgtcctacatatatttaaattcggagtagccatttttcctggtaaattgtgaaagcaggacatggttctccaaggttcacaggtaaaccatcccaccagagcactaatgagcagactgctacattttac

SEQ ID NO: 2458 - DNA, 7075 bp, Homo sapiens
cttgtgccacacattgcattttaataaacttaatttaatgaagcgctgcattccacaagtacagtcagtacagtagctctcctttgggatggaaaaattacaagaagcaatgccgaggaccgtgaactgtatacagaagccttgtggatctagaaaccaacagtgtgtgaacttaggacattctcaagttttaaaacgtggccattataatatcatcacattacataaatatcacatcaccaatattcgttttgtttttttcttttagaaccaaaaaaaaatgcttgtaaactgcaaaattactttagatcactgcgataaatctgaattaactactaggtaccgtcagcccttcatatttgtgagttacacatctgtggattcaaccaaccctggatggaaaatactcagaaaaaaaaatcagtacagagtagtgtctgtactaaacaggtacacacttttttttcttgtcattattcactaaatacagtaataacaactaattacatagcatttacatattaagtattatatgtttagagatgatataaagtatacttgaggatgtgcataggttattcgcaaatactacaccaagttatgtaaggcgcttgagcatccatgaattttgttatcagcagggagttctggaaccaatcccccatggatacctagagacaactgtaattgcaaactacttcagtgaataacagaagctaactaaaaacttagttctgaatgattggattgtctgttgcactctacctactgaagcagagtgtttacatggccacaggtaattcattcagtaatttcagggtatgactcaagatgcagtattcttctctgcggctcttcgccttggagcacttggaagatgcattatctgctgaaaaaccaatgttcagtgtgggctgatataataaaaattaaatactttaaaaactgaatcaaaatcatagctaaaaatcaatgctatatagtttctatgacatgaaaaatctgtgaacaaatcatttattacaggtcttgttttatgtttctcttgtcaaagataattatttattacaagtgaggtttctgccatcagcagagtcaagggtaacctggagtgcctacctctttgaattgtgatactcaatcgagtttatccatgttaagtactgagcacagcacttggcctacagcaagagctcaagaagtatttgtgattttattatcgctaagtaaaaataaatttgagtttcactaagatttttgaaattcacattttatttgcatggcataaaactagcctattcaacaactccccataattaaacttgaaaagatcctgattatttataacagaaaataattatgtccctaattcatttatttgccttttttttttctggttgcctttgattgacttctgaccttaagcatgaacagaaatgtgtgctaaaaagcctggtctttccagtgaagagtcaatcagtttgccaaatgcttactccataattttaatctaataacattttactaataacattttatgaacaagaacttactttcacatccagacaatatttttagaataaagctcattgcaccttataatgtgctttatttaatgtcatcttctaccatgtgcaagaagtttgggggagtatgggctagtagagatgtttacaaaggtcttgattgaaagacccacagggctttgttaattggttttaaagatacttacaatttctctgcaaatacatagaacaaagacaataaaacgttatttagtaagatataagtcctattgaatcagttggtacccactttcatttatagacccttcagagctgaaagggatggggaagagggtggatgaagaaggtctaatggagaatacacagaagaagcagaagccatggctcctctttttaacaatgacagagaaaggaaaacaatggacatagcaataaacatttgctcatttaattttagtcaagttaaatcaaatgtaaaaaatgtgtgccctataataataaatgacacaaaaatactaattagattcaagagagttgaactgaataaccctttaatcaatttaagtcacacagtaagtgtccttttccccagtatttctcataatactacatattaattgcgcttatggttattcagtcttattatttaattataaaagcttatagcttttactttgggggcaaagacaaagagaagaaagtgttctctaatcccttaaggaacaagaatatgacatttgccaatgtgcgttgtgtttatggagacttctttcaactctgttcttattttcatcctatggaggcatcctgaggtaaatgggcagttatggaccatcaaatgcgaaataaatgttttaatgaggaaacacagcttgctcgttcaaatacaacttaggattttcacaagctgttttcctttcttctattcctcttaaaacaaccatgggaaaacatagctacagagaggtaacaaaatactatgtaaattataatcctgattttgtataaaaataaaagtatttattgcatatcataaatgcataggaaaaaaaagattagaaaagtacagaccaaaatgttaccaatgtttattattgttaacatttcgggtgggactggaatgataattattcttaagtttttctgaattttctcaattctgcatatcattgtccctgaggccctccagaatctggccttgtgctgatatggcaactatgggaaacttgctttattttttatatgctaaggaaggtaagtggcttgacgattgcccgtaagaactgtcaaaaggccacagaaactgctcagcaccaggacacagagctgcattgcttgattctgcaggctgcacatctaagaccagatgttgtcctcatacataccagccctgagaaaaaagtttcttggatttgttttcaagaaaaacaagatattgagctttgttcccttgtcaaagaataagaaactctcctattagcctttacaaatcaagacagtcaaacagatctgagatagtaactcatatctagggatcaaccaaagtaatcccctaaaggtattaggagaattttcccagatatttaagtttcattaaatgcaaagttagttcactggtacctactattaaaagtaacagaaaatggcgaggtgcagtggctcatgcctgtaattccaacagctcaggaggctgaggcagcatagcttgagcccaggcgttcgagaccagcctgggcaacatagtgagaccctgtctctacaaaaaataaaaaaaaaaaaaatagctgagagtgctgacacacatctgtagtcctagctactcaggaagttaagggggaaggatcacttaagcccaagagtttgaggctgcagtaagccatgattgcaccattgcactatagcctgagtgacagagtaagaccctgtctcaaaaaaagtaaacaaaagaagtcacagaaaatgaccacacatttacactttgtaaaaattaatgctgcctatacatttctggcaggcttgtaggttatttttctcaggcctagatatgctgggataatacagggtcagcccctccagaaggcagaacactagaccatcgtatctagaagcctcaaaagtcccatgaccctagtcagctttaaatgttgtcttttccctcatctctccatctaaacaatctgcaagtcccactgtctacccctgctgaacaccgccagaacccattctccccttccatgttcatttctgcaaccttggtccaggccatgattatctctcacttacattgctgcatcaaccttgaccttcactggtgtctctgactccagactttaaccttcccaaaccagtcttcctattaactcaggcctgatcataacacttcacagcataatatttttgcatgacttctaattgccctcaaataaagtcctcattccttgacaggacctagaggatccttcccattcagccccgtatttcacatagcatactaccctcaaccccaactctcactcccctagaatacctagcaccccagccaggctaactacttgatctctcacccctggcctttgcacatggggtttctctggctagatcacatatccccttctcccctttatctgaataaccccactcatcctcctggccttaggtttgatgttacctgctctggagaagcatccctgatcttcttgacccagttagatattccttttctggatcccagtgtctctgatatgaaattgcccattttctgtcttccctactaatccataagccctttccagtcatggactgtgtcttggctcccccaacacttaacatattacctgacacataaaaggcattcaataaatactgattcagtcagaagcaatatcaagtgttcttggtttgctgaagatagagtctctagccatcctcaccctcctcggcaaagaaccaatcaaatctttgggattcgattggttcaaccacaaaaccatttcctattcctcctcctttacctcttacataaagagggaaataaaggaaaatgaccattgaaggttttgtatcaaaattcctttttggaagactacttataatttcctactttagtctgtctggtcatgaagaagtctgaactacacaaatgctgtggccatgtcatgagacataaaattagagaaatgattcaaatgcttttggtcccttcctttatttgactgctaattaggaagagaatattgagatggacatgacactggttaataaaaacctcagtttcctgaactgatgccaggtttattcttttgagactagagcagatgatctacccaccttaaaggtaataaaataatccaagtggatgcccactttgcctgcaactttgcttgcactccattcctatacctatacactttgagaaaaaagataacaggattttccccccacagataattcttctgtttctactcctcagttcctccatccttaacccacaaaaggttacacctctcagcaacatccatctgaagaatttatactctatattacaaattgttgatggttatcacttacataagtgatcttttcctgctgcttcttgaaaagagaaagtaggatatttgctttactaggtggaatatgtaagtttttttacatcaatttttttgtgcttttacacaaactagaacatgggagcaaatgacttgtttctttgtgcttttgctgctacttactgagggaattccttaattacttccttccttccttccttccttccttccttctctttatcctatatgcacatggtagaaatttgggttaattaaaagggagttagatatacctattaccccaaataggacactcccagtgcatttgtattacagcggcttgcaaaataaatgctggggtttttttctgcatgcagaaattaagcaacaggattatgtttccagctatgttaactgccagtctataattatcagggcaacatctctccacagctcatcttcagcttatcagtctaggagtgctaaatgtgcacatgtgggacttttactaagtcagtaccattattttgctttcaaattatttcctattcctagaagtttatattcagtcatttgaagactgtgcaattaaagaagatatctaactgagcttaagctcatttaaagtaaccaagcaccttttacctcctcatccatcttggacttcagttccccacccccagctatgttcattctaactactatgagataatattatttgatggagaaggtggaggcaaaatggatttgtgtagctttatggtcccttctcctgttaatgatcttcctcatttgtattcttctccttgcttttctctatattttttcaagcattggtccattcagaactttggcatcctccagcactttctaatgttttgtgccatttttatatttgccttgcattatgattttcctccatcttcttctaccatatttctttgcttgaaaccacaccttcacataccataaagggaagagattttttttcagttgtgttcctgcctcttcaaattcctctgtggtcataaaaaagcctgtcttgccaaaatgtcacgtagctataaccttgcgccaaatagtacatcttgtttccaaaagctgtttttttggcagctggtaggaacatggattattcatatctgcagaaatcacaatccctgtggaggatttgattcttctcccccaggttgtggctgtgattggaaataaggtgtttcatttggacttctacaggaagaagacacctggaggcagacacagaaggaagagcgaggtattcagtatgctccatgcactctatgtaattttcggatacctatataaaatgttttggcttttaacgcttagcatttggggaaaaaaatcataaaatgaaaaaccacttttaattgactcttcaaaaattactttaaatgtgttctaaaacttggctttaaaatttcttcatacagttttgacctatgttaagagatacaggtactttaagaaagtgtttctggaaaattgtatttgaggcagtttatcagctgaaggcacagctaaggcatcgctaagggaatctgttaccctgggatactaattaactccaaatattgcatataaattaagctagcagctactgaaagaaacagcttatgggaaagaaaaaactaaagaggttggaaagaaaagcactgtcttttctaattagagaaaaagacatcaggggtatgggagaaacccttttctctccatcccagccttctattctttttctagtagcttccatccttttctctttccttgttttcctttctcctttctccacagcaggtgtgatttattggatagcatgaccagggaaagtgtctcttcctacaggggactgctctccttgtctcttttgtgtgtgtgtgtgtgtgtgtgtgtgtgtgtttgtgtgtgtgtgtgttaagaacatttaatgtgagatctaccctcttaacaaaaatttttgttttgttttgttttttgtttttgttt

SEQ ID NO: 2459 - DNA, 500 bp, Homo sapiens
cgccgcctcgcctccagcagctctgcctgccttggtgaggagaaaaaaatgtttaactaatggaaaaagaaagcaacatcctaacgccctacaatgaggaagaccccatcctgacagtacttagatgcttccatataataaatacagcaggtagcagagcaaagtcacaaatattggcttggtttttatttctatgcttataaaaaaaatatgaagcttctttgtgtggactgaaggggtgttagcctgtggatgttggtcttcggtgcctgtaccccagtggctgtttacattccaggcccctgctaaataaagcaggctccactgccagctgtctgtacactttttcttgggggaagagatcttgtcttcagtttactgcagtagggttcctggctctgttacatgctcatgtgttccggaagaacatatgaaatatcatcccacggatgacgatacagcccctgcttcagcctcttctgatcaagatagtgtcctaa

SEQ ID NO: 2460 - DNA, 781 bp, Homo sapiens
gttgaagaacatgtcacaccagcacacgccgccgtcgccagcagcaggaagttgttgatttgcagcatattcacactttctgatgcagtcagagctcactgcttctcagaacagatccactcagaaggaactccagtttctgatgtttattttactttttcttccccccaaacaaggcacaaaaggggaaaatgaaagggacacaagaaaaaagaatcaagggtcttactgaccccatcacacacctcctctaatgtcatggctggaaggaaataagaagcccttcctcgggagaatgccagaggcccttgattgaagtcaaggacataagggatgacctcctcccagtccccagccctcaccttcgccttgcgtttgctgtcatccatgatcatcttccagtccgagccgttgttgctgtacccgatcttgaacttcctcatgaacaccttgttctctcggtgcttcccaccctgaatgatgatgcccctcacgatcttctcctcccccaggtctatttggagccactcattgatgtaggaatgaggtgcgggtggaagtgcccagccagagcgactggttaccaggcggatgttttcaggcatccagtttctgtccccttggttggatgatgtgatctgggagtcagaaataagtccagacaccatacccaacattccagagcaaggataatctgggaagtgaaatgaaacagataatgtaaaatgatttcctgggcgactccatgctaagaaataaaatacaacatatggaataaaga

SEQ ID NO: 2461 - DNA, 478 bp, Homo sapiens
atggcggttctctggaggctgagtgccgtttgcggtgcccaaggaggccgagctctgttgctgcgaactccagtggtcagacctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcccgggtctgcttccggctgcttatttgaatccttgctctgcgacggactattccctggctgcagccctcactcttcatggtcactggggccttggacaagttgttactgactatgttcatggggatgcctcgcagaaagctgccaaggcagggcttttggcattttcagctttaacctttgctgggctttgctatttcaactatcacgatgtgggcatctgcaaagctgttgccatgctgtggaagctct

SEQ ID NO: 2462 - DNA, 1137 bp, Homo sapiens
ctgggcatggctgtgagggaggcacttggtgggatacatgcctgagatggaaacagtctcgtcctcacccagcaggtgggacttgtcggtgggggacaagccaagggtcccgcagctgccagttggccctccttcacatgcttatctgatgtggtgcaggaacaacaggcggaggtgagaggtcagtccacagaagggaggtctgagggagcagccgccacgggtgtcccacccaacgctggcaaacagttctgtgcacaagggatgcagctgaatggtgctgacggtggagctcacagagctcctgcattctcaaggtttggatacattctgggaagggtgaactggtgtaagagtcacataatacgtggaggggtgtaataatcaaaaaaacgtagcaaaacaccttctgtgcctgagccagggttgagggagccgagaagaaagtccacagctctgccacacgggccagcagtgctcatgtctgctggctgatcctccccaaagcctctcctgccacctttttttttttttttttaactaaactaaatggtcaatactgccatctctcttgataatgacaaagtgtttgcacaggatgcctacaggtgtgtgtgtcgctcctcactaatggatccgtagtcatatagctgtgagaggcactcctgggttgaaaatgaaggcaattatcacattactgtcagtcctgactgagtcacctctagagtttatgctttcagccttaattgaaatgaagacaattatataaaattctcacataattgatcacaaatgtgatcacagccactcttgactaagattggtgccggccaatctgctgtgagggaatgaagagaggagaggaactgcgatgtcagtccctgattctactgcaagtttccaagcacatgaaatcccattctagctttggagaccccaatgtgacaagaatctccctgtgctttaaatcatctctcacccatgctaagctgtgatccctcaccaagtctatgaaacctggaaaaggagtgagagtgcgcggggtgtgtgtgtgttttatatattcaggggtcgttccaaaaggggcaaactattgctcttcgtgtgtgtgttttatatattcaggggtcgttccaa

SEQ ID NO: 2463 - DNA, 737 bp, Homo sapiens
ctttagcaatgacagcttctccgtacactttaggaccatggctttccacctacaagtccccacaagcactttttaaaaaatgaaattaaagaaaatatcagagtgcatccaacagagaacaagtcggtcaggaagccgcgcagcagccttggcttttaaggataccggaaaacacccgtggagccggaggtggccattcaccaaattcgaatcaccctaacaagccgcaatgtaaaatccctggaaaaggtgtgtgatgacttaatcagaggcgcaaaggaaaagaatctcaaagtgaaaggaccagttcgaatgcctgccaagactttgagaatcactacaagaaaaactacttgtggtgaagattctaagacctgggatcatttccagatgagaattcacaagcgactcattgacttgcacagtccttctgagattgttaagcagattacttccatcagtattgagccaggagttgaggtggaagttaccattgcagatgcttaagtcaactattttaataaattgattaccagttgttaaaaaaaaaacaattctgtgcctgatgacattgcagaaattagttccataaagatttgaaagatgcagggctactgatttccataacaccattattacctcacctatttggtcagtgcaagaggcaaatgttggtggagaatgaaggtggattaacacaaacatattcatgggtttgcttatcccgcccacagcac

SEQ ID NO: 2464 - DNA, 2225 bp, Homo sapiens
gtaagaagaaagcccaaagacaaaaccagaggcaactggctgctgcatcgcccacctagtggcagtagtgtgagctatggacaaaagatctaagtctccaggacaaagagttgtgcagctgctcattttcctgttgacttctgtctaagacttggagatgtttgtaagattgggacctacctacagagctccagagggaagtgagaaggatgttcacttgctggtgagagaaggagctggttccatccattacgcagtcccctgggagcgctaaatgcaactttatctcaacggggagtggacgatgagcaggacgtcgctagagggaaagagcctcacttcccgtttcctttggcagcgcccttttcccgacctaagggagcagaccttcgttggttggcgtgaggactggcgggagaggttttgtgccaggatccgcactgtctggggtgaacgctcctcacctttgacctgaaccgccaacttcccatcctccacttttggagagcgcgcctgatagctgctgcccacctgggcactgacatcctccttccgaccgggtgcggagaaagcacaaaggaagtagaccaaggagactgaaggtggttatgaagactgtgcatctctgaggacatcttaaacaaagatgacccaaatctttgatcttcaaatagtcgatgtgaactgcttaacaaaatgccctgggaaaactctgtctgaaacaagcagcttgggggtttgatttcattagttactggacaagaactggaatggagtgaaaaatcttcattcatttcttggtcagatggagagaggagaaaaaaagaagtgggtttccattcacttccattttctaactgatcattagttagagaacctttggaaaggtttagctcagttttttcttccaacttatcaggttcctcaagaaattcactgccttgagatgactttgataacccatccaaatccagtgacttaaaaccgttattacaagggctcttgctgttgtctgactctgacatcattgaatccaactcagagattttgtcaaggtaagcagcatccatcgatgcttcactggatgttcttgtccggttcatttcaaaagagcgaatagaattcaaccttttggataaacataagcctgatttctcactcaattttgaagatatttctccaacagaatttgctatcgtgttcccctctgaactttcaaaatctaagttttgggcatagcttgtggaacaacagtcccaaaatcctgtctttggggaagaaaaacattctgatttcttttcattttcacttctacttatatcatcttctgaagaatctttattagaaacatttgaagaatcacaaaaatcatcaaacaccaattttctgagatggtttgagtgctttttggaacctcctgcttggaccacagagctctctctattttctggagtactgagctgaaggcaactaagggacaaaggagtacaaggagctggaagatcataaagttcttcatctttgtagggtacacagtcacttggtttattcccccattctctttccaaataagtatccatacttgtatctgtcacatctaacattacttctacctgttcttgatataggtctttgttcttagaacagttaaggtctgctttgctggtactttcctgccttgcagaactggtgtcacacagtctgctgctggaaggcttcgctaggtgagaagaactggaggtggatgagccaggctgctttctggcactatcgccttgattctttgacaccacatcctcctcactgcctttgctccctttgccatctgcagaaagtgctgtctggcaaatggaattcatagcttctttctcttcacttgaattttttagctgtgcaacttgagattctagttcctctatatacttatcacttcgttccagggctttcttgaggcgattggtttcacgctcatactgttctactttggactgaagagcagcaactgcaaaccttccaaacctacaaagaatggaaagatagttaatcttataactcaagcttttttcttttcaaggtttgagagtgcaaactgtcccaggctattctaatttcacctaacagtgacatttcagaccactcaatgagtagggcaaatgccagatgtatattttcaaaaaatggtttccccacttacataataataaacatatgataataatagcaaa

SEQ ID NO: 2465 - DNA, 1811 bp, Homo sapiens
gaaatctcgggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctgttcctcctggcctccgtgataaacaggggttttgatattgttaggcgagatggaaagaaagtatcaaggagtgagctgaagccactgcccttgagaaccctctcgaggagtctggcctcatgaagatgccagaataagtggcagagctaagaagtgacagaatcaggatttaaaatctggcagtgtggctctacaatctgctttgaactttaacataatatgtacaaagcctgaagcaaattctcagtactgtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagtccagagcagtttatggctgtcaaattatctgattccagaatcgccctgaaatctggctatggaaaatatcttggtataaattcagatgaacttgttgggcattcagatgcaattggaccaagagaacaatgggaaccagtctttcaaaatgggaaaatggctttgttggcctcattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggtagaaccaaattgaaagccgacagatactgcaaatgactggaatttttgtttctgccttatctttttgtgttttttttttctgagtctcagtcatagcctgccttcatctctgaagggaccaggcgacccatggagtgcctcggcagcctcgtcattgcatgcaatcttcacagacaagatctcactgcaaccacgtttctacaggagcacaggtgtgacattatactgatgacatcattctcagagaaaattcattttacatactaaggacacacagatacaagcctctcctcaacacagtagtgcaaggccctgccactttgcttcaattcctgaaaattccttggtaaacttggggctgctctattcctgacactttcaaaaaacagttattcatcctctcagcatccacaatgttaatacaaacccaacattcttcaatttgtgttttgttttttgg

SEQ ID NO: 2466 - DNA, 1695 bp, Homo sapiens
tgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaaacaaaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaaagtgaaattaagtagagtccccttttaaacaaatttgtctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtgtgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatatt

SEQ ID NO: 2467 - DNA, 5779 bp, Homo sapiens
gcctggcccgcgacgcaccgaggcctgaggacccgaaagccgggcgcggggagatgaccggtggctcgtgacggtcccacgggcaaaatcttccatcgcccggggctgagacttgtcaaactgccctctacggtcacccggaaagtaggaggctttttctgcagaggggaaaaaaatcaaaaagagccgttccatcccccctccaaggactgggtttgaattgcttttcatctgcagtggctgtgattcagcgtccctcttagcagcaggcaatgacagaggcaggagaggggaaaaaaaaaaagaaagaaagaaaaaacacagcaaatgaatcaaacggacgtagcaggcaagagtgtggttatcgttggaccaggattcaggatctgactgagtagctgactcttaatccagtttgtgttgatcaccaggaggatctggacctcagtattaccacatctagagctataatcacatccctgttaagccttcctgagatcacaccaaatgtccttgatgggaattgtaaacaacccttacttctggtttctaatgatattccaggaaaggagcctaactagagtcagtgatatgccaactccacctttgccttccaccatgtttggaagctccctgaggcctcaccaggagcagatgctcgtcccatgcttcctataagcctgcagaactgtgagccataataaactgtgaattataaattgcctttatagcaatgcaaatggaccagtacagatgggatgctgggaagacagttgtttccaccttcagtaaagtccgtggaacacagttgtgactatattctaggccagccaagatgcttgtactcagaaaggagtggtctcaggaccataagaaagtgaaaaaataaaaataagaaaataaagaagggattgtcaatgaatcagaattcatcaaggtcaaagtcttaggaaattccttcatgaggaagtctaggggggctatggaaatgaaatttttaaacaaataggtatgtggtgctggcaggaataaattatggacttatgaatataacataagattctttattacctggtctcacccgtctttccacctctgccccccttcttgcccgactctgtgtatcacccataataaactacttacagcttcctagtgttaaatttaccctaaagctgcctccttcaatattttaagtttaacctaaaggttcttcatacatagtgaactataacccaatgattaaacagattgtaacctactcttgtaccagtcaccaagtttcagccaatcagaggtggccaactgttcaaaccatgctcaaataagggaaatgtcatggtgtaactaatccagctgtttctataccttacttctgttttcttaggtcactttccttttttgtccataaattctctccaaccactcagcagcactggagtcactccaaagctatcctggttcaggggtctgtctgattcacaagtcattctttgttcaattgagctctgctaaatttaatttgtctgaagtttttcttttaacagatggtgtcagaaatggaccccaaagtagagctcccagtgatcccccaggagcactgagtgaccacaaggggtacctgctgggcccgtcctctcgcagtgtccactgctctcttacagcaactggagattgtggctgcattctctctcagattctgaagctccatacattgccgttttcagctgttcaagcttgcttgagcaaatttttgatcttagctgagtttggaagtcgatagacattggactgggtccaggatttgattggatctgataattaactggcttggatccagttagatgcctcggttatctgactgggtcagatagaaaccgccagtaaatattttaataacaatactgcaggggtatgaactctggctttaagaaactcacaaggaattttatgttctataccctttgtttctttttcttgtgtgcttcggtcaggaaaaatcattagtcaagttaatcaaggggatctgagagccaaatacaagattcaacgtaaaaatggaatccttgggctaggcgtggtggctcaggcctgtaatcccaggactttgggaggctgaggcaggcggatcacctgaccttaggagttcgagaccagtctggccaacatggtgaaaccccgtctccactaaaaatacaaaaattagccaggcgtggtggtgggcacctgtaatcccagctactttggaggctgaggcaggataatcacttgaacccaggaggcagaggttgcagtgatctgagattgcaccactgcactccagcctgggcaaaagagcgagactccatctcataaataaatacataaataaataaagaaatccttaatttctgcggaactgagtgctctaccttctggctacacctacgtatacctgtatgaggtataggccctggaagcagcaaacacttacagaaatggtgaaatcttactaaagggaaaagaaagctggataaagtatttatagaagatagaggacctgtggtggctcatgcctgtaatccaaggtggaaggattgcttgaggccagaagttcaagaccagtccaagcaacatagcaaggccccatctctacaaaaaatgaaaataaaattagccgagcgtgatggctcatgcctgtagttctagcttctagagaggctgaggcaggaggattgcttgagtccaggagttcaagattacagtgagctatggtcacaccactgcactccagcctgggtgatggagtgagactgtctcaataaaaagacaaaaaggctggccaggggcagtggttcatgcctgtaaacccagcactttgggaggcaaaggcaggaggattgcttaagcccaggaatttgagatcagcctggacaacatggtgagacccccatctctacaaaaattttttttaaaagttacccaggcatggtgttgcacatctgtgttcccagctactggggaggctgagacgggaggatcacttgagtccaggaagttgagaggttgaggctgctgtgagctgtgattgtgccactgcactttagcctggacaacagagggagaccctgtcaacaacaacaacaacaacaaaaaagcaaaacatcataggctgcagaaataaactttcttgtcaattgtgtctttaaccatgaccattttgagtcatttccacagtgagttgcctaattttgatgcatttctgaaaactctttataagcaagtaaaatcctagagaattgtgccttcaaggagactcatggaaaggatggaaagaactcttgaatacatgtttctgatagctttatgatcatatcatttggactgggtaagaattcccagaactcatgaagagactgactatttattaatccaagcaggaaaagaattaattgaataccaaggaaatactgtgccagagattttcatgctaaatcagtcagcaccgaaatcgttaagatgtgtagtttgaatgaactccatgatcctagtcaaatttcctatgatgacccatttaataaacagtgctatgcacctgaattggagaaacagaattgatacttaaatccaatgttaatcatagattcatggaaagcctaaatggctgcttgggtcttcctgagcccttaaagcttccattattaaaggctctgcactttataagttatcactgaagagagaaaatgatccagatttaaaatacacatattggtgtggtgaatgttctaaattgcgaaaatggtttatgaccaacatttggtttgtcatgctcacaatcctggaaatacattcaaaacttcaggtacatttctgctacctgatgggctatttgaatatatagagagggatttcattcaattgccattttcattgcatgttttttggttgtatagaagctttcccatgcaaggaggctgatgctgttattacagtagctaaaaggttagtaggaaatgtgttttcccccatggggcattcctggagaaatctctagcaataaaggtacttgtttgactggacaagttgtaaaacagtttaataaggttttttttaggtgtcatagcattaggcaaagctaactgaattgactggattgtcatagtcaaacatattgcagatccgcttccaatagaagacaatgaaatagtcactggaaagcctgtgctcctaattttagaacctcatgtatcttctgctcctaaactctgataggactaaatgctgtgaggcctcaatgcattatgttaatgtgtattttcaccaggtcaaggaagcttttcctgatccactaactaaggacaatcaaacccttcatgatctagaatctggagactgtgtcttctgggaatagtatcagagaaagactgcccttactgcccacatgtagcaaaactttgagacgttgaattatgggtccataatctcacaactcagaggggcacctctagactcttggaactgtatatctattggagactttaaggtaaagctgaacagagagacgtttttctccagaagcagacagcaccatagtcatggacagctttcccaagatcacagatcaagacttctctgccgtcatgagactcataacctcttaattttttcttgcttatgcttctgtgaacaatagaattggaaaaggggtggtcccgcgtgcacccatagggtatacttttatttgtggaggattttgctgccaaccttatacatgggcaaacttatgccttcatggatggaagataaagggctaatatgggttagaaattttaatggtacctttgtttctccataatcattcagaaacagaacactggtccactcttgttaacctacatcataggttgaagagaacattgccaggaggccttcatccttccagatgggcaccatttgttgggtctttttccgtggtatgaagaaaatgaagcaatgattagaaattggtccctcggccgggcacaatggctcatgcctgtaatcccatcactttggcaggccgaggcgggtggatcacctgaggtcaggagtttgagaccagcctgaccaatgtggtgaaacgccatctctactaaaaatacaaaaattagctgggtgtgatggtgcacacctgtaatccagctactcgggaggctgagacaggagaattgcttgaacctgggaggcagaggttgcagtgagccaagatcaccccactgcattccaggttgggcaacagagcaagactctgtctcaaaaaaaaaagaagaaagaaagaaattgatccctcataataggctgtatagcagattctactgcaaaggctatggttgcacaacagacttctttgaatttgcttgctaaacttttactggataatactgggattacaggtgtgagccactgtgcccagcctctcctgtttaactgtattcattctaatgtttacttacttctttaatttgtaaaattgggtcacttagagtttttttagcctatcttgccatttagccactgttactgataatttggatggaaaagaaaaataaattatatcacctctcatcttcagtgtatatatgtgttaacttagtaaatatagtattctttctcgttcctaatgaaaatttagtttacgtactgaaacactgcaaacttttataaatattgtgatgtatttgaccaatacaaaggatctttttagaaacagcaaacagttctcagattataggaattactcatttaatgatagtttcttctt

SEQ ID NO: 2468 - DNA, 32709 bp, Homo sapiens
agacgcttgttagttatgaacttaggtgtctggtctgtttctttgcctttcaaaggcacttcctggcagagaggtacaatggtgctttgcaggaaaccctgtgcccacagcatctgttctgcagcttggcagaccgcagctggccctgagcatggcctactaattctctgggtcaggtgtggctgtggtgagatggatctcagccagacatcctcctgacagctgaaaacaagaccagcagaagcaaccaaccctcactgctcacagcttgggcccagtgctcagccccaggaccagctgacactgatagtagctgttttaaaccacaggaataaaatggaggaaaaatcatcttccaaagacgagaaatgctgctcacaaaagaaaggtgctgtgtagattcccagtaaacaatattatctataaatgactctgggaatcactaataagtgatgatgaagctgattatgcattatataaatgtttagatttgaaaaaaattgatttatagcatataaaatcccattattttatattactgaaataggaatatgaaggaatggaaacattttattttaaaaacataaagttacactaagacattagctcctttgactcacatatttcaaaaacaatgacggttttcagtggaaaataatgctaagaagttctgaaaataacagtaataaggaagaatttgagtaatgaaacatttattcactcattttccttcaagtatgtacaatatagctataaaataattagactaaaaaatggcaggcacagcagaaccttaaaccaacaaatttaaagtatagacattttgttggtataataagagcattaatatgtattgaatgtttaccaagtgcaggtaactattataaaacctttattggcatgatctgaattagttctcaaaacaaatagttggcaaactaaggcctgtgggccaaactcggcccaccttctatttttgtacagagttttattggaacacagcaacactcattcaattatgcattgtctatggctacttttatgctacagaattgagctgtagtggcagagactgtatggactacagagcctgaagaatttgccatctggccctttacagaagaagttagttgatccctgcaaaacaatccaatggagtaggtactgttatttctgctttaccccaaggtcacagaatggtagttgtcagggtagtgattcaaatcctgaactgtctgactataaagtctatcatctttttagatagatttatagcacagagcacaggccctagagtcagactgtttgggttcagatcagattctaccatctagtaactgcatattggacagtttgcttaactgccctgtacctcggattcctccataactcttcccattggtaatagatgtggctggtcatccttcgtgtcagtacaggccttggacccggggtgtctgtcctaggccctgcatctcagggcctcccatgctttggagtgcctccttcaacattctcaaagtttctctgggaacagctggagtagcagtgccatctgggcagggtaccctgagctgggaccagtaagtatcctagtccccatttctgccctttggattgctctttgatctctacttcccagccctcatgtggggctgatctgatgccccaaggagctccaggactcatatctgtgggtttattttgggatccttgacctggccctgattccgggtgggtgaccagatgagccactgctccccagaatagcccagtttttcttgttgagtcaccaggcaagtgcagacatgttgattttgatgactctcacttacgtaaaacccatacgttcagggctctgaggttctcatggcccactgctggcccttgactagagccatatgtggggtccatgtgtcaggtctcacctctccatgtctgaataaatagtggcttccattctacagcaccccaaggtagtaaaggtggtgtcacttaccctctcccctgtacccctcccatcactagcaccaggaaagtcaaaccccatcgctgagcattcctccagagcattgtctgtccccaaagaacatttgacacttgttctgcaatgttagcagaccctcctgcttgaggccctccaatcgatgtgttgcctgtgtcaatgtgttgacatgaaccctctgtgcttaagccatgttggggagacgtggacatttcttgtacaaataggaccactcttctttttctacccatgggtttcccccacctccccatggtgaaagtgtgtggaaggcaaaggtgctgtcaacattaaaagaaatcacattctaggaatgcaggaattaccgtagggagttcaagagaagatatggtcagaaaatatgctcttctatatttatgctataaaatttcaaacagtgaatttaacattctcagaaaatgaattaacattcacattttcctgcatattctgggcaagacttgactttgtggtcatcatctccaaaacacagtaaccgccctcccttgagagcatcagtggaagccaggattcatgggtggcagcagggatgacacaacatcatgattgatgatataaccagcattaaataaatgatattaaggaaatccagaggctagaaaagctgttatttcaatacaaacaaatgctgaagagccagtgttgtaataacagcattgcaacccttttctcccagtgagacatgtggaattagcacatctaacaataaaaaacacaaagaggattctggcatctgcacagaaagtgatggtgcctagacactatgaaaaaatcttcccttgcactgattgaacaataagcaaatacaaaaatacctgttctttacccattattctaaatcttcattgataaatcatgactcagataggcctacgaattttgtaaaacattaaatcaaattccttatacagacagggacttggcagaaaatattttccagggacacataccataaagatgccctgcttggtattacctcattttcttttctatgaagtcactcttgctttcacttgcagtttctcctgtctttcttcacgttggtgctttcccatgttttttttttttttctcgtttagggtgttctttccttcttttcaaaaatcactttatgctttgtaatatttgtagccctcaacttctttccaagcaggtaattttgcctttctctctgtctctttggtcatctgcctgtcttagcctttcagacattctcacactgtaatacacacatgcacgtgcacacacacactctatacatatacactatgcacatatcatatatacacacaactgataaacattttgttttaacgtacaagcagcatgtttacacagaatttgtccttggctttagtaactatactcaccaaatagagggctacatatgtgatacaggagagtcagtccaggattacttgctttcattctcaatcttgtctggataatcaggttacagtatgctaaggacatcaagatgcccagaatggcacaagtggaaattcttttagatgccttgttgtgcgctcttgagtgtctgtggttagaacttgattctttactggcctatggatcaagtgtcctgtggtttgtgacagctgcagcattggatgagataactgggggtgccaggcataattcatccccgtatgtccacattctgactatagaaagctattgacctaaaataacattttatatcatttaaaaatatttgggtagcctaagatccatttttttgttttggatcaggaggtactacatccaatttttacatgtcgtacctctttgttttcacagataatttatatttctttatctctgacactatttggctgtcctagaaatagctgatgacaccaattaggagatacgctcagtcactgatgacgtcctatcctattatgtgttcatgcacagcagggcagggtatctgaaatgcatttgctttagcacatttagataatgtgtgggaaaggtgacaggtttttattttcttttttgccaatttgtacattagtgtctcttaagtggcagattaaaaatttcttaaagcactaacactgattaaaaatgtttgtttaggcttgttcagaactcttaagtgcttgcaggagccaaatcacattctcgtcctttaagcaaacaacattttaaaagcctataatggctgtatcttattgaagcaaatgataataactttctatagggctattttcttttataaggtaaataactaaaacttgtaaatatggaaaaataatccagatccatagacatatttgtaagtatatatttcttaaaaatgtttcagtcctattagtctctatcattttaatacactggcaaaatatatagtactttgttcttttctcaaaactctttttcagaatttatggcatttcttgtacctggtaaagactactgataagccatttcttgtggactaataaaaaaaattagtttttggtaagcattaattttagtctctgctttttatctgtttattcattctttcatccttcattcagcaatagcttctgtgctgggctgggagtcaggttggaggaatgtgccctctcaccaggaggatggacttgattgtatcactgtgggggacccactgaatagtgggacctctgcaaagtgcagtgcagcccaagaggagagaacaactgattctaacacaggcttcacagagaaggtgacagaggttttaacgggttagtaaaaaaggagttcatgcaaagacagaaaggctgaaaagacgggtatttggggagttctgcaatggtaaatgagggggaagctaaatgtgtgtggctggtggcataagtaacgtgggatgtgtagattgaggccagaaggcgaagggacttgagtgccattttcaagactttgtttggactttgtctcctagctatggagacctcataaggacctttagtcagggtggtgacttaagagtgggcactattggaatcagaggctcttacaataactgtgagagggaataaggacttaaggcaaagaccttctttgtgattatagacaaatttattatgcaatacaatagataaaaaagattaatgcataagtcttcatagcccctcttcctcttcttccccataccccccaggaaaattctagcagagctatggattatgaattggattttctttggagttctttaagagaagaatataaatattctaaatgctttaattcttctttgttgctacatcttgatttgtttgttttttcactgtaactgcactgagatcagtccccatggagctctaggttattagggctacataacatgttttttttttaggagagccagtataatgttgggtgacccaaaggtttatgcctacttgggggcagtttgaagacctactagttagtcacatctacaaagataagataggcaaggttttaaaaacccaaatcctgtctggtttcctgctaccacagtaatttcctgaggaatactccaggataagaacatgctgtttattaccagctagggctttgtccttgacacctcacaaaagtgcctgttccaggtcatgaacttgggtcaatctgtgggcaagatgtaagaaccctttgcctcctctgaactcggaagcaattgagatgacatccatctttggatgttctctcctggactctacctggttcctgcttggttttctaacagagggaaaaaagaggatgccgctttccaaccataaggaggcctccatccaatcttatcctatcagctgccaggaaggaaaaagagagaagtgatctctgttctaagaaagttgcattttaaaggaagaagttctgaatgaagtgccccaatcaggagcaaggatgcttatcttctttcctcctctgatatggtttgaccgtgtccctacccaaatcttatcttgaattgtagttcccataatccccatgtgtcatgggagggacccagtgggaggtaatcgaatcatggtggtgtttacctgcatgctgttctcgtgatagtaagttctcatgagatctgatggttttataggggcttttcccctccttctctctgcacttcttcttgctgccaccatgtgaagaagggtgtgtttgcttccatttctgccgtgattctctttcctgaggcctccccagccctgcagaagtgtgagtcaattaaacctctttcctgtatatttaatcaactatctagtctctgttatgttgctccattagcagcatgagaacagactaatacagctaacccactttacccttagcagcatagattcaattccaccttctttgtggaattgaattcctaattcatattagggtgttgggcagagtgagtatttgactttcatttattcattggattttacatccaggttgtgccactagcacaaacagttcatggagggccttgtatacctgtttaggaatttgggctttgtatggtaaaggagagtttctgaaggttgttaattagggactttatgggtttagatgttcagttagagaagcttaaaatattttttaaaatatagtatctaaaaaatatttttagagcccatcactcaaaattaaaaaggaaaaacattggcaggggtcattctaaagacagtgaaatagttaggaagctgttgctatataatagaagcaaggtatgatgagggcctgaatggagtcagtggcagtgggattggagaaaagagattggacatgagaaatatttaggaggcaaaagaagagggttgtgtggaaaaaggagtcacttcccgggttttgtcctgagaagctggctggatggtattgtcactcacaagcacaggagaaggaggatggaagcatatttttgttggtggtgaacttgatttgaaatatggtaaatttggggttctggcaggccaaacaagcagagatgtccagggctcatctggatattcaggtctgaagcccaggagttgtatttgggcaggagatagagatgtgggagtcatcagaaaatagatggcagttgaagctctgaaacaagacatcaccaaacagaagaatgagaatgaccctagggtgcgtggtagcaatggggtcagtagtcgaagaagaaccgggaaggattcacagtggtgtagttggtgggagagaaggaaaaccagagagaagggagtgagaggagcagcagtgccctggagagtcaagtgctgcagagaagagaagaaagggaggtagggtggggaacatctgtgactttaggaaggtggttcattggtgactgctgagcgcagcttcagtgaacggtggcagtagatctggaggaaagtgactcagtgaatgtgaggtgagcaaatggagacattggtgtaaatgcccctttcgaggttgtggaagtggctcacgtttttgaggcagggctgtgtttgtttttcagaggtagggactcgagcatattctctgcagaagcccccagtcagtgagactggtaaagactgttgtcatgtagtcagaggcagagtctcagttctactccttctcttatctctgtcacactgaacacttctgctctttcttaaatcaccagttggctcctggggctcccaggcctttctgggtttgctctgggtttattcacctcttgtgtcagtctgttctcatactgctatgaagcaatacccgagactgggtaatttataaaggaaagaggttgaattgactcatagttctgcaggactggggttgcctcaggaaacttatggtcatggcagaagcggaagcaaacatgtccttcacgtggcagcaggagagagaagtgcaaagggggaaaaccccttatataaaaacatcagatcttgtgagaactcactatcatgagaacaacatgagggtaactgcccccatgattcaattatctcctgctgggtccctcccatgacacgtggggattacgggaactacaattcaagatgagatttggctggggatgtagccaaaccacatcacccctgttagaggtggaggatttgctgtgccccactcactgccacccccactgccaccagggcagtcatgtctcacatggtgcgacatttggtatccccactccttcacccacttgtgccttcagagaggactcggagccctcaggagagctacagggtagtcccgtaaatagccaggggccagtgagatgatgtactctgaggagaggcttcccacaatacaaaccttaggtgtcaaatgtgctatgaggacactgaggcattgtaccctcagcacctgtggcaggtaggtggggcccaggccagccacaacagccctttcatttccccatggtgctgtcccaatgtcataattttctttgtcatgatatgggaagcactgcctgatggggccccacctccagcacattggctgtctctctgtcacttggcttcctgaatggtatttaaacgccccccgcatcactgttgggtctcagcaaactctctggcctcttgttcaatttgccctctgcatactgggaaggcctatttaactttgcctggcatctgtgtggaagaaacacttcttaggcaaagagctcctggaagacaatctccctagcaacaatgaagcatcctctctacagtcttttctgcctctcttttgttgttatctggatgacagggattgaatctggcctctgcccatatcaaatgctgtctggggctggaaacaagcctcaaaacatgttttaaatattttatttccccccgtctcccctaagtctgcccaccatgcatacgcttgattaaagttatgccccagtgatcaactgtgagtgacagtgaccctcctaaaggtagtctacttagcctctgggctcaggcaacacacctgtgtctgattagacactgttaccctgcttgaacctgtgccacatgaaagcagctttctcttgtgctctggtagtgggagatgctttcttgtaatgttaatgcagggctagacttttctcctgctgatcctttgcctggaatgttctcctcttccttgtcaccagccagagcaccactaaatcagtgtaaactccttaagggaagactaaagtcctgggaagtggggtcatcctggccttatctccttaaagaacctaactcttcaagggggtcttccctgttaaccctctgtattagttggctagggctgcagttgccagtaccatgaactgcgtgacttaaacaacagaaactaattgtctcacagttttggagatcaagatcaaggtgccagcaggtttggtttctcctgagacctctttctttggcttgcagatggccaccttcttgttgtgtcctcccatggcctttcatctgtgtgtgtgcatccctaatgtctcttcccctttttataaggacgtgagtcctatccaattagggtcccacccttatgagctcattcagccttaattacttcttcaaaggctttagctccaaatatagtcacactgagggttagggcttcaacatatgaattttaagggaacacagttcagtccacctcattatccttaacgttttccatttttctgtattctctccagtgcttgggtattgcatcagtttcctataattgctttagcaaattactaaaaacttggtggctataaacaacagaaatttattgtctcacagttctagaggccagaagtctgaaatcggtgtcactgggccgaaatcaagctgtcagcaaggctgtactccctccagaggctctagggggaaatctgtcccttgcctttttcactttttggtggctggcagcattccttgatttctggatgcatcaatccatcctctgtggtcacattgtctactcctcttctggtcaaatttccctttgcctctctcttatagggacaatcgtgattgcatttagggtccacccagataatccagactaatgccccatctcaagatccttaacttaatcatatctgtaaggccccttttaccaaataaggtgacatttataagttccagacattagaatctcctatcttgggggccattattccaccagccacaggagtattgttcataatatatcatttgatgtttaaacaaatgatgtatcatttgatgtttaacagctgacctacaaaaagagcccttgttgcaagggcaggagacacaaagatgtttttgctgggtgtgttcagacaagatcacacccttcataccataatctagagccttggctctgtcctcccacatgaccttcgcctgaggggaggggctggggactagggagccaaggagtctccctggggaggtgaggtttcagatgatccaggggttggaagaagtttctcccatgcatttttatctcatggctggttaagaggggtgggcatcccactcccggaagccatttcactttgaatactttgtttacttctggttagaagagtcttcaggagtgtgggctctggtaagaaggtcccattttccctggacttatacaaccaggtctgcttcttgtgttttgctatcgtgacacttttacaatttttcctctcagttacctaaggtacctgatgaatagtcaacatgtttgtgaagtccagagtgccagatgtattgaaaatgagcaattttaatcaacggtgaacctacctctttatattttttttttaaaaagagggcgattactgaagcttcacaaatagtgctttatttagtcataggagccatgatctggtactaggatgggaggactttattggctgctaatctaagattgtgtttgtctgttcttccttcttgccatttatggtggaaaaatcttccagagcaccacaggtgttttgtttcttgcttctagtcccatcccaatttcattttcatgaaatgggagtcaggtttggaagataattaccaatttccttttcctacttttaacaatgcccctgcttacggtacaaagttgtgtctgaacattactgcttattctgaaaaactcaatatgtaatttttaatgtcgtttcaagccttttgaagtttcatctgtttctggggcattgctaatggtttaccttacaacgcagaaagaacttataaaggagatgtcaggagaaaataataatctcctcaatgcaatcatgtcattaagatgctactgttaagagtgggggatgaggcagaggaaagaccagacagtgacttagaaacatgagcatttggcatcgaaggcattactgtcttgaagccttctggcctgtagggtgtatggaaacatgtcagttatggagagttttatattaatctcctgtaccatctaatttggttgattcaaaattaggtttaattacaagtgatcttctggcactagggagaccggccaacaataaccttcattatctcttctggtgaaggccacatttgctctcaggtaaatctctcagaaaagctcatcactgcccatttttctttggtcccaggcaaaattatgcattacatgaactcactcttcatgtttttcctggtctctcttgctacctggtcccaggccagttgctagagacttgtgctcccacagtgggcatctgataagtgagttcacttttcactgttggtggcttgcagatgttgttactcctggaattattctaaggggactccatgcctaatagaaaaagcctcacctaaaaaggaacccatctccaagggtagatttttctagccctggggcagctgagtgtagaagaaattgttttgagcagtactgtttttctagggtcacacaagttctgcctatttcacttgtaacaatgctgcccatgggtataaggatgacatcctttggagttttaatgcacatttcctgggacttaaagatgggaattttctatggacacagtacctcaaagggtttctttgttgggattttcgagacccaaatgtaatgaaagaatcttttcactacagatgatccttgacttatgatgggggttacgtcctgataagcccattgtaagttaaaaaatgtaagtagaaaatgtgttttcaattaagaaccatcctaagtcgggaaccatctgtacttttgtgggtatttggggtgcaaacgttggggaccatgtgttatgctgataatgaccatcttgctgatgtgccttgtagggtaaggactcaccctgggagagactgtgagtttccctgaggggtggacagtccacacgtcacctctgggaagaggcaggtcctcggaagtctggggcttctgctcctctctgagcctcagttctatgagtctggacttcaaggagtttgagagaacttccagggctgtttgtttctactcaattgaattgtttttcctactttgtaagccataactcctggctctcttgggttctaatgacccaggagactcttcaatgacatttggattctgtttcctggggagctttcttccttaatcctggggatactcaaagtgtaagccagcctgggaaaagatggattgaaaggagttccgaggagggaggatcacgagttcaggagatcaagaccatcctggctaacaaggtgaaaccctgtctctactaaaaatacaaaaaaaattagctgggcgtggtggtgggcacctgtagtcccagttactagggaggctgaggcaggagaatggcgtgaacctgggaggcggagcttgcagtgaatcgagatggcgccactgcactccagcctgggtgacagagggagattccgtctcaaaaaaaaaaaaaaaaaaaaagttcctggggctgggcacagtggctcacgcctgtaatcccagcactttgggaggccaaggtgagtggatcatttgaggtcaggagtttgagaccagcctggccaacatggtgaaaccctacctctactaaatacaaaaattagccaggcatggtggtgagcacctgtagtcccagctacttgggaagctgaggtaggagaatcagttgaaaccaggaggtggaggttgcagtgagccgagattgcgctactgcactccagcttgggtgacagtgagactctgtctcaaagaaaaagttcccggggatatagctggtgggacaactgcccagtgtgttcagcccagggactgcaataccagcttgcttcatctggagttgtttcaggagacacttagcccctctcacttccttcaccttcgtaaatgactttccctgagcacctcacgtcaacctcactattgaggtgtccctactctggccttcaggtctctgaatgggcactatagactgggcatgagctttcacaaaatgctggctaattttatataaatatctatcctgggaaccacctgttcagcagtctgattctagaatcttcttctactggagtcttctcaggagtggatcccaatcttgcagacctagaagtgggcattttttactccaatccctgtttctggactgttttgaatagaagcactactaggatgtgagtgtatcctttggttagctcatcatattctttcccttccaagaatgccccctctccctaaaatgatctcagcagaccctcaaggtaccttttgggtccttctcttccacaaaactgccccaggtctctccctccccagaactcaaagctcttttttcccccagtgacccttttggcaatgaatcacgtgcatattttgtgacacactccaataatcacttcatggtgagcataatacccacttcactgactcagctttgctcattttgatgtatggcagacatctctgtctgcgtgatgagtctctggaatattaactctattctgcacgatggctttgctttgggcagatgtttttatctatcacccgtgtcgatctgttttccatgagggaaatttggctgaccttcagaggatggattactgatctcccgggagccaatggaagtgacatcattaacggattttttttttttaacagcaaaaatggaagataattaaatgcagcacagtagttgtaaaacagatttcattgtgttatacatcacttcataaagtaagcatagttcccattcttccacatgatgctttttgcagcattgtaccacagaataatgactccctaataactcagctgaaaaatatttagatctacttgctctaagaataaggtcaacattaaacattctcagatgaaaagcttgctggatgaaatagtgcaccatcagaataaagcatgcaatatatttacagtcagatgaaacaagtgtgtccataaatcaaccaaaagaccatctcctcctttaggaaatacatgtattgcttagccagtaccaataagttaacgtcgtgtgaataattttgggtattctggccttcctgaatctcatacagccaaaccaaccagaaggcttccccgctgggttgatggtggcttatcatttggcatctggaaacttctcttattttgctggatatggctgtctagtgggtggcttactgacttgcctaagaaaaaataagtcaatcattcagattaatctgggaggctaattctaaaatcggattttatgagaattgctagatttggggctaggttaacctcatttccaaaagaaaaactcttactggagagaaaccatcatgttggctcattctattgtgtttatatatttcacagtaaaatgattcagtcttgccaggttccatattaggaggattagaactacatcactcaatattttcttttgtctgttctaaaatatttatcaagttaatttatggacttatggattttttccattccaggacttcatttgcggggagccttcagaaaaaacaggtcacttgcagtaatatagaaggactaaactgtgattctggagacccgggtttctctttgctgttcaaccagtgtagtcttttgtgtgtgctgttaacagtgatttctggctcagtgaaatgtgataatgacttcatatttgtgaagagctaagtatcctgatattttgatcttttcaagcagataatttcaggcagaaatgatatagcttgtcttttgttaggtctcactaggggaaaaaaatcgctcacaagagccttgcctacctcaacaagaagtgtctctacttatacaaatggcatggtttcttttctggttactgggtcacaggtggctcgccatttgctttgagtttgcaaataaagtacatcttgggtttccttatctttaaacaagtaaagataaattaggttaaagtgggagaaggttcacaggatgagaacatcaattcagctcacagcaggtatgggtctaaagtgcctctctgcaggaaagaaagccaccaccagcagtccacctgctctcaggggaagggaccaggcattggaaaggctgcctcgggagaagtgactcaacaaaatcataagccgcatgtagctttgtttcctctttctaatacgggcatatttattgccatctcaattatacctaattcaattaatggaagaaaatgtacatgaaagaactcccagaaactaaaatggctaactgtaggcaggatgtgtgattaatatttagaatctatcaaacccagtactggcagggctgttctctccccagtacttaccagagagggagtagagctaatgcacagccatactcctccccttttcatgaaatagtttcatctttaccttgaggtcacgctacagatgaagagtaaaatgaaagactgaatatgatcaatactaattaaaatgggggggaggtattgaaaagagtctaaaattggctacaaataatgagatacattggactcttcgtcattaacaagatttagaataggctgggaaatttctctttggaactgtgaactgtgacgggtgtggtccaacagaaaaaacactggagagtcatggataacgaaatacaactgagaagttacggaaagcacacaatgccctagggcaagcttgtccaacctgtggcccgcatgaagtccaacacaaatttttaaactttcttaaaacagtctgagatttttttttttttttttttttgcaattttctatttttatttttttaagctcatcaactatggttagtgttagtgtgttttacatgtggcccaagaaaattcttccaatgcggtccagggaagctaaaatattggacacccctgcctaggggaacttgtttcgtctacttggttagttgtcctaattgcattttacctgcagtccaaaggttattttagatgatagaactgcaagaaccccaaacccaaagaaagaatcgttgaagtggttgggagaggaggtcatttctgagatacatttccaggagaaatacaagtttgagagaaggagctggtagttactgtgtgcaagtgtttttctttgatggggaaggagtagttggcaaagggacaggaatctgtgtgtacatttcctgctcctgtttccttaaccaccatcctcagggcatctctggcaccttggggtcgggtaagtgctctctactgccctcgttttagctgcctttatctcgtctatatggcactttctgcgtgaaaagacatttgccttacagggatgaaactggacttgcaagagtttgctgtagaaggtgttcaagtcaggaagatgctcagaaatgaccactgagagggtggcatcagtgctgacttaaaaaaaaaaaaaaaaatctgacctcacatgttcatttttccaaaagtagagaggctcagtttctagcctctcaaaccataaggaagtaatcaaaatgagagtagatggaaatcatctcttaccttaagggctcatgtacatttcagagaagcaatttctctagctatacttattctcttatggtcttgtttattactataaacaagcaagttcactttatcatttactttttattgtgttgcttgaagtacctatgtaatgcaagtatgtactgtactaaaatacctatatttccaaataacatatgtggtgtagcccacagtctctgcagaagcatcatgagtaacctgtgcctttacactttacaatccgttattggttgctgttaaaagtatgataacagatgaagaaaaaaaaactaagtatgaatacacttttccaaacacgcacatacacagcttacaatggaatcccaatggaaataagtgacaacatctgatgtagaatctataaaatgtagactctgcaataaaaagccaaaggcacgtaaaaatatattttaactttaaaaataacttagttacagtaatactttgcctgtgtcttaccaacatgtagctgacagtcaaaattttgcaatatagatataatatatagggatatataagaactacaagaaaatccccaaaacccataaagttcaaatgtgaaaacagaaaagttttaacactggagaattcgctatggtgagcctaagcaatatatagaaaagagtctacaaaaaggcttaggtgttaaataaattttgacttcctcttgctcagaaaatgtcggagtgctataaagttccgtgaagttccttaatgtgactcgctcagcccttcatagctagtgccaatcctggccaagccagatttcttgtgtgtctgcaaacaatatgtgagccgaacatcaccaatgcctcctgaaaatgggctctgactcacttcctttttttgccaagataggttttgctttgttgtttttttctaaattgtttttgcaaacagggcataacaggtaaaaaaatactttgtaagaatattattttagaaaacccaacacaaaactgcaaatacagctccggaagcccttctcttcaactgtggttagtttgtttttgtaccttttaccccaaaggaaaaaagttggcatcttgttacttatttttatccattacattcagcacctcatccaaaagtgagggcccaagatcaagctgcagggagaggagggaacctgtaaggtcagagagggactcctctgacttagtctttcccttgatgagctcgcatggggtgggatggtcaaacatgtcctcggctggccagtcggggtactgttcggacaggctggaggagtggctgtctctgccttggctggactgagatgcagaaccgctggagccccacgaggtgtctccctggtggactgtcccattctccaacagactgcttttctcctgagctttttcctccatgacgggctcgcagctaagcctgggcagctttgctggcccgaaggactcctgtttggaattaaatgtcactggtgacaataagggcaacatgagagcttgggatcctccaatggtcgggagggagatggcatttttgagcaccggggagggcgtttctgtgaacacagagtccgaggtgctgttggcccggaagaactcattatgcccagggaactggcccaggtgtgctttctcctggtttccaggtaaaagctcgtagttcccttgaagaaaggaaatatctccaaagacatcgtgctggccctctttgccaatgtggatggtgtggcgaaagtctccaagcgggggactgatcatatcaggagacagaatgtccctcagtttaaatttctttcctttcttgttattggctgctttcaggtaaattggggtcttggctggcattttggaatttgagaatgtctattttgcaagcgggagaaagggccactttcttcacagatggtatatgtttctgaatcctttttgataggaactgtcacatcatttttctcaagtggcttcagaagtggcttcgaaatgagatggggtcaaagagaaccttcctgaggttacggccaagtgaggcttcctagagagccagttacatcatccagtcttgaccacaaccaggacaaacctgcagaagaaaccaaagcaggttataagctaaagacccttttgggtgccctagggcctcccttttcacaagagcctgtaaataatggcagggccagtttcaactaatgctgaacttattgtttccctccagtaagtggataaaaattttcatcttagagaaaacaggaaagagaaagacctaaaaaccccatatctatgacaccagtactttttagacatagccatgggcacatcttctggacatgtctatggttttagtcattttcctctaagaattgctgtaagcataggatcagtgatttcagctccttaaatacaactggatttgttttaaaatacattttccttttgctttgatgtgcatactagcaacactaatatttcattgttgagttccatatgtacataagttaatgcaataaaatgaacagtcctaaaggaaaggtgctggaattatttaataagtgacaataactattatatgctactgtcctaaaaatgttagtggaatacattcttacagataagaaaacggagattcaggataagcccttcccctagaaagttaccttttctcaataacatatagccagtaaataagagagctagagttgtaatcaggttgtggcaaagtattgggctgtcgaggatgtcaggatttgaagtcattctgagatgggaggaaatgaacaaaactgcttcacttcaaagagaaaacattgtgaatctctattacaggctgggccttcacttgggaacacttctgaaacattactgataaggctatatcctccatgcagtaggcagaattcgaagggagcccccatgatctgcctcctggtgttaatgcctttgtgagtagaacctgtgactggcttctaaacaagggaatgtggcaaaggcaataggtccctgattaggttacattataggagatttcatctgagctgacaagggagaagactccctgactccctttgctggctgtggagaggtgagcagttacactgtgcaagggcctatggaaatgaaatctgccaacaatgttggggagcttggaagtagatcttttccccagttgagcctctgatgagaccaccaccctgacccacactgaatcataactcagggagatgctggaactcagccctgcccagattcctgacccacagaacctgtgaaatggtaaatgttgtaagccctcaagtttgtggtcgtttgttaccagtgtagaaagcaacacatcctccctgcacatactatatgataagattaggagggatgagctacaaggcattggggttgtaatgtgctcttttgccaatgagatgctcttatctcttgaaaataatcctccacctctgatgctgacacagagaagctaaaccctttcccactgcaggaacttcccaaatggctctgccatgacctcttccctcaggcgctcctcccactggctgcagagcctgcaaataaatactccaagggctgggtgggttagttggtgttttgaagggagccacatttgcttgtagcagctggaggctgtctgcatctgccccatatttctttcctttcagcaagagttttaaattcatttaccagtggcaggtgacaagaactgtgctccaccacccactggctcagtaacagctaactcaatttgggaagcagctagctcagcgtgtcagcatgctggccagcaacccaggccggagaaggctgagaacaatgcactagagagagccagccccactcgggctttgggtatggggaggaggcagagaaagtacgaggaggtttgcattcatgcagagtgggctgaccatggggctgccagcaatgacatgatcgtgggtcctgacactcgttctcatagttttagctctaatttgggtcttgttgtggtaacaaaagttgaagcccatgttcttcctgttaaaacatcagaacttccttcctgtatgagtgtacaatgcctagtcctggcctcgggccccctgctgttcagaggtggcctccctgccctttgggcacagtgtggctgactgcctgcaggagcagctgggtggcctgaggaacagctgcccacaggagtggtgtcctcagcacacacggccaggaaggcagctgccatggaaagatacagcgtgtccaccacaactcaagggcatgccagggctgcctggggtcagctgatggaggcagggttatgcaaggccaggtcccagggcagggggttccaattatttaaaaaaaaaaaaaaaaatcgatcacttaaggcctggagtttgaggtcagcctgggcaacatagcaagaccctgtctctatgaaaaaaaaattagctgggcatgggggcacccgccggtagtcccagctactcaggaggctgaagcaggaggactgactgagtccaggagtttgaaaccagcctgggcaacataatgggacctcatctctacaaaaactttcttaaaaaattagctgagaatggtagcacacacctgcagtcttagctacttgggaggctgaggtgggaggactggttgagcccaggaattcaaggctgcggagagctatgattgtaccactgcactacagcctagcaaggccttgtctcaaaaaaaaaaaaaaaaaaaaaaaaaaaaaaaaaaaaatcccatgaaaatgtagccagagagcagttccctgccactctgactggatcattcacatacacccttgaattaaacaaggatttgggacagtgaggaggaagagcaaagggggagaaagtgtgtgctgctgagggtgcaggggagggagggcccagtcggtaggctggtgggggctgggcacccaccagggagcaagatgctcgtcaagccccagcctttggtcagtccttgcccagccacaggcaccagcaccaggggcctccaaccagaggctcactcatcctgcttgaagtggggcttcatgtcggtggcatggaggcaaaggttggagggaagcagcaaagaaaaaggcaagaaaagggttggtggggaggctacctaagctgtagtgagattctggtgagtaggagatactggagaagataccttcagaggcattttgctttctttctacaaatatttacatcatatttactgcatgatggggcataggcttctaggactatagaaaaaaataatttgaattgaatctgaattgccaatcctaacagctcccaaataccctgaaagttaagaattttgggcaaaatgtcagttttacaactctaggtaagttgacgtttgtgctgctgggaaagtatctggcagctctgatctagtccttctattgcatctgttctcttcctccccagctcaggggcaaccatgattgatcccaggagagtcaatccaacgctgataatccaatgcccataatttctcgaactgaccacttccttctctctcctttctgaacattctgggctaagtccatgcagcttgatcagtttccccttctgcttcctgggctcactgctctttcaaaatctttgccaattacttacttaggcagaaacctaatgggatagtttcttccctagcaagaagtggctgctcctggagagggtatgagcatctcctgggtaccagcagcacttgatacaagtcggtatttgttgagggcttctctatgtaccgagcattgttccaacccttgacatggactagctgaggaagccatgaggctgttactgtgactatcctcattttacaaatggatcactactgacgaactgatatccagccactctgccaaggctgcatggctaccaagcacgaagccacatggctgggctctgagctttgaggtcttgacatgatatttaatgagcaccctccctgggaattctgtctgctccctaattatgaaaggggtgcattccaaagcctgtttaaaacacaaatgtgtggcaatgtgctgggctgatgaggatgggaaacaggccctgcatacactgacagttgaagtatgaacaggtccaaactcagtagaggcagtggggcaatatctatcaaaactgcaaatcatatgccctctgacctcagattgcacttatagggatttacccaactcacagagaaataacaaggctgttcaaaccagcacagtttataacagtcaagagttggaaacaacctaattgtccacctatggaggactggttcagttaagcgtatccttccaaataaatactactcagatctaacaaaggatgaagaagtgcttaatatgctcatccgagaagagcccaaagatgtacatcatcaaaggaaaaaaaaagaggtgcaaatgcgtgtatttatatttgtactggcttatctatagagtatttctggaaacacacaagtaataatagtgactgtccacagagaggggaagtagatggaaggggaacagggtggcaaagaaatttcactatccttttatgattttggattttcaaatcatgttaatgaactggctatttttttttaaatcacaaatatataaatgtgtatgcagggctcagattaggctttcctggagagccaattttatacatggctgttaggtcctgaaaagcctactatgagttactgatcataacacaaacatcaggaaaatgtgtctaaaagcagcatctgcaatggcagtgtgtgggtatatgaagacttcacaaaaggcctgagccacgtctcccctgaccctggctatgggacagatcactttttgcttctgtgatcaggccttcaccaaagaggcagcatggatctgtactttgtaaaagggaagagatctcagaagagaaacatttgtagtcggaaaggaaagtgagaaaattcaacaggtgggagaggatgcaggaggagctgctggccagggcatgagcgaggagggaagtgcaggcaggtggaatcgcctgggcccgtgaggacagcaacttgtgcaagggtgactagtgacacacacagataacctttgatgatggaatgggcctatatgccatgacttgaaatcccatccctcctcatcattttaagaagacacctggggccgggcatggtggctcaagcctgtaatcccagcactttgggaggccgaggcgggcagatcacaagatcaggagataaagaccatcctggctaacacggtgaaaccccgtctctactaaaaatacaaaaaattagccgggcctggtggcaggcgcctgtagtcccagctacttgggaggctgaggcaggagaatggcatgaacccgggaggcggagcttgcagtgagccaagatcgtgccactgcactccagcctgggtgacagagcaagactccctctcaaaaaaaaaaaaaaaaaaaaaaaaaaagaaaatagaagacacctgggttccaggagactgctggtgaatgaccaacacatcagaacagtcagcatgagtcaggggaaccccagggctttgcgttctgcccagaaggaagaaggatctgcttggaggaagggatgctgggaaaagagaaaaggaggagctaaacaggaaaggcttacaggccggaagcgaattaccagactacaactagggagcgggccctcctgggtgttccacaacccagatgagagaattttagctttctgtctcagtcaaaactctcaacaccagcattaacctgtgggcactgagccatctgagggtgctgagcacattcactcgtgtctgtcctttcctcatcttgaacccctttcctgcaaccaagggtcaagtcatgtggtcacccaggctggagtgcagtggcatgatcacagctcactgcagcatcgaaaccctgggctcaagccatcctcctgccccagcatcctgagtagctgagactacaggtgcacaacaccattcccagctaattaaaaacaattttttttttttttagaacaaggggtcttgccatgttgcccaggctggtcttgaactcctggcctcaagtgatcctcctgcctcagcttcccgagcagctaggcttacagatgagcctcaccatgcctggctctctagttttcttgcatttctctactcccactatcttacctaaatcttaaaagacagacaaaggttcttatagttagccctttctcaaaaaccttgaccctgaaatttgaacttcccacaattattcctggtttctttctagttccacaaactttctcctagttcttggatcatggtttgttcctctttcccttcatagataacactggagataacattcatctcagaagttagattcctttaaaaacaaatgctctagttcctggggcactagagagaaaagatttgccaacaaaagggtccagcttgccagtcagtcatgtggcaggtcagagagaacacatgtggcaggcagacaggtgggcacagtgctgctgagaacggacatgctcccttacaggttgtgtgagaaatccaagagtttcaatacacaaaaggaccggagaggaagctacggccctggtttttataaggaaggaagagagccgggttgcactaggctagacaattctagtttcttgtgactgactgaagcgtaaatgacagtgataatgatagaaataatcacagcagtaataaataatttggttaagaaaaaaactgaagcggtgctttgcttcatttcttaccatctttttggcaaacagaatgatgctgaaaatatcaaaacagggcagcagccaggaggaagggaaaatcaagcggttttaaaaaatgacagacagaaaaatcagctcctaagttacttagagttgatgcactggcaacttacaggactctgaaaagaaccaaggagttgggatatttttaaaattccatttattttaaaggaatgtttggtttgcctactaattgtttttagattaattcttagtggagagaaaaagtaaaaaaaaaaaaaaattgcatcctgcaaaacaggttgcagtgttaatttaaaacacacatgtataaaaatgggcaggtgggttgaggggtgctactgcccccagggacctgcggctctgttcttttctcctccttgcaggaagtgagcctgcatccgacttcccctttctggctcggttgtcacatccttcagggacattccagcttctgatcacttttcgctttgcctcagcacagtcgcactatgcggccagtcacggcaccactgcactactgcaccatctgagccccatgccagagtatccagcgactcctcctgcatgttggaaccaacagtcctaggggaggatgatgactcggccaagtaccctccgccgcctccctacccccaaccatctgtgggctatgtctctctgctgccaaccagaagataataattccactgtgccaagcgcccagaacatgatcctaggctccacatttagaagggataaaggctacctggaacatgtccccgcatgttcagagggaggcaaatgggaggaagtgaaggagctcgattaggacatgtgagaagaggctgaaggaatagagcagcttaaagagaactcatagaaagagaaaactaatcttaagggatctgaaggattcatttaattgtaatgaaaaggaattaacttgttctgggaggccctagagctaccaagcagaaactacaaggaaagattttggctcctccaagtaacagctcaggtttctcaaaagatggaatgggctggggtggggaggggacagcaagtatggccatgggatgaagctctcacagaggggagggcggttaccctgcgcctccctgacagtgcgtgaagggaggtgttcacgttcccatttattctgagtttcctgtatgggaacacgatcactgccaatttccttgtagtcccatgtcacttttccatagaaaaacgcacacggactttcccttgaagaagctttctctttgaacacggcagtcttcttactaatatagaaatgaccagccaatctttgggatcagaaacactaaaatattactacaatgtggacgctcatgtcaatccttttacaaacctctgtaggagtgcttctctgaataattttaaaattgaaggggaaaaaaaccccatagtgttagattttcatttaagttcaatgctgaatttctaaggcggaaatcagtgtaaccagaagcacccagtaacccgaaggggatgcttttcatattttcagtctgtttaactccacccatttgagaagataagaagatgccttttctatttttagattcttaccctctccccatatcatctaaactgaggacatagctctaagcttcaagactatgaaactctattagctggctccccagctgctgagctctgttatgcaaatgaacttagccagaacgagcaggcggtattttaaagacccattcaaagtctgatacatctcaccttccattattttaaaggactttcatttgtgattcagctacagcttgaatttattgttcttttacaaccctgattatatacagacccacaaataccatatgtgagactcagtgctaatttgtgtacacgtctcatttttatgggatctaatttgaaagatctcttagaagcaaaattggaagacagaaggtccacctcacatagcaccaagtctgcacttttgaacagaggccattaggaccttttttcctataaaaatgagttactggggaagactcaatgtggacatagaactctggcagttacaacaaggcaggaggagggcaagtcctctcatgcctggttcatttatcaggacgtgttgtacatggcaccagggctggtcagaagcacccaggcaggcactctagtttcatggatgtgaatctctgataaggccattgctgtgaactgctcacgtgtttccataactaatggatctgacttggtctgtgatgctgcaaggacaatatcaatacaggaagagaacttgactctgaagttttcagcagtattcagccaggatattcattctaatctctgctcaaaagcaaggaacttgctctcagttgctcacaaaatattaatatttaagtcagcaattattctatgcagtactccagttctggtaatggtaatttcaaatgatcccaaataataagctgacactgtccagaaattcagattatggtcatttaacccatactaccttggagggcaaagttcctagccatttgcctttaggccacattctcaagttctctgatggggtaaagggacaaatacaggacttccatgctattctgccaccctgctagggctgtctacaataatccacgttccttggatgggctgaaacatggcttttctgtatgataccagcactggctatatgtggaatctggtagtcgtcattctactctcaatctacttccactaccaacatccttgcgttatttgtatatgtgttactacaaatatatttgttgaatgatttccctctaactaggctgaaagctcttctgtgggcatgagcttattcatcttttgcctcccacaacacatggcccacagtgaacttcaaattcacaagtgttaaatccataacccctgctagactttccatcatgagagccaggttgacttgctcccgggggccaaaccctagagcaagtctacagaggctctctggaaagtgacaaatctgaaatgctttgttctctaaataatttacacctgtgaagagtactagctagcatgagtgctttctgtgggccaggcaggcatgtaatgctcagagcatacctcttaggaagcagtcttagatgaagcctgtgtctccagtcaatcacccaaaatgtggaggagctaggattccagccatagctgcattctgtagccactgccgatttgataactcaaggactgccaacctgaagactatgtatcttgaagtctgacagcaccaagaggaaatgacacaccaagagcgcaacacggatgagaggtggagatgctaacctgaccttgtcagaagccaaaaatgagaagaagggtcctagacactggtccctccatctctaactcactaggacttttcagtatttttgctattgtcaacaagaatctcaaaaggaatttgacttgtggtaaacgtcaaaagatttgaattgtaaagtaacaaagccccccccccaccccccgccccccgccatcctcgaggagaaaaacaaacatcctgttcttagaaaatcgtgttaagtgctgttcattcttttcccagaggaagcccattgcatgcgacagtgaacaatcacaggctttcactggggacaatagctccctagcttcctaactgacacttcatttccctcctaacctgaaactaagaaccttgtgttccctacatggaaagctctcccaccttcttaccatcagcctctattcacaacatcctctgagacctgctccagatgcacttccttcctggaggaagtctactcgaatgcacctcacgtaatccaaccttgctactgctttgcttaggggttttcttaggggttgtggagggcttgtattatgtgatttgttgttttcctgttttgtggttttaatgcctgatatttccaggtggctggtgagctcaaaaagaataaagtaagcaaaagggctatacatgagtgttcctgttgggaaaactctcctcctttttatgctgaatcacttacagagcctcctcttgagctggggacacagaaggccctcaaatcttactgaataagctcttctagttttctttctgaccatcccttaagtcaagggtctacaagctacaggccggccaaatccggccccctgcctgtttttatagataaagttttattagaacacacctatgcctattcatttatgtactgtctacagctcagtggggttctcaactgagggtgatatttgttccctatgcgatatttggcaatgtctgggaatattgtgggttttcgtgactgggggtggtgtgctcctggcatctagtgggtagaagccaggaatgctgctaaacatcctacagtgtacaggacaactccccaaagcaaagaattatctggcctcaaatctcagtagtgctgaagttgagaaatcccagtaaaggtgcttttgctctatcaggtcagagttgagtagcctgtgacagagactgtatgttgctctcaaagcccaaagtattaactgagcccttacagaagaagtctgaacccctgtcttaaatgttggcattttcatagggttggatggctgctgcccatcccccactcctcaacaattcccccggcaatcacataccacctctagggataacttccaagtcagtaccttcaacccacatgcatctacttaagtccagaccagtgctactcaaagtgggttcatacagtccatgatgagataagaacagaagttggaagcaagatctttttgacattgccttaacatcaagcatgtgaccaacagatttttttcttactgaataggctattgacaagtttgggagctgtatgctgttgagcttgcatggcggttgtgtgtggcccaagctccatattccttgtgcacagtagtattgtacaatggattggaaatggaaacaaacaaaaagacagtggcccttcccagagagtttgaaaagcattgattggcctttcccttcccttatattccagacttctctactttgcttcccttgtcccatataatactcataaaccttgccccaaatgggatttgccatctttcttccccctgcctgccttaggcatctgccttccaaactatgctttcctggtaaatggcagaagtcactcaattccaaaacccagctatcatcccagcacttctccccgcctccatctctacatcaagtcctatagtcctatcagtctgtctggactgtctctcctcattcatccctgctccatcagccttactcctggcccccatgatctttctcctgcacaaggacatttgcctttcacctacctccctgcctccccggtccttccaccttatcttccaatctacaccagagtgaggtacctagaatcctcatgtaaccttatcactctctgctttaaaacctttcaagggttttaaggctacagcttggagataagataaaatagcttgtgaagcccacttcagcaatctggggggcctgccacacttgcaactgaatctcctgccagttccccatggcatcctaagctcccatagcgtcctgtgtacacctcaaacctagcaactatcacactggattattaccactacttatttaactcttccccaatcaggctataatctgggagagagaacggagatcttattcatagcaggtattgaaaaaaatgttgaatggataaacaaatgagaaagcttgaaagacattgctgtgcctcttcctctttaaccctgcctgctctattgaaaatgcaagatggaatctatgattcttacagaagaaaacaaacatgtaacaagaagctgtctcctcttttcttgtggcaaaggctttcatttttccatctgtaagccattttaaccttcccctatccatgcagggtaataatttaacagtgtatcaatgcaagccagagtaattctacaggaccatacagatctttggcaaatatacagataaaaaatatagatcttaaggcaaatatttgtggacatgctgtttgaaagagatatgactcctatccctgaatgcaatgtgcaaatagtgtcttaggtaagactcaaagaaaatttgacaatacagtcctctgaattcaaactcagtgactctacttaaatcaaacttaaagaatgaggccctggagaaacaatgaacttgctcttttctcttttcaaaaggagatgtgttaagggagaacttggctcatttggcctaaaatgtacaaggaaacctcaagaaactacaatggacagtctatagaaaagggttgtttggaagatcaatgtgtgactggcacagatcagatatgtggggaaaaataaacctatcaaaacatttgccaaaccaaaccaaatgaaacaccgactgtacgggccaacgaaactgctatctcactgctgttcctggcctgagcgggggaagagctggaccaaaactatgagccagccctgtaagacgcagaagccctgatacactgggtaccagttaccttcatgtaaaatggagataatcatcccaaactttataataaccacaggtgttagagctgagtgttaaaatctacagtgctatgtaaacacaaggcattatcttttccccaaatgagaccagactatctactgaaatacagagtggaggggaaactattctcattgccaaaataaacacttctattttctccttaaatttcgcctgtaccactcattaataaaattgttgcagatgaggctaaaatggttcctattgatcctgtggacagtctccacagttggaagggattcctaccaccagcttgattagaagttaattcccctgtcaatgggacatagggctggggctatcttctcattcacacctacatgcatcggttatcttcagttggggctcttccagccttaggaacaaatgaaacgtcccggagttgggaaaattacaacaactgctatataggtcagataaaagtggtgttttcataccaacttgggatctcttacagtagcccctgaccttaagacataaataaatacaaacaatctaacattttttttctcctaaattctctgttgac

SEQ ID NO: 2469 - DNA, 897 bp, Homo sapiens
atgaccaccatatatgacctgaagaaacagaaggataaactgttgaagttttatgctgaaagtgatgagcagatattaatgaaaaatagaaaaacacttcataaagctaaaaatgaagatcttgatcgtgtattgaaagagtggatccgtcagcgtcgcagtgaacacatgccacttaatggtatgctgatcatgaaacaagcaaagatatatcacaatgaactaaaaattgaggggaactgtgaatattcaacaggctggttgcagaaatttaagaaaagacatggcattaaatttttaaagacttgtggcaataaagcatctgctggtcatgaagcaacagagaagtttactggcaagttcagtaatgatgatgaacaagatggtaactttgaaggattcagtatgtcaagtgagaaaaaaataatgtctgacctccttacatatacaaaaaatatacatccagagactgtcagtaagctggaagaagaggatatcaaagatgtttttaacagtaataatgaggctccagttgttcattcattgtccaatggtgaagtaacaaaaatggttctgaatcaagatgatcatgatgataatgataatgaagatgatgttaacactgcagaaaaagtgcctatagacgacatggtaaaaatgtgtgatgggcttattaaaggactagagcagcatgcattcataacagagcaagaaatcatgtcagtttataaaatcaaagagagacttctaagacaaaaagcatcattaatgaggcagatgactctgaaagaaacatttaaaaaagccatccagaggaatgcttcttcctctctacaggacccacttcttggtccctcaactgcttctgatgcttcttctcacctaaaaataaaataa

SEQ ID NO: 2470 - DNA, 1533 bp, Homo sapiens
gaccaatgaaagcgcagatttattgaggggaaagtacactccacagaagtggaatgtaggtgtgggagcaggcgaccaagcggctcaagaaccccgattacaatgttttttagggttttattaggttggtgcaaaagtaattgcggtttttgccatgaataagctagaattttataataccccaagagttctttaaaggcctccaatcctatgaaggactggtgcacaaccaatcagaggctgaagtggagacttctgtcttgttaccacaggagtgaggacgtggcctgtgtgctgcctcatcttgcctagaactagctgcacctgctgttcttttgcttatgccttcattcttggttaccctaattccctattctcctgcctcactctgaggcattagagttggtttttcagtctgccagggacaaaagagaactaatccagataggaccatgccaaggaagatagaggagaggctaaagaaagagtacaaaggtcaatcagtcgttcccatggaaaaacaactctcctgcttatatagtcaattattgtgtccaattcattcagcaaaacatttattcatgtaatatcccttacttggtattctaacttatattttcaactcattttaggaacttgaagtcagtctcaggtaaagaacaatgaaagagaaatctcagcttggtattggtaatggtggtgataatctccacctggagacactaggcgtatgttaaattatcgagcttgttatctttcctgggaagtgattatcatttgtttctcttgtgacagcggggagtgttctgcatgaggaactaatatgataccagaaaaacaggtgaaatgccagttacagaaacttattaccaacgactatctaataactgcgatgacagaaataggtcaattgaaacatgagtggatggtgaaaaaaatttacacttcacagaagtttttctttctttttttttttttttttttttgagacaaagtctcgttctgtcccagactggagcactattcacaatagccaaaatatggaatcaacctagatgtccaacaacagataaatggataaagaaaatgtggtttatacacacaaaggaatactattcaaagaacagaatgaaatcctatcacctgaggcaacatggatggaaatggaggacattatttaagtgaaataagccaggaacataaacatgcacattcccactcatatgtggaagctttaaaaaaaaaaaaaaaaagctgggtgcggtggctcacgcctgtaatcccagcactttgggaggctgaggcgggtggatcacctgaggtcgggagttcaagactagcctgaccaacatggagaaaccctgtctctactaaaaatacaaaattagccggggtggtggtgcatgcctgtaatcccagctactcaggaggctgaggcaggagaatcgcttgaacccaggaggcagaggctgcggtgagccaagatcatgccactgcactccagcctgggcaaaaagagtgaaactccatctc

SEQ ID NO: 2471 - DNA, 2017 bp, Homo sapiens
gggcggcaggggaggaaccagactgcgagcggagaagcggagtttgcagcctcggaattggctagagcgccagagccgagtcagccataaagctacgcgctaggctcttggccctgacgtgaggcgcgcagagatggcgtaacgggaatagttttcaacgtctatttcattccctgcttcagaggacctctttaatctttgattttggtccctgtttctaagaaaagcaactgaaaaggtcgtaataccgcccctgagaaaaaaggagcagcgctaaataatcgagaaaatgcctcctcttgaaacggatatagagatggaaacaagatataagaaggattgagaatcatataatacaggagcttaaacacctatgcgcgatgataaagagggtactattagagcgcttggaaaataccaggaagttgagagagttaacagaagggcgcacgctggattggccacaaaatcgaattactgaagtaagtgcaaaacgacaaattgtcacagaatacagagaaaaggggaaaagaaattaagaggagaaaaagagagatctagagggccggtccaggagatacaatctatgcataataggaatacctgaaactgaggacagagcaagtggagctgaaacaataaaggatctacttgaaaaaattttccagaattgaagaacgaactagatctacaaatggaaaaggctcataggatacctttaaagtttaatgaaaagaaagcagcatctagacatatccgggtgacgtttttgaatttcaaagacgaaacattttacaagcatccagtcagagaaagcaggttacttacaaaggggcaaaagtcaggctgacctcagatttttctcctgcaattctaaatgccagaagacagtggaacaatatctagagtgttaagggaaaataattttgagccaagaattatatactctgccaagttatcatttctttacaaaggaaactggaagacattcttagatatacaggggttaggaaagtatatcaaccaagaactttccctgaaaattttgctgaaggatttactgcagctaacagagaacctgaattaaaataagaatagggaggcaattgtatgaaagaactgatggtatgcattaaaactagttaaggagcattaagtttaaattgttatgtatagggcattaaaactaaatacaaaaatagaaacataagctgggtgtaaaatttcagtttacgtttaaactggaagggcataccacatgttcaatatattggacaaatactgttttatttttagcatgtagtattgtagatacaaatacgcatgttcttaagctaaacctaagtaaaagggctttgtcactgtagatttgacaaataacattctaaatgtcaaatctgacaattggaaaacagtacagttttatttcccttatttttaagtatagcaggaaaaaaataacaagtttgtccatgttactactgatactgtaaagaaacttccaaatcactggtttgggagggggtggatacatcctcattttctgtacatgatgcatggggaaaaacagtagttactgcatcatatagttccaagtaaatcatatagttccaagtaaatttgacatggaaataagtgttaactacaaaaatagaatatatacattccaatgtttggaaaagaagtggtaaaaagaaaaatagcaaaaagacactaaaattagcaaaaagtagattgacagtacagatgacctataaactggttaaatagccctattacaattgaaattgggtcaaaaatcaatctctaacctgagatacatttgtataaaacaaatgatcaaagagtttaaagataatggaaactataaatcatagaaatggcaacatttttcttaaaatctaaacataagacattttatgtaaaacatacaatataggatgtaacatttaacaaactatatggtaaataatatgacattaatatataaaatatatgttccagatcttgatgtggg

SEQ ID NO: 2472 - DNA, 345 bp, Homo sapiens
ggcttgttcgggcctgagctggcgctacgaagttccggtccaggtctctgacttcgggcttgttcgctggtggcgtcggagccgagccggactggtcagggttccaggacatagtctgaggcaagatggagggtatgaggggccttcacacttcacttcatcccttctacccatcacaacatacaaagcaactacacctggatttttccaaacaacttttatttcctcagagtcttccttaatcctatggaacaagaagctgccactgaatagggcccagtataggggcttgcttttctactccctccccccaatataaaaatatagacttttttttgtggtccc

SEQ ID NO: 2473 - DNA, 7830 bp, Homo sapiens
agtacggtctttcttcgtctgagaaggagaggttatggtccacaaactgaaagaagtattccaggctggatttggtctgtaagctgccagtgtgccatctctggattagtcactgaagagtcagggaaggtgatgaaccagcaccagccaccccagatggagtcacgatgtggcggtagtgagagaagcagggcagaggcaacctacacccggctggctctgggtttccttgtgagtgatcctgtccgtggcattagtaccacctagtggacttcgcaggaagaactgcatgttgaaaccatgcggacagtcatttaccagagcggcggcggtgagcgcagcagaagggccagggtcctccgagcgaatcagcatgaaagaaaccataataatgagtaaactcaaagcttgaagcataaactcaaagcttcagggggacaatgagacagaggcaggggcgctggtcttgctttctcaggccgcccagttctgtttgactgagcctgtggtccgagcggatggaatccgcccctccagcacggggaggcccccagagcccaaagacaaggaaagccaccagtcatattgaagcgtccagccttctttctttaagcctcatgagaaattaggtgggtggtaatcccaaatcaatgtttgtggctgtgcttatcctgtttcacaagcctaacatctgtgtttatattgtttaaaatctattaaattgtgtggaatattttcccttcatttaaaaaaaaattacttcccatcccttttatttttggaaaaggtcacactctgtttccgtttccaaactatgctgacccacatgatcttcctaacaaaagtgttttcctaaaactcacttgcttgaggaaacctgttcctctgcaagggccccctcccacaccttagcatcgatttccccccagactcatttgcatttgctgttgtttctctctgctatttcataggcctgtgtgtcctgtttttttctgtgcttttccttaaaggctcagtacaggccccacataacacatcggctgtgagtactaggcttaccttgatactctgaatctccctactctgtccacagcatttttgctgttgctgtaattgccaggagagcagggaagtaatctggtgtaatattcagcttttgagtacttgcttcgtgtcagtattttgacagtattactgctaagccaactgggaaggtgaattttggggatacctctgcatactaaataaaagctccaaatcttagaaagtcattagagatacaaaagcactcccttgaacacgcacaaaagatcggggatttccaggtcttcattgcatttttaatggccactttcaggaaaggcacttccaagtttgagattttccagttataagatgatctgggtctgaaagagcgtagatgggacagtcagatttctcactgctcggctgtgtgcttcatctgctcttcccgcccttaaaacatccattgttcagaatgggggaagcccagcagtgttgctgggtggcatttgagagagggagtggagttgtcatgctataaacagatatagcattgatcctacagagcaaaaagatagggaaagggagggagaggaacccagttggacattatgtcatgccaaagagaattccaaggatggttaagaatggcaaccagaggcccttgaaactcccaggaggccagcagacttcactaggcagaaacccaagaaaaaagttacccccatttgtcgctaagaatggcggatgtcaaggggaatgggaacaaaggggaatttctagggtccttgtaagcttaaaagtcctattaagtgaagttacttgagatcagcctggaatatcttaatctggacttccccaacggccagttttaaatcttgtttacaactcaggtcagaattaaaatggaaaacagccttcgatgacttccagacaaggaactttggaaaaaattaattttacagtaacatcaaaatgtctgttatagcttgtgcaacaaagctatacaaaaaatctgtacaaaaaataaaaaaattaactgggcgtggtggtgggcgcctgtaatcccagctacttgggaggctgaggcaggaggattgcttgagcccaggagtgtgaggctgcagcaagctgggattgtgccactgcactccaacctgggggacacagcaagaccctgtttctaaacaaaacacacaaaaaagtgttcattaggcccttgtcttctgcacacccatcactctcgggaaagaagctggtctgagctaaggtccaagagcagctgggcctagggcctggcaattcatttcagcagtacggagactgtcacatcccattcccaggctctgcttctccagactccagcaaaggtagttgtggcctgtgtctcagaagaggggtgcaggaaggatcagaaatcaggtgggagccacgaagaacagcaggcaggagccaggaaagctgcaggggcagggttcccagagactccctagactctggagatggcaccgcaggcttctggtacctctcatgccaggagatgcttcctcacagcccagaatgagtagctggcaacaatcagggacgatcctctgaggaccagtcatagtgtctgtgatgtacccaccttctgaaggtggactgaggcttctagcttataagctggctgcataggcacccctcgtcccctagcaatgtcaacaatgacttgtaccgccataacacagaggcacatgtagattccattccaggttagaatgtgtcttttatgccactgccaaatgttgcagcggcatgaaacagttctgacatgagacaagtgtattccattctgaggactgctggtttataaataagtcaaaaacggccagataatttaggtcaaggtgagtttattgtccaaatagcataacctaattgcattcaaaaccattttcaaatccatctttaaactagtcagaaaacaggttattatttttttaaatcacttaacactgaacagataagacctcttaaaaggcagctgactatatcatgtcaccatcatagccaatacaacatttttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaaagaaaaagaaaagaaaaaaaaaagtccaagacaagaaactacataactgagagagaggagagagagagagatctgaggtacatgatataagggtgatgaacataatggaaaaaatccaatggcccgatgatttgctggggatgtaagagttggccagcagttaagaactaaaccaattaaaaataaaaatagaaactttgtttttcaaggacaggcacctgtcaaaagacattggatactgtaatggctacagtcagtaaggcactttatttccccaaagtaggctgcaggcgaagggatgcaggctgcagctacagcatgcacgtacacatttgctgatggcttctcaaaacctgagccgagaatagggtctgatagcccagccaagtttaaaagcagacacacacgaatgtagtatcgttgtgcctgaaatgaccattctgggttgtttagaatccagaatcatcaaaagccatgtggtatgaggaagtaataaatatcctcttgaatcttcttaccctattttgcacaaatggatggctgcatgaacagctcttgtaaattgctctgagtccacaccaatagaaacctgcactcattctatagctacagagggtttgttggcttaaggggactttatcatctcagcattaatttcccttttaaagctattctcaaggttggactgtctcagagataaacaaagaggaatccttttggcttagaagccaactggcttactcagacttcctccccttcctacctccaattcccacactaccaatattatcttcttgaactagaaaatcaattatttacatgacataaggtgcaagtctatttcttctcccagccctgtcccctgtggcccatggagagaaaattcccctgccctcttggagagagtcatctgatcctgccttatgttcttaacctttcagtcccagagctcccagggcacagtctggagaggccctagaggtgctagactgcagggaagcgcagctccgtctgaagagttgccaatcctgctagcaatgggatgcagcgtgatgctgtcagggttgtcttctcctctggctttgtcacttaagccatgtgtgcccctgacctggctgataagaggcagaacagagcctccagtacagagcacatagaccaaggatgacccagtagtaaggcatgctgtgctctccagtggggtcctgaggcagttcaaaataaggcctcctggaagaacagccccttcttcaaggagctcgcctctcagcacgcatggggtgttctgcggagggaactgcccttggctttctcctgcaggcttcttggctgttatggacccgcatggagtttaattatgcttagcatatatttttggcatactaggatttcttccccctaggatttggccaaaagaggggaaggatcaaaatttggcaggctgggggaacaactcggcccccactgatggagaaaaaaacaaacagatggaagtaaagacgagatagaaacacaacaaggtagaaaaagaccaggataatttggaacccctttagtgggaggtaagaaaaagaagagaaagaacaacaacaacaaaaagagcaagttcaaatccaagggggagagctcctctggaacaaaactcctaccaaagagactaagagctaaggagagggcaaaatccaggattccttcttgtgtttaagcaggagcaggcagaaaagcctaacaacccccgactttcccatcggcagccccacacccatcatcacacaaggccccaaggatgggaaagagaaaagctagaaggacccaggggcctcgggactacaggaagagtggaaagttacagactgtaaatagagtcgggtaggcttgtgcccttccttatttgtccggttctttcatttgctgcttctgtttaagctcaagggtcagtcaccatgaaatgaatttgcacctcggtttctctttaggctccaagattcccaagaactccagggttcccgctttccccattccgtgggactccttggggcccaggagagtgtgctgagcaaagctggctcttgagaaaactctggctagcttacttgctggctgctccacttccctctccaaaacttcagaattcaccacccattgtcccaccagaaatcccctagaattttagggtcatgctaactcacaaagtcctgaacccttctaaacacacttcccaagagactgactcatctggaatttcacctctgtagagaagcagcctcttcacctcccttcaactatcatcccatacttatctgacctatttttcttatcctgccaattcagtgtgattgaaaacccgaccgtttagtaccgctcagcagagggcctgggcttgcatagtgcttgcctgcgcagtttgagacagaggagggagaaggaagcaccataaacgctgcttgctgcaggttcatctactcgcagattcagacctaggaaacctgcagagatgatcctaaacacaaggtgtccatgccaggggaggggaaagacggaggggaaaaacttcaagatgaaagggccctttgcagatgaagccccgcttttgaaaaagctccaagatgaggatctccaaacagcctggtggaattctttttagtctgtttcctgacacctggtacctaagtgcaaattacgacatctgagcctaccgcataaatgtttgtactgaacgtctgccttgaaggggagggaggatcccttggttcaatgtattttttccatcatgatgaggataccagggtctaactgggagcccgatggcctccatgaccaaaaaggtccctgggagtgagaccgccctgccttccacctgagagggagtcagccctgctcacactgcttctgtattcctcatgcgaatgggctcccaagcagaaactgtacggttgtgaggtattatgaaaacaaaagcgtgaatcattgccttttgtagttattgattttgtccagtaaacctgaggtaaagaatactccgtctttgaagaatgtgatcagaggaaaaaaaaaaaaccaaaaaaccaaaaaagaaaaaaaaaaacaaccatgaatatgctaccagaagaaaacaaactacggaagggcttttccagtacgaagaactcatatctcaaccatctacttcaggacttggaatttaagcagtaaaataatatattataaaaatgtttataaaatagcagcacactctgtgaaacattacagctaggtactgtcaacgtgaataaggatggatgactttagcttcttagcagcgcaaaaaaaaaaaaaaaccaaactgaacaaaacaaaattaaaaaaatgagagacccttagattgttttccgtcttcaaccctcatactatgaaacaaggcagaatctgtgtataaaataattcttcaaatagccctgttctgatttttcttttttacttaaaaaggcaaatattttaacaaatagcttcattacctgtcaattacaattgtgcaaaaaaaaaaaaaaaagttgttgctccaacctctttgctaactgaatgcctctaagaagtggagaggaagaaaaattcaagtacgctgaatacaactttgcaataaaattaacaacaacaataaaaaaaaaaaaacggaaaagggaacaaaatgccacaccctgatgttcagccatctatctttgcaccagcaataacttttctttccatgtccaaaggagaagtatagagatgggaattaagatccttctgtgccatcagaatggtaacagattttagtttacaggcttgtctgaggaatgttgtgatgggaatgtcagcaggaaggggtgtctcttgagtcctggtaggaacaccagaactgtgtaccaaagaacgccagataccagaagcgaagagtaacccagactgggggcaggaagggagggggcaaaagagaagaggggaggagtattcagcatgacttgcataaaccatcccatctatcgctcgggaacaatttttcaaagtgcttttcgaatggaatggtttataacaatgctaaactgtgaaccagacatgccaatcagcaccaaaaattagtttttttctaagaagaaatgccaaggccacattacccttttaaatacaataacagaaaagactccattctggatcccacccttggtctccatctgcctccgtttcatgtgagttttggttatggcccatagctacatttccccattagatagcaatatggtggtgtctgcaatgaactgcatttggaagaagaagcaggatgtcacagaacatgaaacccaggagccaatcacctgtgtccaactggcaaaataaaacatctttttttaggtagcagctactgtagacagcaagaggacattaatgtagagatccaactacactcctgacttagtaacaggtggctgagagcaaaggtgcttctccatcccaaatggttcaatcatgttgagagattgttttgtactccttccccatcatgtccctccttatttcaattccttcttgagttcattgctttgcaatctaatcatgccataaatggc

SEQ ID NO: 2474 - DNA, 7703 bp, Homo sapiens
agtacggtctttcttcgtctgagaaggagaggttatggtccacaaactgaaagaagtattccagggcagaggcaacctacacccggctggctctgggtttccttgtgagtgatcctgtccgtggcattagtaccacctagtggacttcgcaggaagaactgcatgttgaaaccatgcggacagtcatttaccagagcggcggcggtgagcgcagcagaagggccagggtcctccgagcgaatcagcatgaaagaaaccataataatgagtaaactcaaagcttgaagcataaactcaaagcttcagggggacaatgagacagaggcaggggcgctggtcttgctttctcaggccgcccagttctgtttgactgagcctgtggtccgagcggatggaatccgcccctccagcacggggaggcccccagagcccaaagacaaggaaagccaccagtcatattgaagcgtccagccttctttctttaagcctcatgagaaattaggtgggtggtaatcccaaatcaatgtttgtggctgtgcttatcctgtttcacaagcctaacatctgtgtttatattgtttaaaatctattaaattgtgtggaatattttcccttcatttaaaaaaaaattacttcccatcccttttatttttggaaaaggtcacactctgtttccgtttccaaactatgctgacccacatgatcttcctaacaaaagtgttttcctaaaactcacttgcttgaggaaacctgttcctctgcaagggccccctcccacaccttagcatcgatttccccccagactcatttgcatttgctgttgtttctctctgctatttcataggcctgtgtgtcctgtttttttctgtgcttttccttaaaggctcagtacaggccccacataacacatcggctgtgagtactaggcttaccttgatactctgaatctccctactctgtccacagcatttttgctgttgctgtaattgccaggagagcagggaagtaatctggtgtaatattcagcttttgagtacttgcttcgtgtcagtattttgacagtattactgctaagccaactgggaaggtgaattttggggatacctctgcatactaaataaaagctccaaatcttagaaagtcattagagatacaaaagcactcccttgaacacgcacaaaagatcggggatttccaggtcttcattgcatttttaatggccactttcaggaaaggcacttccaagtttgagattttccagttataagatgatctgggtctgaaagagcgtagatgggacagtcagatttctcactgctcggctgtgtgcttcatctgctcttcccgcccttaaaacatccattgttcagaatgggggaagcccagcagtgttgctgggtggcatttgagagagggagtggagttgtcatgctataaacagatatagcattgatcctacagagcaaaaagatagggaaagggagggagaggaacccagttggacattatgtcatgccaaagagaattccaaggatggttaagaatggcaaccagaggcccttgaaactcccaggaggccagcagacttcactaggcagaaacccaagaaaaaagttacccccatttgtcgctaagaatggcggatgtcaaggggaatgggaacaaaggggaatttctagggtccttgtaagcttaaaagtcctattaagtgaagttacttgagatcagcctggaatatcttaatctggacttccccaacggccagttttaaatcttgtttacaactcaggtcagaattaaaatggaaaacagccttcgatgacttccagacaaggaactttggaaaaaattaattttacagtaacatcaaaatgtctgttatagcttgtgcaacaaagctatacaaaaaatctgtacaaaaaataaaaaaattaactgggcgtggtggtgggcgcctgtaatcccagctacttgggaggctgaggcaggaggattgcttgagcccaggagtgtgaggctgcagcaagctgggattgtgccactgcactccaacctgggggacacagcaagaccctgtttctaaacaaaacacacaaaaaagtgttcattaggcccttgtcttctgcacacccatcactctcgggaaagaagctggtctgagctaaggtccaagagcagctgggcctagggcctggcaattcatttcagcagtacggagactgtcacatcccattcccaggctctgcttctccagactccagcaaaggtagttgtggcctgtgtctcagaagaggggtgcaggaaggatcagaaatcaggtgggagccacgaagaacagcaggcaggagccaggaaagctgcaggggcagggttcccagagactccctagactctggagatggcaccgcaggcttctggtacctctcatgccaggagatgcttcctcacagcccagaatgagtagctggcaacaatcagggacgatcctctgaggaccagtcatagtgtctgtgatgtacccaccttctgaaggtggactgaggcttctagcttataagctggctgcataggcacccctcgtcccctagcaatgtcaacaatgacttgtaccgccataacacagaggcacatgtagattccattccaggttagaatgtgtcttttatgccactgccaaatgttgcagcggcatgaaacagttctgacatgagacaagtgtattccattctgaggactgctggtttataaataagtcaaaaacggccagataatttaggtcaaggtgagtttattgtccaaatagcataacctaattgcattcaaaaccattttcaaatccatctttaaactagtcagaaaacaggttattatttttttaaatcacttaacactgaacagataagacctcttaaaaggcagctgactatatcatgtcaccatcatagccaatacaacatttttgccatacttcctaaaaaccttttcgcatacactgatcatgctacttatcagcactttctaacatcctgaccaaacagacacccacacctcttatagagtacactgtgagagaataacatggacttgatatggcatcacacttgttttaaagcaaaaaaaaaaagaaaaagaaaagaaaaaaaaaagtccaagacaagaaactacataactgagagagaggagagagagagagatctgaggtacatgatataagggtgatgaacataatggaaaaaatccaatggcccgatgatttgctggggatgtaagagttggccagcagttaagaactaaaccaattaaaaataaaaatagaaactttgtttttcaaggacaggcacctgtcaaaagacattggatactgtaatggctacagtcagtaaggcactttatttccccaaagtaggctgcaggcgaagggatgcaggctgcagctacagcatgcacgtacacatttgctgatggcttctcaaaacctgagccgagaatagggtctgatagcccagccaagtttaaaagcagacacacacgaatgtagtatcgttgtgcctgaaatgaccattctgggttgtttagaatccagaatcatcaaaagccatgtggtatgaggaagtaataaatatcctcttgaatcttcttaccctattttgcacaaatggatggctgcatgaacagctcttgtaaattgctctgagtccacaccaatagaaacctgcactcattctatagctacagagggtttgttggcttaaggggactttatcatctcagcattaatttcccttttaaagctattctcaaggttggactgtctcagagataaacaaagaggaatccttttggcttagaagccaactggcttactcagacttcctccccttcctacctccaattcccacactaccaatattatcttcttgaactagaaaatcaattatttacatgacataaggtgcaagtctatttcttctcccagccctgtcccctgtggcccatggagagaaaattcccctgccctcttggagagagtcatctgatcctgccttatgttcttaacctttcagtcccagagctcccagggcacagtctggagaggccctagaggtgctagactgcagggaagcgcagctccgtctgaagagttgccaatcctgctagcaatgggatgcagcgtgatgctgtcagggttgtcttctcctctggctttgtcacttaagccatgtgtgcccctgacctggctgataagaggcagaacagagcctccagtacagagcacatagaccaaggatgacccagtagtaaggcatgctgtgctctccagtggggtcctgaggcagttcaaaataaggcctcctggaagaacagccccttcttcaaggagctcgcctctcagcacgcatggggtgttctgcggagggaactgcccttggctttctcctgcaggcttcttggctgttatggacccgcatggagtttaattatgcttagcatatatttttggcatactaggatttcttccccctaggatttggccaaaagaggggaaggatcaaaatttggcaggctgggggaacaactcggcccccactgatggagaaaaaaacaaacagatggaagtaaagacgagatagaaacacaacaaggtagaaaaagaccaggataatttggaacccctttagtgggaggtaagaaaaagaagagaaagaacaacaacaacaaaaagagcaagttcaaatccaagggggagagctcctctggaacaaaactcctaccaaagagactaagagctaaggagagggcaaaatccaggattccttcttgtgtttaagcaggagcaggcagaaaagcctaacaacccccgactttcccatcggcagccccacacccatcatcacacaaggccccaaggatgggaaagagaaaagctagaaggacccaggggcctcgggactacaggaagagtggaaagttacagactgtaaatagagtcgggtaggcttgtgcccttccttatttgtccggttctttcatttgctgcttctgtttaagctcaagggtcagtcaccatgaaatgaatttgcacctcggtttctctttaggctccaagattcccaagaactccagggttcccgctttccccattccgtgggactccttggggcccaggagagtgtgctgagcaaagctggctcttgagaaaactctggctagcttacttgctggctgctccacttccctctccaaaacttcagaattcaccacccattgtcccaccagaaatcccctagaattttagggtcatgctaactcacaaagtcctgaacccttctaaacacacttcccaagagactgactcatctggaatttcacctctgtagagaagcagcctcttcacctcccttcaactatcatcccatacttatctgacctatttttcttatcctgccaattcagtgtgattgaaaacccgaccgtttagtaccgctcagcagagggcctgggcttgcatagtgcttgcctgcgcagtttgagacagaggagggagaaggaagcaccataaacgctgcttgctgcaggttcatctactcgcagattcagacctaggaaacctgcagagatgatcctaaacacaaggtgtccatgccaggggaggggaaagacggaggggaaaaacttcaagatgaaagggccctttgcagatgaagccccgcttttgaaaaagctccaagatgaggatctccaaacagcctggtggaattctttttagtctgtttcctgacacctggtacctaagtgcaaattacgacatctgagcctaccgcataaatgtttgtactgaacgtctgccttgaaggggagggaggatcccttggttcaatgtattttttccatcatgatgaggataccagggtctaactgggagcccgatggcctccatgaccaaaaaggtccctgggagtgagaccgccctgccttccacctgagagggagtcagccctgctcacactgcttctgtattcctcatgcgaatgggctcccaagcagaaactgtacggttgtgaggtattatgaaaacaaaagcgtgaatcattgccttttgtagttattgattttgtccagtaaacctgaggtaaagaatactccgtctttgaagaatgtgatcagaggaaaaaaaaaaaaccaaaaaaccaaaaaagaaaaaaaaaaacaaccatgaatatgctaccagaagaaaacaaactacggaagggcttttccagtacgaagaactcatatctcaaccatctacttcaggacttggaatttaagcagtaaaataatatattataaaaatgtttataaaatagcagcacactctgtgaaacattacagctaggtactgtcaacgtgaataaggatggatgactttagcttcttagcagcgcaaaaaaaaaaaaaaaccaaactgaacaaaacaaaattaaaaaaatgagagacccttagattgttttccgtcttcaaccctcatactatgaaacaaggcagaatctgtgtataaaataattcttcaaatagccctgttctgatttttcttttttacttaaaaaggcaaatattttaacaaatagcttcattacctgtcaattacaattgtgcaaaaaaaaaaaaaaaagttgttgctccaacctctttgctaactgaatgcctctaagaagtggagaggaagaaaaattcaagtacgctgaatacaactttgcaataaaattaacaacaacaataaaaaaaaaaaaacggaaaagggaacaaaatgccacaccctgatgttcagccatctatctttgcaccagcaataacttttctttccatgtccaaaggagaagtatagagatgggaattaagatccttctgtgccatcagaatggtaacagattttagtttacaggcttgtctgaggaatgttgtgatgggaatgtcagcaggaaggggtgtctcttgagtcctggtaggaacaccagaactgtgtaccaaagaacgccagataccagaagcgaagagtaacccagactgggggcaggaagggagggggcaaaagagaagaggggaggagtattcagcatgacttgcataaaccatcccatctatcgctcgggaacaatttttcaaagtgcttttcgaatggaatggtttataacaatgctaaactgtgaaccagacatgccaatcagcaccaaaaattagtttttttctaagaagaaatgccaaggccacattacccttttaaatacaataacagaaaagactccattctggatcccacccttggtctccatctgcctccgtttcatgtgagttttggttatggcccatagctacatttccccattagatagcaatatggtggtgtctgcaatgaactgcatttggaagaagaagcaggatgtcacagaacatgaaacccaggagccaatcacctgtgtccaactggcaaaataaaacatctttttttaggtagcagctactgtagacagcaagaggacattaatgtagagatccaactacactcctgacttagtaacaggtggctgagagcaaaggtgcttctccatcccaaatggttcaatcatgttgagagattgttttgtactccttccccatcatgtccctccttatttcaattccttcttgagttcattgctttgcaatctaatcatgccataaatggc

SEQ ID NO: 2475 - DNA, 4377 bp, Homo sapiens
ccggagtcaaagccgattctcggaccagtcccatcccacagcagcctgcctcctctttcgacatcacagaggctgctgtgtccttcgccaaggactccctggcaggtggagtggccgcagccatctccaagatggcggtagcacccatcgagcgggtcaagctgctgctacaggtgcagcatgccagcaagcagatcactgcagataagcaatacaagggcattagagactgcatggtctgtattcccaaggagcacggagtcctgtcctggtgcggtaacctggccagtgtcatcagatacttcccccacccaggctcttaacttcaccttcaaagataaatacaagcagatcttcctggatggtgtggacaagagatcccagttttggcgctactttgcagggaatctggcatcaggcggtgccactggggccacatccttgtgttttgtgtaccctcttgattttgcccatactcgtgtagcagctgatgtgggcaaagctggagctgaaagggaattgcgaggtttcggtgactgcctagttaagatctacaaatctgacgggattaagagcctgtaccaaggctttaacgtgtctgtgcagggtattatctaccgagctgcctgctgcctacttcggtaactatgacactgcaaagggaatgcttccggatcccaagaacactcacattgtcatcagttggatgatgcacagactgtcactgccgttgctgggttgacttcctattcatttaacaccatttgctgctacatgatgatgcagtcaggatgcaaaggaactgacatcatgtacacaggcacatttgactgctggaggaagattactcatgatgaaggaagcaaagctgttttcaagggtgcatggtccagtgttctcagaggcatgggtggtgcttttgtgcttgtcttgtatgatgaaaccaagaagtacattcactcctaataaataacaaatttggagaaataaaaatatcttaagaaaagaaaaaagaaaagaaaagaaaggcttcacaccatggaatgacaagtgctcaaatggctctcagtaagtgctcacggggacaccactgtcagagtggtgagcaatcatctaccacaaaatggaacaaagcagcagagacatctccctggttggagcaaggaggaaacatggctttagaaagtttccaggtccaaggagaagccccacaacagtttgagatctttccagaatgatccacactcgacctcctcatccctcttaccaaagagcgacaccttgttcgtggaagtaggaggagatacacacccagtacctgtcctcatccaacaaagtcgcaggcacccaagggcagccacgctgccaccgaaggcccccggctgctcacaaccgccggtcagctccggcctctcttcgaaggacacacgcgtctcgcaccccctccccgccccgccctgaggagacatgcgtctgggccccgcgccttgaaaaggcgcattcccacccccacccctcaaacgcgcgaggccacgcgttccggcctccgccacctccacatgccggaacaccagtgaggggcgcgcgctcccaaaggtcgggggcggagctaagagcgccgcgcccaaaaaaggcggcaaagtccctgactcgctgagagtttgcgagccgccatgtctatctcattcgtctcctctcctccgacagcacgccgtgcttcccctcaggcacctttcaccgttagggatgagggctccgcggcggttctcggtgtggctctgattcaccgccatcttgcttcgggcctcctgccgccccgtagatggaaaggggcgggacctgcgccgagctgtggggcgcggttctgaaggggagggcggagattatgacgtaaggaggaggaggaggaggagcgagaccgggtcacgtggtggggcagtgcccggggagcggggcggagtcagggtagaggcccccgccgagaaaggggagaaagaggcgggccctgagaattggctcgagcgcgaaggggtgagtgataggtgagtggcctcccgacctcacctgcccccttagccccctgcctttaggtatggacttgggttggtcctgtcaggaatgatctcagctcactgcacctccaacctcccatgctcaagccatcttcccacctcaacctcccatccattactcactttggttatgaaacactagaaaataatgactgaggcccgacctgacgccaactgaagatgaactgacctcacaaagtgttttcatctctaatatctgtggctatttcttaccaagagagtctcaccctccacacatgggtgagatgacataatggctgatttggtcaaggagcacaaataagacaggccaggcagttactgttcaaacagcaatgtttagttgtacaacacataaagtctagcaacaattacaggaccagtttgagtgtctgtttgcttgttttcaattgggaaatttaactgtaatgtcaccgtaagattggctgggactggtaacatttaagaaacgggttgttcttgcatcccctaggcgtgggcctcttgctccatcaggacttggttgtagatgaatggcccacaagtcaccagcctttgagcaagttgtgtccaggtggagacaggaagagggtgggcaaaggggaattctataaagacacagtgtgtggggcagtggcagtcaacattcgcaaacattcatgcatctgatggggggctttgccctcccttgggtattttccattagcctacagtgaccacctgtggtcaggctaattcattactcacattaatggggaagggggttgggggtaggagtaggtagggtaggtgggaagagatccctcttattgctgagtggacagaagggtgctagtttttccttagcgtgtacatattgtgggtttctgggggtttgtgtgtgtgtttagtttttgtttgtttgtttggacagaagaaagtcaactccagcaatgtcttcttaggaaaaccactcttcctcagtggctgcgttatgaggtggggaggatgtacaaccgcactctgggacagccacaagtggtgattttttaaaaagtgatcctagcccttgctccccaacatctgtagtgacccaccctcatgaatatctttaagtaatgaaggagacacccttgtcccactttggggctcacacagctgatctcaatgaatctagtaagcagaaaaattgctttcttgaccctttaaggaagccaagagtagctcatgcagatgaatgggtagggagcaatgccattgcccttagagatggttacaagtagctgggatgggcttacaagggcagaaggagctcttgatgagttctttcaccctgcagatgggctaggaccggctgacgcagatgatgcagtagggctgtactggcagaaccccactccactgggaggagaggagtggtttggataaatggaggatgcaactggcctaaagaggcagctggcccctcccacctactgagggctgagaggggctgtggtggtgagctggacgagcacagcactaaaaagggcttggccctgcagcaataacagctgagaggaatggagtgagaagcagcgcttgaaatggccttcattcagcagtggggcagggggtggctggcacaggtggaaggacagtgcccaggaggccttctccctgcaggggggttgagaacggttgagggtgtggagaccagcagctggcagcagacatataaaataccttctccagggaggctcagatcatggttcaggggtgccaggcaccattcctactcagcctttccaacgcccacctcccatgcccatagatcttcccctgctggtccaaggtctccatacaggactgcttctacagtagccaaggatccctgttctgttgaaatgtataacctctgggctgtagcgctgctgctgttctgtcctgacaggtgcctaccctgtaactttgtgagcaagggaggatgagggctgggttggcagcctccaggaaagaccgagagcataggttggggtcactggtgacctgatcaccgcccccctttctcctggtccattgaatcttgggtcttgagtctatgttttttttcctagcacctgagtgataaaagactgggattataagtgctgggattcatagaggaccagtgaaacacctaggctgaaccaggagatgggacagaaggttgtatgaggttattgtaaacagtttcacttagtgttttcccttccctaaggctaaactgtttccctggccccgaatttcatgaatcttacagattaaaggaaaagagtaacttacttgtacaacaagcaggggaaat

SEQ ID NO: 2476 - DNA, 2632 bp, Homo sapiens
gaccaggcggctgggcagcgccagttgaaagcggttgagcaggccgggcgcagtggctcacgcctgtaatcccagcactttgggagaccaaggcgggccgatcacggggtcaggagatcgagaccatcctggctaacacggtgaaaccccatctctactaaacatacaaaaaaaaaaaagtagccgggcgtggtggcgggcgcctgtagtctcagcactttggaaggctgaggcgggcggatcacgaggtcaggagatggagaacatcctggctaacaggtgaaaccccgtctctactaaaagtacaaaaaccaattagccgggtgcggtggcgggcgcctgtagtcccagctactccggaggctgaggcaggagaatggcgtgaacccaggagatggagcttgcagtgagccgagatcgcgccaatgcactctagcctggacgacacaaggagactccatctcaaaacaacaacaacaacaacaacaacaacaacaacaacaacaaaaacaacaaaaaccagctgagcagcgcgggccttctggcagcgggtccagctccagggcgccctagggcagcggcgtgcagtgttcgggtaataggacgcagacggtggggtcgccgggggcttcggggtggcctcggccccaggccatccagccctgtggaccgaatggagtcccacacgctgttgaggtagttgtgggttcccctggcctcgggctcggcgcagggtcagcgctcctgcaggcggcgcttgcggtacgggctggtgaaagtggagacggacggcaggatggattcacttggcgacatggcggggagctgggaagacggacaccgacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacagacacaatgaactgacctagatagaaagccttagtatactcagctaggaatagtgattctgagggcacactgtgacatgattatgtcattacatgtatggtagtgatggggatgatagaaggaagaacttatggcatattttcacccccacaaaaatcagttaaatattgggacactaaccatccaggtcaagaaaagtcacatgccatagccatggtattgcacatcattcatcttgcattctttgagaataagaagatcagtaaatagttcagaagtgggaagctttgtccaggcctgtgtgtgaacccaatgttttgtttagaaatagaacaagtaagttcattgctatagcataacacaaaatttgcataagtggtggtcagcaaatccttgaatgctgcttaatgtgagaggttggtaaaatcctttgtgcaacactctaactccctgaatgttttgctgtgctgggacctgtgcatgccagacaaggccaagctggctgaaagagcaaccagccacctctgcaatctgccacctcctgctggcaggatttgtttttgcatcctgtgaagagccaaggaggcaccagggcataagtctactcacttatatctgtttgtctggaacataacccatgtttgtttttacaacaaataaaattgatcttgaataa

SEQ ID NO: 2477 - DNA, 2085 bp, Homo sapiens
tggatatttgtctgcatttaagagagttaacagaaaggatgtttcctgtaatttattgcctacttctgccttaattgggttataattatagaatgaaaattggattaaatttctgtaagcatgacaagtactgaatgtacagcaggtattcccctagcaaacaaaatggcttaggcaccaggaatatgtacaacatgtgttcctttgtcctcaagaagtacagtccaactcaggccaggaagagaaaggtaggcagtgtagcacagtggttaagagcacagactctgagccagactacctgaatttgaattctttaacactctttaccacaaaacagttcattttagggaaacagataaaagaattagtttttagaagcatatacatcttgtaataagcaaaataaacttcaatatgggtctgaaatttattttgcttattatatttaagcaaaaactaggccatgtactatttgaggaagcagacttatttgcctttttgcatattttataccatatattaaaaccagagtccatttgtaaactagtctacaaacaacttcagagtttagaatttgtccaaaatatttttgtttgccttgacaataatgaatcattatccattaatttatttaaatctatcttttaatttatcaacttaatgtttgtcttatggaatagtacacaacatgattaaatgagatattccaccaaaagaagttttcagatcactgaagtttaccctaccagacccccaattttttttgttttgttttgttttctgtttttttaatcttgttttcacttttgagacagggtcttactctgtcacccaggctggagtgcagtgcctcaaactcctgggctgaagcaattctcctgcctcagcctcctgactagctggcaccataggtgtgtgccaccttgcccggctcacttttttaatttttcatagagctgaggtctccctatgttgtccaggctggtctcaaactcctggcctcaagcagtcctcccacctcagcctcccgaagtgatgagattaggcatgagccactgcacctgtccggtttttaatctcaaccttttttaaaaaaaaagtccataccttaataaacagtatatcaaatatgacttaatcttgtagaatcaagattttacaggtagccctgtagcacttagcccacttttcagagaagattaatgacttgtcattggtgtcatcttgtgacgtaatggcagatcaaggacttgaacacaattctactaactcttagtagagccgactttccaatgtacagtaatgcctcaggtttttcatttcgtgtcttattttactgtacaactgatccagaagagagagcaatgtgtgacatggaataatcagaatgacttggaagtattgagaaatggcaagtttgtcaaatgcatgagacttgtcctaatccagttaggcagttctttgaagcgtttgaagaaagtattaatttgagatacccataggaactgttaaaagtttgcagtaccgtttgaggttgtaatgaaaggttcaactattctgcgttcctaattgtcttcggttttgtgctttgcttctagctttcagttcttgctgcctatttccaccggctggtcttatagtcagtcccctgcttttatctattgtctgctgttatataggacaggcaaaactgggtcaacactgtctctgctgcttactagtttgtgactttaggcaagttaacttctcagagttttaattttattatcttaaaactggagtttataatagttcgtactttatagcattgttgtaaagatgaggtctttttaaaacataacaactagaactactctcaaagttccaaatacaaatgctattttctgtttctagtaattttcctgttaactactcaacatttaggtgactgttatagctgcagaagcacagtacgcttagagctttaggaagtgtcactaataaactatgatatctctaattaaatgtctgtaaattataaatgtctctaataaaaataataaagtaaatcttataacttacaatctaacaaaaaaaaaaaaaaaa

SEQ ID NO: 2478 - DNA, 10056 bp, Homo sapiens
taagagaagtctgaagccgttagcagtctacatgaatgcatgatgactgcagtaacatatatttatcccacaagtgaggagagaattgattactctagagaactaaagccataactaattcacagagactctttcttatgatgaggataaatattctgtgtcattctgacccataaaatatactgtttttatagcagactcattgtaataattcatcttaaatgtcttatggacatattttcctatgatttccaaataggaatcattggacgttcttgttttcaaaataagtttagggattaaaaataataagtagctttaagtaacattgttatacttgcttcagaaataaagagatataatgttgtgtacattatatgttcccttcttgatatttatcaaaaataacttattggtgcacattcacgggtattttgcatattcacagttattcatgggtattttttgcatattatggcttgcttcagaaactgaaggtgtatataggagactctatttgcaaatgaacaaataggcaataagctaatcccccagtgtgacattttacttcaggtaaaaattacttcctatttcttctcatctactgctgcgccaatttgaaactagttttttattaaaaggtaaaggtatttgcttacttttataaatgcattgacacttttttgagtctattataaaagtttgctattttatctttttttattggaaggctgatggaagataggagtacactgaggatcttgggaccgggctcttatgaaagggttagaacaaaccattttgcttttggttgatgtaaattatcaggtggcttagaacatatttgtgtcttgtatattatgtttaatgttggcaagaaggaaagattaaagtatgattttaaatggcatgagttagaaatgttggtgttgatattttcttagacttgtggacttcacttaattcttagccagcattagaattaatagaaactgcagatacttgagggtagagggtgggaggagggagaggagcaggaaagatagctattggctactgtgcttaatacctaggtgatgaaatagtctgtacatgagtacatgggtttacctatgtaataaaccttcacatgtacccctgaacctaaaataattgttaataagaaactgcagatattcgttgatataatgttccatatttacagatgaagacaatcagactcaaataggttaagctgcccaaagtcacagagataattcaacataaatgaagaagaaagctaagcaaatagagtttttattctttttgtttatttgagggaaatggggtagcaaaggaaaaaatcaaagtagctgtatgaaatttttgaatacgtagaatttcttcacatttcagtgtttaatacattactctaaaggggcaaacatactattttcctttatctaaatgaagccaagattgttataatgtccagaaatataaagaaaaggactggaaagatagatattaggttctgcatggctagatttggggtcacttcaacaaagactggctttttaatagtatcagcccacatctcccagtcctagaaccttgcagagcttcctgtggtttcgcctttggagttcagtgtttggatggtcaccttcaggctagtactttctagggatctgaacttattgagctgagtcacttggtttggtccaaatggtcacttgcaaggccggttaaaatctatgtttccatctatctctgaattagtgggtgatagaaagtagcctgggtgaattctttaattcttttacttattgactgttgactcttattggcctttttctgtatatagcaataatgctaatgataataatttctttggaaatacgtgaaccattcttagtcctcagagtatttctacaagaccatttatgttgattctcaccataacagtttgagagtgtaaacgaagatatactgggggatattacagtcaataggttgaaagaattacaagaggtcattcatttattaagcagctgctaagcactggtcattgcgtcaggcaaactggttaatgttgaagccaggacagaacctacagtctgtgatctgggtctcacttctctcagcccttctctcccttttctcttgcttctctttctttctgcccatgcagtgcagcagctttccctagggcctatttaccaggcttctgttttaaactatacattatttgttctcagttcaaggttagcagatcttgtccacatccctgtgggagaacctaataagctcaggtgaagcgcagctcaacattgggaacaacagtaaatgtttgcaccattaaaggtactgaattgttccatgttatcaacagcagcctttcagtcatactcatctgaaaaatgaagcctctctgaaaatcaccacttgaacttatgtccatggactgtgatcacctgtagccctatctgtaagccatctgaagtccagtgtctgtgttgtatgtgatttcatctcagtagagtgcagtttagcaccttattttgtcatgtatagaactctaatatattaaacaaataataaaagtggaactccctcataaatgatttagatattctccttatatgaaaggtcttatagtaacagataatttgttcaacagcaactgtgttttgaataatgcagggaaagaatgcttcctccattttgaactgatgatgaatatatctgtgagtgaaaaagcaataataaaaggtggatcctggattcttctctatgccatctctaaaatgtaaatgtttgttgattaaatgcatcttatttgggaaccaaaaaaaaaaaccaagcaaatattggttttcatgagtcatgtgctcatattccaaatgcagaatagaaagtttatggaaagactcaaatattgctgtttacctttattatgcaaaacactgtgagttgttttttcttcatttgttaatgcaaaaacactgatttaaaaaaatgagacaatggaatgagcaattatcaaatggtttttgcaaaatgcatttaaaatctactttttaaaaatgattcatttgaagcatattaaaaggtacacataataaatatattattataccattatataataattataccattatactagtggcttcatgctacgcttactatatgaactggcagcagggaataaaaatttatcttggtgcttcttatctttttcttttctggtaattttaagtcactttctgttgttattctttaataaatagtctaggtaagcagccaggactctcccaaagctgtgtttaggtaggaagaatacatgttactgacaaaagtgtcaagtgagttagttaaacaagtcttggacatttccatcccctattctataatcctcccctgggtgcctagccctgtaaccttatgtggctctccaggggcctacttttaagaccttcccccaaacccactcttccaatgcaaactttccttcccaaggctttctgtggtccattaaccaacatgggcctgttttctgaccctttttttttttttaatttcatcctggacctagctaaaaactaagccttgttaataagccagtgatgagttcctgcattatgcatcctcagtaagacataaatgtacattataggaaacagccttatgatttttatcttatttatacttgctttgtgtgtctatttaggaaaaaaagataatataagatggtacgatattcccagtataacactatgtatttcaggtgacagaaagtagagttatgttttcctttttaaatgaaaatagaatattaaaatgagagtcagaggacctgagccctactctcagctctgccactaacaggctttgtaatctcatacaacttaattagttatgtatctcccacaagatttttaatttctttttttgttattattatactttaagttctagggtacatgtgcacaacgtgcaggtttgttacatatgtatacatgtgccatgttggtgtgctgcacccattaactcgtcatttacattaggtatttctcctaatgctatccctacccactcccaccatcccacaacaggccccggtgtgtgatgttcccctccctgtgtctaagtgttctcattgttcaattcccacctatgagtgagaacatgtggtgtttggttttctgtccttgcaatagtttgctgagaatgatggtttccagcttcatccatgtccctacaaaggacatgaactcatccttttttatggctgcatagtattccatggtgtatatgtgccacattttcttaatccagtcaatcattgatgggcatttgggttgtttccaagtcttttctattgtgaatagccccgcagtacaaatacatgtgcacgtgtctttatagcaccatgatttataatcctttgggtatatacccagtaatgggatcactgggtcaaatggtatttctagttctagatccttgaggaattgccacactgtcttccacaatagttgaactagtttacactcccaccaacagtgtaaaagtgttcctatttctccacatcctctccagcacctgttgtttcctgactttgaatgatcaccattctaactggtgtaagatggtatctcattgtggttttgatttgcatttctctgatgagcagtgatgatgagcattttttcatgtgtctgttggctgcataaatgtcttcttttgagaagtgtctgttcatatcctttgcccactttgtgatggggttgtttgatttttttcttgtaaatttaagttctttgtagattctggatattagccctttgtcagatgggtagattgcaaaaattttctcccattctctaggttgcctgttcactccaatggtagtttcttttgctgtggagaagctctttagtttaactagatcccatttgtctattttggcttttgttgccgttgcttttggtgttttagtcatgaagtccttgtccatgcctatgtcctgaatggtattgcctaggttttcttctaggctttttatggttttaggtctaacagttaagtctttaatccatcttgaattaatttttgtacaaggtgtaaggaagggatccagtttcagctttctacatatggctagccagttttcccagcaccatttattaaatagggaattgtttccccatttcttgtttttgtcaggtttgtcgaaattcagatggttgtagatgtgtggtattatttctgagggctctgttctgttccattggtctatatctctgttttggtaccagtaccatgctgttttggttactgtagccttgataaactaggtattgattggacatatctcaaaataataacagctatatatgacaaacccacagccaatatcatactgaatgggcaaaaactggaagcattccctttgaaaactggcacaagacagggatgccctctctcaccactcctattcaacatagtgttggaagttctggccagggcaattaggcaggagaaagaaataaagggtatcaattaggaaaagaggaagtcaaattgtccctgtttgcagatgacgtgattgtatatctagaaaaccccatcgtctcagcccaaaatcttaagctgataaacaacttcagcaaagtctcaggatacaaaatcaatgtagaaaaatcacaagcattcttatacaccaacaacagacaaacagagagccaaatcatgagtgaactcccattcacaattgcttcaaagagaataaaatacctaggaatccagcttacaagggatgtgaaggacctcttcaaggagaactacaaacggctgctcaacaaaataaaagaggacacaaacaaatggaagaacattccatgctcatgggtaggaagaatcaatatcatgaaaatggccatactgcccaaggtaatttatagattcaatgccatccccatcaagctatcaatgactttcttcacagaattggaaaaaactactttaaagttcatatggaaccaaaaaagagcccgcattgccaacacaatcctaagcaaaaagaacaaagctggaggcatcacgctacctgacttctagatttttaatttcttaagggtagaactgaagcacataatcccagtactgtgggaggccgaggcaagaggatcacttgagccctggagttcaagaccagcctaggcaacatagcaagaccccgtatctacaaaaaataaatttaaaaattatctggatgtagtttgttgcacctgcagtcccagcaactcaggagtctgagatgggaggattgcctgagcccaagagtttgaggctgcagtgagccatgatagagccactgtgctccagcctgaacaatagagcaaatagagcaaaatatcctgtttcaaataaaaggatagaattgatgttcattcatatttatctccaacagtgattagcataataccatttacataatagatcttcaatatacagatatctcccatgattttcaggcaaatggagaattaaggtggaccttaggagagaagtcaaagccaaaaatgtaaatttttgtgttatcagcatagaggtataacctcaggacctttgaaatggacaggctgaaggaaggtgagagagagcatatgggaagtgaaaacattaaattcaggaactttggagccacaaaagtttagggcgtggttggaagaagaaaagaaaattaattagattttaaagcacaacaattaaatagaaagcaaaccaagatagtacaatatgtggagggcaagagaggagatcatttggaatggtgaatctttaccgggacagttttgccccctaggaacattcagcaatgtctggaaacagaaacacaacccagtgggtgttaatgcccactgtaggtaggggccagggatgctgctaagcatcctacattgaaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctatcctacattggaaagggtagctcccacgaccaagagttatccagctgaagatgtcaatactgccaagtgtgagaaatcacaatgtgtaaggtcatggtcaacagtgttagatgccctaagaatctgagaaaaggttacattatttggtaattagtggtgacttttttgaaaaagtttctctacattatgaaaggataacgttggtgaaagtgggtagcgagacagagtttacaagacatgatgatttctgagaagttggaaagtaaggtggaagggttattttgtttctaagaatcaaagagacttgaccctgtttccatattaagaagagttaagagagtgagggaagtgagggaggatgggaaggagagagggagggaaagagattaaaagtgtgaaaaagagacgagcaatgcatattatttccttataataataaggaaagtaaaggttaagagtgcagaaaagagttggagaagatcgttttgaggatgaaaaaggaagggataggtaaatgaatggaattttaaaatgcagagatactggagaagttcacaaaagatgacctttctcagtgaagtagtaaagtataaatggccgagattaaaagaggagagattggcaactagaaaacaaattgatagcagtcttcctggaagatggataaggaataggctggtgatgactgaaagttttatggaatgatgttgaaaactcagctgactttggaaagcataagtagtgggttcagtcatcacatttaaagtggttcctctagaaatgcctagtagacaaaagaaaaggaaagcaaacacagatgttcagccggactaagggtgaggagttggcaagacccaactgtggtatcagatcaagggcatgaaaggagcaaaaaaagacgcagttgaaagggtgcaccgtgttttggggccgggtcatgaggactctcagctcagaggaagggaagctggtaaactggggaacggagggactgaagaagtgaaaatattgcagagggcaaatagctgatccaattttaggtgatgaggagaataaagttgtttcactgtggggaaccttctgcagtaaagcggcataaaagttgccagaaaggaaaaaaatgtcatttttccggagtctctgtttttaaagttaggaactgtccttgccttcaggcatcttaaagggaaaatattctgtgagttatttctacatttgctggcctgtgttgatcattttcttcagatattcacaactctataatatgtaggcaatccattctttttgggctcaaatatagacttagtccagaatctatacttcactctactccttactagataaataacctcaggcaagacatttcaccaacctttttctttttctatttctttctcttttttttttttttttccacctgcaagatgggactcatgagttctagcttccgaggctgtcctgaggataaatcatgtacaactataaaatatgttaggtttaaaattagcaagaaaaaaacaaacaatcccatcaaaaaacaggttaaggacatgaatagacaattctcaaaagaagatacacaaatgaccagcaaacatgtgaaaaaatgctcaacatcactaacgatcagggaaatgcaaatcaaaaccacaatgtgataccaccttactcctgcaagaatggccataataaaaaaaattttaaaaaatagatgttggcatggatgcagtgaaaagggaacaatgtacactgcttgtgggaatgtaaactagtacagccactatggaaaacagtgtggacattccttaaataactaaaagtagaactaccatttgatccagcaatctcacttctgggtatctacccagaagaaaataagtcattatttacaaaagatacttaaacatgcatgtttatagtagcacaattcgcaactgcaaaaatgtggaaccagcccaaattcccatgaatcaacaagtggatgaagaaactgtggtatatatgtataatggaatactactcagccataaaaaaggaatgaattaatagcattcacagcaacctggatgagattggagactattatcctaagtgaagaaactcaggaatggaaaaccaaacattgtatgttctcactcataaataggagccaaactatgaggattcaagggcataagaatggactttggggactcagggaaaaagggtgggaaggggacgagggttaaaagattaccaattacgttcttgtatgctgcttaggtgacgggtgcaccgaaatctcacaaatcaccactaaggaacttactcatgtaaccaaatgccacctattccccaaaaacctatggaaataagaaatttttaaaaaatacattaggtaccaggtgcagtggctgacgcttttaatcccagcactttgggaggccaaggcgggtggatcaactgaggtcaggagttcaagaccagcctggccaacatggtgaaaccctgtctctactaaaaatataaaaaattagctgggcatggtggtccatgcctgtaatcccagccactcaggaggctgagacagaagaatcactcgaacctgggaggtggaggttgcagtgagccaagatggcagcattgcactccagcctgagcaacaagagcgagactccgtctcaaaaaaaaaaacaaaaaaaaaaagtttttttaataatttaaaagattcatatttttctattctcatctgtattagtggcctcactggtggccaatcttctgcctgacttaccacctgttattcttcaaccagcagaaaatcctattctgcccgagttttatttttcaaa

SEQ ID NO: 2479 - DNA, 1403 bp, Homo sapiens
accaatgatgagtaccatggggtatctgaaacaggatttttgattaaacccatatgcaattctgaggtccattacaaagagacacgtattattccttttttgggaagtgagcctatggtaccttttccttggactttgtggttcttggggatggattgcatttttgttataaaatcagcccatgaattaaaaatttatcaatgagtaaaacataaagcataagtcatgtacttattatcagtgactgtaatgaaacatggattattattaaaacttatctgagactcccaataaattaatacccaaggcttctaccattctgaatgaaaaccatgtagctggtcttattattctctaatcatgaagaccattattgttatttgtggactaaggagcagaaagactgatagtggacataggccagctgatttaataatttaagaaagaactgttatcctgagtaaggagcatagagacaaatataaaatgaacgcactctacctgatttaattatagtcttctggtgaagatcttgctgttatctctgtgaatcaggagagaagagattgataaggaatagacgagattggatttggtcatttccccaaggtgaagagcatggcgatttcttctgtgaatgaatgcgcaatgattcaattattctccagcgaggaagatcatggttgttgtctgtttgagtaatgagtgtagaaacctataatggaggcgtgatggctgatgcaatcattttccactgatgaaggttttgatggccacctgtgtgagtagggaggacataggctgctaatgaacagccccatctgatttaatcactgtgcaatgaccgtgaactgtacagttacctccgtgtgtcacaggaagactcttgtgattgacttaagcacccttccatggtcatgaggtttctggttgcctctgtgtgttagaagcttggagaccaatgccttctgctgtgatcgcgttctccacagttgcctctgggtaggagcctggacactaatagaaaatggatgcacttgagccgacctaagcattcatggtcatgagatttgtggttgccactgttggttaggagcatagagatcagtaatggacacacctgggctggcagaacatcttgccttgatctggagccccatgtctgcccctctgtagaggtgcacatgggccaatgatggatgcaatgagctgatcattttgctgtgatcaaggctatgttgcctctgtgttaggccaataatggacagacccgggctgattttggtgttctgtggctatgagatcagtggttgcctccatgtgttaggaacatggagactgacgtaatagtcaaacttcttgtctcagtttcagtgttcttctgaagggtatgcagtaagtgc

SEQ ID NO: 2480 - DNA, 2513 bp, Homo sapiens
gaatttttaaaatattttaatttgtatatataacttcaaatttagaacactcagtatgaacaagaactattctctgacaaagatgtgaaatgggggagtgaattactgtacaggtgcatatcaacctctccatgcaatttacatctgtatcttatgcaatgagaaactggtttacacagctccgtaactgcagtattttttaacaccccattttgcagtctcagaatacttttcaattaaactggtcgacatgtttaaagatgagaaataagatgtttgcattgtaaagttgagtaatagctaataaatgcacacttccttccattaatataaatctggaacaatttatggtaaacaaaaatctatccgcgttatcagtaatctaacagtgcatacttttactgaacacttcctgtgagccaggcctcgtagtaaacatctgaacatgcaatttcacattcagtgtggaataagaagtgtcataggttcgcgtgtttttcacaactgattatgatgtccatgatgacagcgtgcactaagcgctgtgtccaaccaaccctttacctggcattttagccagcaagacccgcttgcattgcagtcgttcacggtgctcgctggcacaattttagaatgttacatgaatactcaggcctgactaaccttcccctccaaaaaacaacaaaacagaacaaggctaagcctttactactcagagacacatctgtaagaccccacagggacaagaaaagtagctgtgatctaggtctgcactaaagctgcctttcctggcactcagaagtgcccttccaggcctaactgcagaagggtggcctcagcctcctcctcctcctccttggcttcctcctcacggatctgcaccagcaactgaaagaggtttggggctggcccttccccagccccggtaagccacagctgccttcggatggccccgctgtggttggccccggcaatgacctgctctaggcgggcctggttcacattatctttatcaatggcccccttctctaccaccttctgtagcagaggctccagacgaatgacataagcagacaatttttctcccgggttctgataagtgttcagaaatttgatctgggcatccctagagctctcaacgctcccaaacacctgctcaagcgccttcaggcattcggcagtggttatcgcggggttgttggacttaaggatgcgaataacatcagcggcggggcctctaagactctccatcaaccgccgcctcttttctacatcggacacctgccactcctctaggacctcattagtgtgctccagccagggatcaaaggtttcctctccaggccctgggatgtccctccccgagaaaagtgtcagcctcttgtaccatatggactcaacaagaggctgaataacattatccaaaatatagtttagcatctctgctggcatctctgggcccggggtcggagtagggttctgaaacccaaggacacgggcaacatcttgcacggtccacccctctctagctaggaagaggtgcaatctttctaaaaattcagcatcagaagttgggggcttaaataacactttccagacccctcctttgcccggcatctccctggggatcgcggcgtaatctacagcgccagtgagctctaataaggctgctttcgcattttcttccctccagaacattctcccaagcattcggtaggagacctggggcatcgcagcctggagggtctcttcgatttcagcctcatcacagttcactgggatgccccagactaacagagctctctgggagttcacatccatcccccggcaccagtcttccaacagtgtcatcgccattttctcaactatcaagacgccaaattctaccaacagactgtggctcaccgtgctcctggccttagaacaataccagacactcccaccaagtaggcccgagggaggcgaccttcatgcagtcacgattaacaaagacagagtcctgatctcgcccttctctgcccccacagtcagtccgtaggtgcactcggagccgagctcggggacgctgaggcagtcacgcggccgtcgccatcttgcgtctgggtctgggtccggtcgggtccgccgcctgcagcaggggcgtcgcgtcgtcgtgcagcgggcgaggagcgacggcgggcggcgaaggcaggcgcgctgggccgagagccgccggggtgtggtcgcggggcgtggccgccgggcgctcgctgcggctcctggagaggatcgggcgttcgcggtcgcagcctggtcttcccgcgggcgaggagcggccgtttgggagactagccagagggagaaactgtgccgaagtcgcggcggctgcgggccagcggaaagcggcttcttggcgggcgcggggactcctctgggcgggcggcgaggacggccgaggaccagaaacgaaggcagcagaggagcaggaaagtcggagaagcgaggctggagacagcagaggcgagggtgggaag

SEQ ID NO: 2481 - DNA, 434 bp, Homo sapiens
atgagcaaatccaaatttattttaatgtcatgtcattttcaatgtgtttaaaaacctcataagttagtgggagccctagtttcctgggacagcatgccagaggtactgaaatttgtcacctttctctacaaacccccagcaatccaatccaagtccatagcttcagaaagccaggagttgtgtcttcagtcagtctacgcctctggttcttggtttttctttcatgggagggagatcacaatatttcaaacagggaacaaaaccagtcctcagcgatagtttgctcctgttgctcgtcctcgcccgacatcttcctactaccaccactgcagcctcgtttcccctgagccgccgccgcctctgtctcccttcccagccacaggctgtggtcagagtcccctcgatcctcgaggagagggcgagcgaaagcgcga

SEQ ID NO: 2482 - DNA, 675 bp, Homo sapiens
ctttaaagtcctataccaacacgcaggcacacatgtgcacgcacacgcacatacacacacacacacacacacacacaccctgaatctgctctccatgcctcagattatctcagtatacacaatgcaacaatcttgcagcattcacaaaaacttttttgttgctttttaggaagtagcgaggaaggaaagcaaagcagcaggatcccctagagagtttagtctttggtttctaagtttaaaggggggattggcttcagagcttggagcaagacagaagagtcgacggacggatgagctggcaagggagaagggagtctctggggcatgagcaagggagccgagatcttgtctgggttcatgaagctagagagggctgcggcagaggcgttgaggcctgggtatagcactggcactgaggtgggataccagcacttctccagcatgggcaggtaggcagtcgctgaaggtgggatcaggtagaagggcaggcagaaaggaggctggtgtgggtgtgggcccaggaacggggagctgatcaggtcactgctagtgaaatggccttcatcatccgaaagctgcatccggttcttttttgtggggggttcttcggactcttgcttaattgcgccgatcctttctcccatcgtgaacctgcgtccgtggtcacttttgaag

SEQ ID NO: 2483 - DNA, 634 bp, Homo sapiens
ctgagttctagatctgcctgtaccactgtgggacccaaggcctcgtggccctttgaggacacaagaaggctccgatgataacctggcaacctaggtagaaacccagccaagtgtgagcgtttgaagctgcagtttggctgccatcgtgtcggcgaaaagaaagaattcaggcaccatgtcatccagtacaaaggataaaaacggattcaaccggaaattcaatgtggcaccacatatgggatacatgagtgcggttatacaacaggccacatattttttttgaacagtctcctacatgtgatgccgaggacatgtgtaaccatcataacgtctctaggaatctgtatttaatttgagttggggtggtggcagggattggagatctgaagccgccacaggtttgtggcagatggctctgtgtcagctatgacaagcagccaggctcagcttcctctgcagattttcttttctctctgatcaggtaaatatgggcacactctggaaagttcttcagattctgccttaggctgcaagtttgtgacttagccccatctgtcacaaatcttccctaggttctgttgtaagcagagacctgaatttaccatgtagggctgcccaagaaaacggagcgatt

SEQ ID NO: 2484 - DNA, 1114 bp, Homo sapiens
ctgctggagatttccgccagagcgctggagaccttgcgctcagatcttctctggtgatgaagaggcgaggaatcaagtgactgatctggaagaaatatctcgcagcactgcagctaacatcacagaacttaagtgtgttttgtgtgtgtgcccacacgtagacaaatgtgtacggtgcacacacacagtgcatcattttttaagggcagattatatatatatatgagatgtattaattcagtggttaccatttgtttgcaggaaaaagaaatgtatgggtgaaaaaatttatggttgataaatccagccaaggagattaaaaggggtttggataaattctgggtataaatgctcagactaaaaaaaagaaatggcagttttgcacagtgctatggtcttgcactagtttttgtttctcatctgaaaaaaaaaaagtaaaataaaaggaagaaaatgtaccttttttatggaatgagtagactgtatgtttgaagatttagccacaacctctttgacatataatgacgcaacaaaaaggtgctgtttagtcctatggttcagtttatgcccctgacaagtttccattgtgttttgccgatcttctggctaatcgtggtatcctccatgttattagtaattctgtattccattttgttaacgcctggtagatgtaacctgctaggaggctaactttatacttatttaaaagctcttattttgtggtcattaaaatggcaatttatgtgcagcactttattgcagcaggaagcaggtgtgggttggttgtaaagctctttgctaatcttaaaaagtaatgggtgatttaaaaagaaaaaaggaaaaaaatctttggctgaatatgttcattgcttgtatttttaaaacaacagaatttccagtatgaaacaggctgaaagagcaggaagaaatgttctttgtataataatgggaagtttggaatataaaagtttatatattatttatctattggagaactggtgtacaggaggaacattttcttactgtgttgctgttttccatcatgtgttatcctaagagttggggttttttaaaatctgtttcaccaggggaaaataaaagcatccctaatgtt

SEQ ID NO: 2485 - DNA, 498 bp, Homo sapiens
atgccgccaaagttcgaccccaacgaaatcaaagtcgtatacctgaggtgcaccggaggtgaagtcggtgccacttctgccctggcccccaagatcggccccctgggtctgtctccaaaaaaggttggtgatgacattgccaaggcaacgggtgactggaagggcctgaggattacagtgaaactgaccattcagaacagacaggcccagattgaagtggtgccttctgcctctgccctaatcatcaaagctcttaaggaaccaccaagacacagaaagaaatagaaaaacattaaacaccgtgggaatatcacttttgatgagatcgtcaacattgcttgacagatgcggcactgatccttagccagagaactctctggaaccattaaagagatcctggggactgcccagtctgtgggctgtaacgttgatggccgccaccctcatgacatcatagatcacatcaacattggtgctgtggaatgcccagccagttaa

SEQ ID NO: 2486 - DNA, 1703 bp, Homo sapiens
ttccgcgctgcccggcgccctagcccgcacccaccttgacgtcctcgtcctcgtcctcgccttcccagcggtccccgccggcagtgccgccgccccccaccttccgcactgggtcttccacggagaaagcgtcggcgtctacggaagaaagcgagccgtgttagtgcctgccactgcgtggggccggcgccggcccgggccctgccccagcaacttctcctcaccccaggagtccgagtcccccgccgccgccgccgccgccgccatctcgagccgggtgtgagcgtgtgtgagagggagagctagcgaggagttagcacggcggagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatatacacatcctattgattctgtttctctggagaacccgtactaatatagtgtctgactagatatgaaggaggaggggaagggagaaatagataga

SEQ ID NO: 2487 - DNA, 31786 bp, Homo sapiens
gaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagaggaggcctctgccgcgggcactgtgagtcctggccgatgatgacgagaccactgcgcaatctgagttcaggtgatggagtatgttctgagaacagactgaggccgggcaagcaggaggcggccgcggcaggggagaggcggagagcccctcgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggctcacgcctgtaatcccagcactttgggaggccgaggtgggcggatcacgaggtcaggagatcgagaccatcctggctaacacggtgaaacctcatctctactaaaaatacaaaaaaattagctgggcgtggtggcgggcgcctgtagtcccagctgctggggaggctgaggcaggagaatggtgtgaacctgggaggcggagcttgcagtgagccgagatcgtgccactgcactccagcctgggtgacagagcaagactccgtctcaaaaaaaaaaaaaaaaaaaatgctcatgtatagagtgttcatttttgtacacagttttctattcagtttgcctctacatatttaagaaaggttaagtatcacaacttcccactgcagatcaccatcagtaggtctttatagatgtactgtgttttctctaattggaaatgtcactaatgagtggattctaacaccattcagtgaaaggtttacatatattaaaacacgtaaatatatgagagaatattgacatagtctccaagtctcatgaagaggaaagggtacctttacaatggataaatcttgcgggtattacttcaccaaattatgaagtaatggtgtcccatcaccaataaagggacagactgacgtcatgcgctccccttgctacagcgacaacacaatctcacttgcgtagaatttctgctgaaaacatctggcctgaatctaattataaggaaacaatgagacaaatccacatggaggtacattccacagaacaactgacctgaactctttaaaaacatcagtgtggtgaaaaacaaaaaatggctaaaataggaatagtatcacattaaaggagactagatatgtgacacatattgtatgagatccttaattaaaacctgggttaaaaaaatactctaaaagacagtattgggacaactggagaaacatataaattatagatgacatggtaatattgacattaagtttcctgatcatgataattatattgtagttatgtagaagattgtcctttgttctaaggaaatacatactgaaatatatgggggtgaagaatcatgagcttgcagatgactggaaaaaatgcatttatatatatacagttatgtgttgcttaaccacgagaatccatcctgaacgatgtgctattaggcgatttcgtcattgtgtgaacatcatagatttcacttacacaaacctcaatggtagagcctactacacacctaggctatatggtacagcctattgctcctaggctacaaacctgtatagcattttactctactgaacactgtaggcagttgtagcaagtagtaagcatttgtgcatctaaacataggaaagatagtgcatgactatacactggcagagaaagataaagcaaatatggccaaatattaccaactggggaatccaaatgaagaatatacagttgttcattattctttttcttttttttttttttgagacagtcttgctttgttgcccaggctggagtgcagtggcatgatctccacttactgcaacctccacctcccaggttcaagtgattttcctgcctcagcctcccgattatctgggattacaggtgcttgccatcctgcccggctaatttttgtatttttagtagagacaggtttcgccatgttggccaggctggtctcaaactcctgacctcaggtgatctgcccacctcggcctcgcaaagtgctggcattagaggcgtgagccactgcacctggcccattattctttttctaagaggggagtcttgcttgctatgttgccagggctggcctcaaactcctgggcttaagggatcctcctgtcccagcctcctgagtagcttgggactacaggcgtgtaccacattcttccatttttgcaacttttctgtaggttttaactctttcaaaatagaagttgggataaaaaatgtccttcacgtaagctacaaaattgcttgaaacaagttatttttgaaaatatttagtccttttcaggtttacatcatgtttaagcagttatgtattcttgtaattttaatatgtatattaaaattgtgataatttttgtctagatgtggagtctttcatgagatgtaaagttattgttctacttttagacatttaactctcagtatttttataaatgcaatattatcatttccttacttattttcctatgcttaaacacagtttctcctgctttcctataacactaaaaattgacggtggcttaagcagcagtggctttagaagtttcagtaatggaaactggggaaagctgacgaagtcagtagggcctaggacaacttttaaaaatgagtatatgaatctgaatgagtgagataagtgaatttgctgatcttgagtagtttggaacgttatgtgtgtgctcactgttaatctaattgctttggaaatacttcaatttttgttaattagaacgcaaatgttgaatgtggttttattcttaaaacaaatactaactcttcagaaagttcaagttgccaagcaagaacatcagatgaatgaaattgttcgcagtggcaaatccgtactggcctgcagcaactcacttcttgcctcctcaaaggaatgaagcataaggcagagtgagagaccgaggcaagtttttgagcaggagtgagagtttattaagaagtattagagcaggaataaaagtaagtaaagtacacttggaagagggccaagtgggcaacttgagagattcagctgtgccacctgacccttgatttggggattgatacattggtacggttctaggccttgcattacttcttccgatttttcccttggggtgggctgtcggcatgctcagtggcctgccggcacttgggaggggtggcatgtgcagtgtgtttactgaagttgtgcacatactcactagagacattcctcccttaccagtcttgttcctagaggaagctcatataccagttaaactctaccattttgcctcttagtgagcatgtttgagcccactctcccaaaatcttatccacaagctgctgatcaccagattctagtattttccatctattgggagaatgcctttccctgacgccagttgagacgaatgattattttagatagtttaacaacttgcctgaccatcacctgatagtcgcttgacattcctgggcggggtgggggaggttttctcctgccctgcccaagtctgcctagctacctattctaagggaatgtagacaggaagtaataaagacaccaatacgccaaactccctcatgttaagtttaccctaagtcttgatgtgttcccagtaaccctaaggcactgtctcaaacttaagatagatatttgtttttcttttttctctacttgtctgaaagttatttgcagcttctatatctttggctcaactttcatttagtagcataaccttaggcaaatcttccttggatctaagtttactctgcaaaatactaatgttggtagaaggagacaatgctgttgttgccttccagccagaaacctccagaaacacacctatagttgaacaagttgggtttaatgttctttggaagaagggagattgcacatcatgggtgtgcctttgggaactgcagcacatctcagtaaaagggtggtaggatttggggtttggttaggtgatttggggaggatccaaggaagtacgggttcactctggattgggtactgtcaggaagtagggacaagtctttgggtatcagtactattcagggttctccagagggacagaactaatagaacatatgtatatatggaagggagtttaagtccaggcctggtggctcacacctgtaatcccagcactttgtgaggccgaggcgggtggatcacgaggtcaagagatcgagaccagcctggccaacatggtgaaaccccgtctcttctaaaaatacaaaaattagctgggcgtggtggcgtgcatctgtagtcccagctacttgggaggctgaggcaggagaatcacttgaacccaggaggcggaggttgcagtgagccaagatggtgccactgcactctagcctggtgacagagcgagactctgtgaccccgtctcaaaaaaaaaaaaaaaaaaaagcaaaagaaagaaaggaagggagggaggtgagggagggagggagtttattaaggagaattgactcacaggatcacaaggtgaagtcgcacaataggccatcagcaggctcagccaggaatggctcagtctgggtccaaaagcctcaaaagtagggaagccaacagtgtagtcttcagtctgtggccaaagggcgcctgagagctcctggcaagccattggtgtaagtccaagggtccaaaggctgaagaacctggagtctgatgtccaagggcaggaggaatggaaggaagcatccagcacaggagaaagatgaaagccagaagactcagcaagccagcttatcccaccttcttccacccactttgttctagctgcgctggcagccaattgcatggtgcccacccacactgagggtggctcttcctctcccaggccaccgactcaaatgttaatttcctctggcaacaacctcacagacctactcagaaacaatactttaccagctatctaggcatccttcaatcaagttgacaactaatattaaccgtcacagtatcatcttatcctgaaggagggctgattagagctaggctcaagctgcacctgggaaagcagctacagtccctcatattacctgggacagggcatatttggtgttacatggtttacacagtgatcttgtttttgtgcctgggcaaaattacagtcttgtttcatatcactttagtgtagtcagagtggccacatctgatattggtgttttataaggttgttcatagcaaaagaacaacacggcccagcacagaggaccaggccagcttctagcatgacccaggcctagctctgagtttcaaatcagttcctggaagtcagtctgcttttctctttctgaactgttattaagtgtatcttgtatgaaatttgcttcttttcaaatgtggttttcctgttgaggctttgaagctaggactaaacctctttgagaatgagctgaaggctttcctcaagtgagggtattctttggtcagccactcaaaaagtgaatccatctttagattggaaggtggtttcaaaagtcaacttttcactgcatagtatacagcaggtccctacataacattgtttcattcattgtcattttgacataatgttggtgagaaaaaaagaattgcttcctggccagggccactgtgtgtgtggagtttgcaggttctccctgttacagtgggtacctagtcaggcatgagcagggcaggagagagctcccccctccacacacacaccaggagcatcttgtgaccatccagtgatggtcaaggcagttgttaactgtctttctaaagtagtcattggtcgcagccagcatcagagaaaggcagtctcccgatagaaaacacatgaaactggtgatcagccacttcctgacaagatctcaggagttgagagaagtaacacaagaccgcagaagtaggccaacatataaaaccccaagtcaagaggttaagccacgctcttgactctttcaagtcacccacttggccctcttccaagtgtactttcctgcctttccactcctattctaaaacttgccttggtctctccttctgctgtacggccctcaaattctttcttctgaggtggcaagaattgaggctgcagcctcattcatacagacatggatacgttccactggtgagatccccatgactgttttctttggattctcatttcctcccatgtcctaaagctgtgtacatgaggtgaatggatgtgtctaagtgatcccagtctgagtgtgggtttgtgagcacacccagtgacaggatggtttcctgtccaggcctggtgcctccctggcaccctgagctgccaggagaggtgggccctcagtgactcttaaatggaataagtgggcaactttctcatttgtttttattaatctttctcaaatgtatatatagctttcatttcagtgtttaattctagaagtgttttggtctttatttagaagtttgttgatgttttggccgggcatggtggctcatacctctaatcccagcactttgggaggccgaggcaggcagatcactgggggctaggagtttgagaccagccgggacagcatagtgaaaccccatctctataaaaatacaaaaaaattagccaggcatggtggcggacgcctgtaatcccagttactcgggaggctgaggaggaagaatcacttaaacccaggaggcagaggttgcagtgagctgagatcttgccattgccctccagcctgagcaacagagcaagactccatctcaaaaaaaaaaaaatttggtgatgtttgtatgaccataaatatgccgaaggaactgtttatatcaactagcttatgttaaaattggtgtcattacgtcattttgtttatactcgtggtttcctagaacttatcagtgacgttgaggactaattatactgtgaccatttttctggatcatgaaatatttcaatagtggtctctaatgatgggtgcttaagggcaccatccctggggatgtcttcttgtatatttttaggtgggtcaggttaacaatgggtgtggaagggcaccatctctggaggtgtcttattccataaatttgggtgtaaatttttttaaagatttccaggtgattttgatgtgtactcccagttaagaaaaaatgtatcagtatttccatatagatgctcagtttctgggctattctgttccactggtcaatttttccacatccagggccgggcgcggtggctcacgcctataatcccagcactttgggaggccgaggcgggtggattacctgaggtcgggagtttgagaccagcctgacagacatggagaaaccttgtctctactaaaaatacaaaattagctgggcatggtggcacatacctataatcccagctactagggaggctgaggcaggagaattgcttgaacctgggaggcggaggttgcggtgagctgagattgtgccattgcactccagcctgggcaacaaaagcgaaactctgtttcaaaaaaaaaaaaaaaatttccatgtctgtcatcctcacacatcttaattactgaaattttgtaagtctcaatgcctgctaaggaaagcttcccactttctcaaggagggtcttccttattcatgggcctttgctcttccatataaatcttataatgagcttgtcagttttcacatagaaacagttgaaattttgatttttaatctatagatcaacttggggacaactgacaaacttttagtggtatggagtcttcgaattcttgtacctaattatttctccattttaatgttgtcattgtttttcacttatattttacaaattcctccatacagatcttatgactatttccccactgatttttcatgccatctctaccgtatgctatgttatacataggattgggcctatccttgcactccctattctgtttcgttgatctacttgtctttgcctacaccaaaactgcctttaattccatagctttaaagtaattgctcaataagccttgttatctgagagtttctccctgcccccaacttttggactgtaagatgctgacctctggtttaaatgatcttgacacgtattagaatataggccccataatgaagcttctcaagagagcattacaaagaaactttgtcaacctgtagctgcagagttttaaatttcatttagatttggcacacctctttattcaaaagtatttatttccacaaatttttatccacagctaaatattacagtgactattacaagcatttttctataaacaaaggtgtagtttacagatttgtgcaaagtgggaaaatattttcatcagtagtctttcttccatggtgttggattcacccctgaatatgatctgaactctttcagagaggcagtccttcatctaaatgtcagttggtggcaaaatgttatattcaaatctggattattctgatacagtgtcactttagaaagtagcttagtttcatttctgattgatcccctttgttagaattagaaattttttgaaaaacaatcttttgtatctaatgacctttataataaaaaaaaccctgtcctgtgtttctcattggcattaacctctgtctacaccctctaattctctaattatggcaccagtgggtataaaaagtgaattatggttatttggctcatgcagcaaattaattggagaaactgaccacaaatattctgtgaagaactacaaggtcttgccccatgctgtcccattttagtgaccatttagttatgcaggcattatacaaatgcctcaatttaggacacccttgctgtcttagtaggtcaagtgtatgaaaatttactttatgcagaagaaatgaattctaatttattggttactggaatcttaatgtatgaaagctctaagtaaatatttgatgaattgatggtagcagtgttgatttttaactgttccaagctcctagttttgttttgtttttacaaaagccttaaaatttagtactagggaaatcaaaggaagcaactcccactgacatgcttcatggaaaggggaaaaacatctacctttgggtctaatctgcctcccaggtgagcctacaggtactggaactctaactgcaactatgagggcacagggaaaatgcatgtatgtaatatgcttgtcagcttcagcaacaactcatgtgtacattcacatttactataagtaaacaggtcccgtataatacttaaaacacaagttttgatctataaatatttgattcttaatatttaaaatgcttctaatgttttaaaagacaaaactcccccatgatatcaccttgaacattaaaattattcccacagcaacacttatttcagagaaacaactgatgtcagttatcttagtaaccgctaaaggcacctggtgaaaaaaatgtcaactaaattttaaatattaaaaaattaaagagacatctaatgcagagttcaaacctgaattgttaaagagtcattactgatttcatgacactgataaatgtttgaattgaaatgattttttaaaatgcagagaaaatgctaacaaaagattatatagttcccctaaagatgcttcttctagcctccaagtattaaataagacagatctaaatattaactacatataaagtatatatttgttagtcatctgtaagttttaagtacaattccaggatatacctttatcttttggaagagaagaactaaatctgccatttcttaggctaaatggactattcataaggtccttccctccccatttattctaattgccaagcttttattcagtaagctcttggcacctagtgattaaccagtgacagcagagagtagtgaccaagagagatggagagaatgatggtataagacagtgtataaggatagtaagccactgtgtttgtggaaccactgcatgtcaaaactccttaacactctaacaaggcatttttggtcttttaaggatggtccttacataagagactcactttcaaactaaagtgcattaaaaaacaaattatccttcacaaacaactttaaagaggtagccacaaacccagttgttttagattggccttctaaatgaagtcagcacatggatccatgggtaagtgtcatggacgtcagtgattatgtaactgtaactgaaagaaaaaggcacagctctgccgatgcccaagagaagccggcatgtttaatgtggatgtagaggggataatgcccatgacaactgattggaacacaatgtcagcagccttaacccaggctaagactggcctaagccccaggagatgcagagaacaactgaggaagctgtgctctaagggcacagtgcagaaggtagcgtggagtgtgctgtgtttccaagagccttttaagttgggtggttgagtaaaagagggtgaaggcaggctgttctacttccaattcatggataaatcttattttctcaatgtaatacagaggctgttcttccatgatttgcaaataccatttttttcttatgggaacagcatactgctatcaagaaatacagaaaagacagtaaaaaaaagtgtggaaagaatatgggtttccaattgaatgcttgcttttgaagaaaccaaaaacaagttaaaaaaaattctaagagcagcaaacatctaagcctgttatattactgaattacttttttaaaatccttattttgtgggagagatatttacaattttttgtgtgctaaatttgaaaaacgttgaaaataacctgaaaagggaaagttgacctaagccattttattctcttaaaaaaaaaaaacccaaacttttgtataatatccctgaactgattatttttgaaggtttttcagatgatctgatgtgcgaactttagtttgttttactatttggtttctggaacagtagagcattatgtgatgctcttactggaagcttaatggtattaagagattaaaagctttcatattgacttgtttggtttttacatctataaataaaacaagtttgttatccgtttctaatatttagcttatatacatttttgtgaaagttttgtgggacttggaaagtgtatggactagcatcagaaacaaaatatttttccatctttctcacttggagtttgggatagcagcattttaataatctcttccattaaatcaagataacacaaaagcgtttgagcacactgaggactggcacttctaattttgcttcagaaaccagtactcaaaatgtctggtctggaggtcagttacaccactgtctgtgtataatcagccattaaaaaatattttgggaatatttctcagaagtctcatccccatatttttgttcttaaaacatctcaccacaaactcaaccacacctatggtttgcaaactttgggaaatgtcagtatatgccattatcatggttattagtaccattatttgttaaagccctttgaaggcaatttatgtgacttatatatatttggtattttaatttggacattctctagttctatgcaaagatcaaaactaggcagcttcgttttatagaattgacaccttttatatgtctatggggactgcttggtgtctataaattatgtatatgtgttggactgaaatcaaacttaaaatcttccatatttcaagtgtttttattctgagcagtaggtacaaaaaataatgacatagttgtgtctaattctgtatagttcagcaccctccacaggctgtcaatctctgatttgatctacttttaccagatttaacagatccttgaatttactttactgtatatacttccttcttgctcacattgggaatcaaactaatgctggaaacatgcatcttcagacttcattgaggaattccagattgagacacgctgggatgtggattgagtccatggttagagaagatggattaaatggaaacaaaacaggaaacatgtgcttggcatctaatagcagttgctgagggtcattccgctcttgtagttgtgcctatggggaagaataagaccatgtaaagtttgagtacccctaaaaatagccagtttaagtgaattcacaaaagtgagttggcatatatcatggaaagatttctacgacaattaggtagaacttcaggactaggagaatgtgatctcctcacccttgaggtatttagtggggagagaagccctgacttaggcttcttggagatcagagggctgtaagcactctcccaattctagcattctttaaaaaattgtctaagggagaatataaaatacatctcaggtgcaaaccatatggagaggcactatagtgaagtggccaagggcatgggtttttttttttaggtagacagctgagctctaatcctggcaccaccctgggcaaattcctgaattttttatgcctcagtttctttacctgtagaatgggagaagagtacatcacataaaatggcagagtaggaagccctagggattggtccctccactgaagctaccttgaagtagaaacagtgattgtcaactatctcataactctggaacttgattggacatttataacaatcgggagactgattggtaaagggagaggctgctgatctttgctaagggaactgtgtgtgtgacccagctactatccccctctcttcagctcccctgaagctatggggatagcagctcacattcctggagtagctagctggccagggtaggcagtgggaccttgtcctccaaaaatttggggttgtgccctttgatctggtgggtcccagcagatgcctgtcttggtttagacattccttgggatgcaatggcttccactagtggcatcaactggaaaatttaaaggcacagagcccctccctgcttcctatttgaagccagaaattttaggaaaagtacaaaaactgaaatgaaaaattcactagagaagtttaaccgcagacttgagcaggcagaagaaaatcagtgaatttgaagataaagcaattgaaatgatccagtctgagaagaaaataaaaataatgaggtaaaaatgaacagagcctaacagacctattggacaccatcaagtataccaacatacacattacaggagtaccagaaggaaaagagcaagaagggggcaacaaaatatttgaagaaataatgccagaaacttcccaaatctgatgaaagacatgtatgtaatcatccaaaaagttcaatgaactccaagcaggataaaggcaaagagattcacagtgaaacacattatactaaattgtcaaaaccctaagacaaagagggagtcttgaaggcagtgagaaagaagtgacttgtcacatacagtcatccctcagtatccatgggggattggttccaggaattcccacagatacccagatccatggatatgcaagtactgctgtcggccctgtagaacctatagatagaaaaagttgtccctccataactacaggttctgcatcctgtgaatactgaattttgaatctgtggttggctgaatctgcagatatggaacctgtggatatggagggctgactgtataaggtatcctcaaataagattaacagctgtttttcatcagaaaccatggaggctaggaggcagtgggatgacacagctcaaatcctgaaaggaaaaaatcttgtctgctaagaattctaaatctggcaaaactacccttcaagaatgaaggagaaattaagtcatttccagagacaaagaaggacattatattttaataaaaggttcaactcatcaagaagatataataaacatctgcatctagcaacagaaccccaaaatatttgaagggagaattgacagactttaagggaggatagttctacagtaatggttggacatttcaataccccatttttaatcatggatagaaccagatagaagatcaataagaaaatagaggccatgaacaacactataaaccaattagtcctaacaaacacatatggaacaccccacttagcagcatacacattcttctcaatgcatatggaacagtctccaatattcaaacaagtctgaataaatttaaaaatattaaagccatatgaaatattttttctgattaggatggaatgaaactataaatcaataaatgaaagctgcaaaatccacaaatatatggaaaataataagttctcaaatagccaatgggctaaagaaatcacagggggaattaggcaataaaaatataataaaccaaagcttatgggatgggataaacatagtgctaaaaagtttgtagctgtaaatgtctacattaaaaaaaaaaatctcaaatcaataacctaactgtataccttaaggaatcagaaaaagagcaaactaaacctaaacctagaagaaatgaaataacataaattagatggaaaaaatagagaacagatcaatacccaaaacaaatgaaatcaaagttggttcaaaaaattgacaattttttttttttttttaagatggggtcttgctctgtcacccaggctggagtgcagtggtgtgatctctgctcacaatctccgcctcccaggttcaagtgattctcctgcctcagccccccaagtagctgggattacaggtgtgtgggaagactaaaatgagaaattagcaaatcagaaatgaaagtgaggacattactgccaattttacagaaataaaaaggattataagagaatactatgaaaaatttaacaccaacaaattggataacctagatgaaatggacaaaatcccaggaacacacaaactaccaaaactgatttaagaagaaatagaaaatttgaatagacctataacaagtaagcatattgaattagtaattaaatatttcccaacaaaggaaagcccaagatgggcttcactggtgaagactatcaaacatttaaagaagaattaacaccagttctcaaactcttcctaaaaatcaaagaggaaggcacactttaactcattctatgaggccagtataaccctaatatcaaagccagataaagaccctgtaagaaaacaaaactatattcatcccttataaatacagatgtaaaagccctcaagaaaatactagcaaactgaattcagtaaaaggttaaaaggattatacaccatgaccaagcaagatttaccttcagaaagcaaggttagttcaacataaaaatcaatcaatgtaatataccacattaacagaatgaagaggaaaaaacccacatcatctcaatcgatggagaaaagcatttgccaaaatccaacttttttaatgataaaaagataaatccctccatgatgaagaccatatgtaaaaaccccacatttaacatcacaaatatcacactcagaaagtttttcctctaagatcaagaataagataaggatgcctgttcttaccacttctattcagtatagttctagccagggcaattatacaagaaaagagataagaggcagccaatttaaaatgatcctcttgcagacaacatatcttacatgtagaaaaactgaaagaatccacacacacacacacacacacacacaaatattgctagagctaatgaattcagcgaagtacataataaaaaaaaacacataaaaatcagttgtatttctattcactagtaatgaataatcagaaagaaaaacaattccatttacaataacatcaaaaagaataaaatacttaggaataaatctagccaagaaggtgcaacacttctgaaaaagtcaagacctaaacaaatggaaagacaccccatgttcatgtactagaagacttaagatgacaatactacataagcaatctacagattcagtgcaatccctatcaaaatcccaatgacgttttttgcagaaatctaaaaaaatcctaaaattcatatcaaacttcaagggatcttgactagccaaagcaatcctgaaaaataacaaaattggccaggtgcaatggctcatgcctgcaatcccagcactttgggaagctgaggtgggcagatcacctgaggttgggagtttgagaccaacctggcaaacatggtgaagccccttccctactaaaaacgcaaaaattagccaggcatggtggtgcatgcctatattccctgaggcaggagaattgcttgaacctgggaggcggaggttgcagtgagccaagattgcactactgcgctccatgggtgatagagtgagactctgtctcaaaaaaaaaaaaaaaaaaaaaaaggaaaacaaaattggaggactcacacttcccatttgaaaactttttacaaagctatgggaatcaaaacagtatggtactggtatacggacagacatacagaccaatagaatataagggcccagaaaaaaaaaaaaccctcatatttttggtcaattgatttttgacaagggtgccaagtccattcaatgagggaaagggcagtgtctttgacaaatggtgctgagacaactggatatccacatacagaagaatgaagtgggacattcaccttataccatatacaaaaattaactctgaatggatcaaaaacttaaagggagctaaatctgcaaagctcttagaaaacataggggaaagtatttatggttcttaaaaatgacatcaagagcataggaaacaaaaaaatatacatagattggacatcctcaaaatttaaaactcctgcatcaaaggacactatcaagaaagtgaaaagacaacccacagaatgggagaaaatacttgcaaatcatatctgataaggatttaatatccagattatacaaataactcctacaactcaatatcaaaaagacaataatctaatttaaaaatgaattaaatactggaatagatatttctccagagaagatatatacatggccaataggcacacgaaaagatgctagtcatcagagagatacaaatccaaaccacaatgagatgccacttcacacccattaagatggctataattttaaaaagctggaaaatcacaagtgttggtgaggatgtggggaaactggaactctcatgcattgctggtgggaatgtaaaatggtatagctgctgtggaaaagtttcagattcctcaaaaagttaaatatagagttaccatatgacccagtaattctgcctctaaatatatgccccaaagaactgaaaaattgatctcagctccttgtgcaacaatgttcatagcggcatgattcccaatagccaaaaggtagaaacagtgcagtttccatcaaccaatgaatagacagaatgggatatataaagggaatattagtcactaaaaaaatgaagtttttatgcatgctacaacatggatgacctttgagaacctaagtgaaataagccagacccgaaagaatatcgtatgagccaacttatatgtgatatctagaatttacatatagaagcctacccagggttgaagggaagggagaatattatttgcccaaatgggtagtgtttctgtttaggatgatgaaagaattttggaaatagtggtgatggttatgtaatattgtgaatatacttaatgccacggaactatacacttaaaaatggttaaaatggaacacacataccccaaaaccatgggatggagaagagtacccttctgataaggttgtgaggatttgaagagttaacaggtgtaaagaacacagagtaccatcactggcacatagtaagtgctgtatttgctgttatcagttttataatatgctcctttgttcctcctgcccatgcattaaccattgacctctgaaccatgaactgctggtagaagctgtacttttacaaaagtcaatagggttaactgtgggagtattgccaaaaaggaaaatcaatatatcctgattttgtgaaaacacaatttatttttcttaaacctcgaaacaggccatagtcagtaaatacatagcagcatttgaaaatcgctgggaaataggtttacagaatgaagtcagctggagcatggcactgtaagatggctctatagtggcaggggaacctagaattgcccacgttttcatccattacctgaattatgaatagaaagcatgacttaaatttccagtacccgtgtgtttggcatcttgaaagatgggccaaaattttaaagtaattttaatcatttgaaaaagtggtttgaaataatgggagagaagtttaaaggagagaaaggtatttagggaggaataagcaactagcctcactaattcaaggtactcaatgatggctctggtgtggcctggcagaatgattctctgggattgttgacagctcacacacagcccactctgaggtttgctgcgtttattatcatgaacctatcacaaggcatatgtatgtaaaatgtgaaatggcaggaggctctgggaaaaaaagtcatctttgtagcacttaagggcccttgtatttctccacattagttagatgtgacagtagacttcactacctaaagggtttgaagaaattttagagagtataaaaatgggaaaagaaagtgaaatattacctatattatcacaattcaacagcaaaaggcatgtatacttttaatcaattaaagtatataaggtggtcatttcacagaaatcctcctgtgaatgctttggtgagtttaacaacttcaaatttacatttttaaaggtcagtacaaagctataaaaagcccagagcgcccaagcaatggtttgctttaacaagtaacttgtctttatcacacatgtgagttcaaatgtaggagggcaggactgattgttcaccatttcttctgagcattgtataggtagaaacaacataaagctatagctcatgaaaaaaatattttgctagaactgcgagacactgaaattgattactgaggaagattcagaatctgactgtacatattttgagagaatagttgggcttaacctccattatattttccctttgtccttgatccattaaacctgcagtatgatgtggcatatattttttaacctgaattctcataaacagtggggttgccaatttatgagcagttatagttctccctctaatgtgtgtctcagatattcgaaactaaacaagactttctaaacttgcacttttgtataaattatcagccctccataaaaatccatataatgggtccaggttcagatatctcagtggcttctgtcatcaaactcttcccattcagcagctgactatgagcatcctaactggatcctttctgtcagcgccacccacaaccccattgttgtatacatgttggtgagtagagagactcactctgcctgccccattctgcggcctgtgtctttaacaatcgactgtgtttctgtcattgcccttaggagaacaacctttagtctgactaggcaccacttcccagacgttccctctgttggcctctgttccctacttagatgctgggctaaagttcatttaggctttttttttgccatggctcttttcaaacccctttttagctcttttcagggctctctaaatctctggatctacattgaaacactgtaaggagctccaaataaaatcccaggagtattccaaagggaacaggttcttgtacaaagctccatgtttcctcacgtttcttcagtgtctttgataaacctccatttggttccctttttcctgactctccctctgatgacttccccctgaacccctttttaatccttgttttgtgtcaatatcccttcactggccaacaaggtcatttaaaagtttgagggagtgctatgtctcccctgaggtgctccccacaggtaatcatgggagaagtgtggcctgttttctgaatcactgcgacatgactatcattccaacactgtcacagttactatcacatgcaaaggtcaggcgctcagccatcaccttgggctcagcttaaggaagctcatgtttaagtaaaacattcccatcatcttaggaaaagacagatttaaataaccgttttccctaatacattttctttcaagcattttcctaaaagcaaatattgtcttttttttttgagacaagagtctcactctgtcgcccaggctggagttcagtggcgcaatctcggctcactgcaagctccgcctcccaggttcacgccattctcctgcctcagcctcccgagtagctgggactacaggcgcccaccaccacgcccggctaattttttgtatttttagtagagaccgggtttcaccgtgttagccaggatggtcttgatctcctgacctcgtgatccacccacctcggcctcccaaagtgctgggattacaggagtgagccaccgcacctggcctatattataagtcttagacaaagatttaagagctcaaattgctttctttaaagaacatttcttagttccatttatggttagggctgatattctgctgacattgttaattccatttggtgctaatagttcagtaacatgctagtggcaaatgacataatgcttaaactatgtctataatctgagaggcagagatgataaaagttgagttttctgtgtgtaaacagtaagttactcatgggtgatacggttcatgtttacctaagtagaaagtctaggaatgtaaggtctcccagcatatatgtaaccagtattttagtaataaagagaagcaagattaaagcccaaatttttaatttcctttatagtcgtagactggactttataaaattactatcttaaaactcacctggattgttcgtataaaggccactgttacccgttcttcaaattcattcaggggagtataaaggtttaaaattttgacaatctgttggggataaaaacggaatttagcacagagctaaatgaacatgagacaacttttgaactttaaagaatatgtgacattggtacaagagtatgatcctctttagacaaggcccacaacacagatggagctggactgacatttacacttggagcctgcatccaggaaactagagcccacagctttgtcaggtggatctgagccctctcaccgaactcatgtctcctgtaaacccacctgcccctccccactatgctcattggtatacacaatgaggagtttagaatgcagttgcctgaaatcctcagcctcatatctactagtaatttaaaggtttcttctgaagagtactggagatcttaccttagatgagaaaggtcttgtttaatacctaactaccccctgtcccccaacattgtttacaaatgagtatttgaacaggagatactcttttgtctgcctaccactggtttggtggaagtagactgcccaaatgcaatgccagctgcatctagaaggaaacttactttaagtgaaatgtatttaaagagaagaaaaatgtttgaagactttctggaaatgtttacagaaggaagcagttttttaaagagttagatatttaatattttaatagtaagcagaggaggtaaggaaaggtgttcactttgctatattaagatgtgtttttctgtactgagtttggattttgttatttatctttcagggactggcaatgtgtcggcaactgaatcatggttatacattttttagggaaaaggaaagtaacacttaaatgcccctaagttcttaatgacttcatttaaaacaatataaatgagtgtgagtgaaaatatgaccatattgcaattagttttaaagaaaaggtttttcttacagttatatttgtaaagaaagcaaatacctgatgctgccaatttctgaaaatttgtggatttctatgtaagaaacattccagaattcattatatttaaagaagtttttacctaaacttaacgttttgtgagtttgctaccttatctttttaagtgagtaagagggatagagagttactagaaaacagtatctgtggcatcttgtttcacagaccaaatggtttttggttcatctaggaatatcccatcagctgcacttcaaaattgtctcattaggggtatataaagggtgggagtgcaacactaacaaataaccaccaacgagaacagacttggaatggactcagggcttccttggaataccatgttgacagaggtgcaaagtgactgtacctgctgggtgctgagggaggtacacagggagcagatagcctctgcgtcctcctgggttttcttctttaattgcaggagctgggctgcttggatcagaggttccatggtctgaactgctccactctggtgaaggtttcttccccgaagccactcctcaagctgacttatattgtaccttagccataggtagaaagcaagctatgttaagccggtcctcctaattcactgagaaggggacacctgttgtgttttgcaggcccgctgcagctagtgccattatttatctcacacggttaaaaagcatggcaagtgccttgcactcaggaactatttgttgaataaagaatgaataaatgaatgagtgggtacttaaaatcaagcaaagatgaaatacctgaagtgtctacataagttaacagggaaaaacaggcattaaatatactgaattgtaagtatttatatttaacattcacaaatgtatttatacttctatgtgagccttcatgcctcttaactcattgagttttctctctgacctatctgctttgtattcagtctttaacttagagtatgtcaacatctttaagctttgaactaatttgtttaccaagtcaaccatctcagtgttcgacggatttcaccaacaggtaaaaaggtgatggatttgagtcacagactgatggagacaaggactgtcaattagatttggatttcatttttagaaacagcagtcttgtgttctgattctagctgcagtcagtgagggcccactctatctgtgttgttggggggtgctcctcccttacctgagttgcatgcctgtgctccaagagcagacgtccttccgcaagagcaggttgttaagagtcactgcgttgatcatgtagaagagctgtttgaatacctgcaggatgatctcagggtccaagccctggtcacacatgactgtatgaaaggcattcatctggcggatgatagcttccaggcagtatgagttatccccatctgccatgctggaggagcgcttccggtagccggtgggcttcacaccagatagaccctgaatgctctcattttccaacatggcagaaactgaaataaaagcacagttagagaagcttgcattccccactaacaatgcaaagattggaccactcaaatcatttagtgctccgggctttagcaatgataccatccagaggtgtgcaatgttgacatgcttaggaacttataacatttggcaaaaaatttctaatgtgttgatttctgtatggaataaaacagctgtggacagcattttcatttaatttactggcaattagacaaagatgatgggcatgtaccagctcgatttggtatcgcctgtgctgaagtccacagtttgagaattgagcaacctgggtgtcatcctcgtccagccactgactatgtaaataagagcttcattggtccgtcatacttactaagcagccattacctatgcaccaggggctttatgttcagtatctctttcaatcttccaacaactctataaagtactacccatttttatgaggaagttgaggtataaagcggttaaataacttgtctgaggtcacactgatagggagtggcagggccaggatttaaacccaagtctgtctgactccagaactgctgctattaaccttcacattattctgagtatctccagcttgatatgtcagttctccctctgtctggtgccttataaaaagatttccagacaggaaggagggtttggaatgaacctcatttcaagtaatgtatttctagattggtccttcttgggattcactcataacctacttgtgttgtaagaacctggggaaagcattatgaataggtccaggtacactttccttcccagcctttgcagagcacagtgagtaatgcatctacacataatttttcttccgattgaaaatgtaactgctctcatttctcaattctgatttcatgttcagtgcccaagtacactgcttggttcaaagcaagtgtctaataaatactgatgcatcgtgccgactgctgtgtcctttcgcatgaacactcctgcttttttccatgaatcaagttcataataggttaagagggttatgctttttcactgtatatgcatttgtaccttttgagtttacatttattatgtattaaaatttgggaaaaaatacaacatattacagaaaaagagataaagggaaagtcatctatgcctcttgcactgtgtcaaatactttcacagctttttaagcatgatgtgcacacctcagttctgccttcactggaaggttctggctttctggaggtcatggctaagatatctggttcccgaaaggcagagggtgctgaccacgccttcccctcatttcagacaccatgatgagtgatgtagctctcctgctgccagcttacctatcatcggctgtaacacgccctcggcaattttaatgagctgctggtagatctgaatggaaaggtcactcagcacctgacggtattcggtgaggtcaaaattcttaagacagtgttcattctgctttgcagtgttctgagtcatgaagccctgcagagggagaggcgtgcactactgagttctctggtctgctgggcccagcacaacttccagggctctggtaactttagtcatctatttggtgggcagggggcctactcaggccctccctatgtagatgatgttttacaaaagcctgtcagttctttgaggcctcattgatgacccttgaacttgaaggatgtagaaaaactcaacatgagagagaaagcctgaatcgctcagtccaaatccctgaggcgaagtgatttccctacggtagcaaaacctaggttggtaccaggtccagagaaagggatccctgctttttcccttcatccagcgctttcctcaatatatcaggtccccctaaaatgttagatgatgtgcagcctctaaaggagtgtggccatgggccagattatacgcttgtatgaggagaaattttatacagattctatcactggttatcagaattaatagatgaactaaagtgatttcatagctaccgcactgtgtcctcttagctttctgtattaatcagatgaaatcacatgtaagttaagggaactgctgatatcagaagggctcatgtgaccaatgtccttttcattcaggcctagggaaaccagtatctgccaaaaagattagtgctcccaaaagggcaaccatcttcagcaaggcctgttgtactgtgtcaaatacaaagccatcttaatatgaaaaaaagcaggcagaaaaggggataattgtaatgatgaagatagagtcaatcattcttccttgttatttggactacacggatctggtcatgctgtggttcagctcttgacccagagaatatgagcacatgtaaccacaacctaatgtaatggagttctaggtcctgccctagccttatataacctcccatttagaatgtgtataacattgggtaaagtgatggacctcaatgaaataacattacatgtagttctatgcttcaagtaaatgcttggatattatgattttgtaacagaagtcatggggtttgaaatggctatttctttaacctttggcccatctcttttataataaaagcaggccatcaaatgaagtgctggttcttaggagagagatggcgtcaagccaactgcaaagaaggtaagactgaaaggaagggcatatccttttactaacccagggagaagagtctgtcaaaattggttctggcacaaaagatggaataaagctttaaaaatggtcgcactattttggtttacactatgtcttgaccttgggaagggtggatggtgagatatgtgaaaggaaggggaagaaaagttggaagacctacaggaacctgtgagcgggcatatctggaacaagctgggattctcaccagagaaactagaatggaaacaagccacatattactaggtcattgggcagagtgcagagcatgggagaagttctttcagggaccaaagctaggaatgtgagttccagaaaaagctgggccttacaggtccggtgtggattgtgaagtgatggggttagtagttgggcctcaggtcaaggaatccaatttggataaatgcatggagctgggcctccaggtcagtttgcacacacgtagttctgattatggtgtgcctctgttcttgtggccatctttgtctatcttgaaatggacagattaatcagttggcttaggagacagggtgacccactaggcaactgagctccctgccagtatccactgcagtggggcttctagagctgatacagaaatgtcaggttacaagagtttcatggagactcccagggcctctattgatcatgggttatgcagactctacttacataacccaggagtgctttttggggccccttgggctcatcaaggcctcctagaggcaggtctcctgtggctggccttattgctgcttccagccacgaggcatgataaggtgtgcccacggtctgaggtccccaagggtgctccaaagaccccactgacctctgagggtatacaaagcacttctcaaccacatttggatgaagcaggaatgcctcctgggtgcctggctccccactcacctcatccccgctgtactgcttcagacagtgaagaaggcggcaggtgttggataaccagaatgacgtcatctcaaagtcatcattgtgcttctgtgaaaagaaaaggacatcctcagctctaagtggctcccatctggtgaaatgcttcctcggtacctctttccccacatttcctacccttacctagtgttcctgagcagccctgaggctgggcagggcacttgccagtcacggggttgagacccattgctgagaggctgtgtgagtgttcctctaccaccagggatggtgcacagaacccccaccttggtctcctgatcagtggtgcacatacagggacacacataaaggacaggctgccttccatggctgaagaatgaatgcaaagctgagtgacagatgaggctctgccccaacagccccgggctctcgtctaaccgcctgggctagctggctctgtttctgaactgccagttatccaacacaagggatgctgaagagcataacagcaaaatagtttggtgtcccatttatctagatgtcagatgcatcatggctttaactctctagaaaatggctacaaaccctaactaggtgaaaaagcctgctcagcaacccaaacagctatgagacagctgctgcattaaagctgatgacttcacgcagctcattctgtcaagtaagcgttatcattatttaaatgacagagtggtatgaggtacgaccaaaagaaaaaaaaaaaaaaagaaatgaggttgaatagaaagtgactgctggggctgggacatgctattttagctcagaattagggaaggctttcctaaggaagtgacatttgtgtcagccctaaattggcctagactggccgaagattccagctggatggtgctcacgaaagaggatcaaggctggagacacaaatctgagagccacgagcatgcagatatgttttagagccgtgagtggataaaattgcctgtggagggcaatgcagctactgagggcaggaaaccagacttaaaggctggctctggaattctgagcagcaaccagcagctcagtggactccagaattggtttggactcagagcttttgagaatggcttgtatcctggaagcagtaatgtgtaagaactaaagatggtctctaagagcaataatactcggggcacaggcctgctagcaggtagaaatccctctcactgagggttcatctccctcaagaatctcacctcccccactgcctggccctcatccatgtgtggacaggcctcaccctccctgcaggccagcctgtttctgcagtggctgcactacattcaagaagagccttgtgccttcaggtggcattcccgagcacctttaacaccatgcggcaagccctgtcctggcccaggttgcctcaccttgggaggtgatggaatgtcacagccctccctgtgttaccccccagggaagcaagcacccggccccttggaaaggtggagagggcccatgtttcaggggtgtccctgaacttgctccagggtgaggcccacacacccttggctgcagcaggatgtctccctagcacctctggcagtgggcaggccaaggcttctgtaagcactgggcatgtctggaggctcagcagggaggagctggagggctacctacaccagagtcctcggctttctgccattgctgggcctgagcatccttctctgggaactgccaggcatcctggttatatggatgcttctgtggctcatttaccttcaaagttggagccctaggagcattcactacagccaaacccagacacagagaagcaacagtaaggggctggcttcactctacccaccacaaaccatgaccttctgcaggggctgcttactttcaggactttcttaatgccgttgatggtggaggtcagcagggagtgcaccttgagatcgtcgttggtgtagtccgcgtgccggatgcacatgtagaggatgtaggcggggagacagggcactgtgcccgacagcatctggggcttcaagtctaagggcaacgagagcagcaaatggcaagttagatctatgggggacaatggaggctgtcagaatcctcatctgaatagacgtgttttcaatatttccccatagctcatctaggaatagatgtctcaaagaggattgggagagaagccacccagggtacccaaactcccgagcatgcctaccagtagtttcagacactgtggttaaaaacacaaacaaacaaaaccacattcctaattgtctgcactataaccctgaaacaggcttctaatgcctcagcctaacaatatggaggaaaagtgcctgcaagttacacagatgcctcagtccgcagccaacaggggcccatggcaagtggaaggctgaggacagggcctagctcccacatgggggcaggaactcctgattcgtgggcaccaccacttccagaaggcaagggctggctccagaattagacaaattgtatgtgcccaaagacagggccagcctgctgagggctagggaggttggaacaatctctggcccatcagttcaggaacaaattacccagccgtgcttgcccagcttcacagccaaatagatcaggcaggccccccttccccaccccggtgctgctgcttggcatgcatctctccagcggctctcttacttcccccaactgctctcctctgtatcccacactcctgtccctgcctgggcaagggctgctctggctggactggaagggccttgtgagtctccccattaactgcagactcagccctttggccctttcttgcaaaaggccctggagggacaggaagcagctgtcagaccattttctattccagaccatgccagctgagccagacttaaggcaacaggtggtggtagaaggccagagaactagggggaaaggcctggtgcaaaggcaagatgacaggtgagaatggggcaggagcacaaggccccaggggtctcaccatagctctgcactgtatctccagcccttgttctttacactcataccctcccaaacgaggcctcatgagccacctgtaggctcagaatggcaatgaagggaggccacctccctcccacctgcaggtgggcagtatccttgcaaaccttctaccaggctggtcctgggctgggctctgctgccagcagctccagttggtacttgggttacattgtccctgctccaacgcatccttctagttaaatgataactgtaggccataatactcttgagtacatggttgacatttggccattttataggtccagcagatggctgtggattggccattggctctagttagaatgccagtcatttatccaggaaaatgtattttgtaggcccagacttccaatccataacttcttacttcaaacctgatccatgtgcagattgcaaacaacttgtcctgtcttggaatgttctattgtgattaaataaagcttgtttgggtgccccagctaaatgttagcatcttggggaagagacgatgacactagttttatttctcctccacagcaactggccagtgccaggtacctaagaggtaggtggtcggcagtcaagttttggcatttgtttggatggggtcttttggagggaagatgactgcaggattttcctaggtagctcagcaggagatgacctttcctggggccacctgagcaagggtcatctcatgctgatggcagggttttctctgtaaaaaccctggcaaatggcaggagggagccacctgtctgacacaagcagccttatttattgaaagtttcattcaccagagatgaaaggtttgttcctaattgcatttgaacaagatgcagtctgtttaaggaagtttaagataaacttacaccacatttaattaattgctggacaactgtaggggagattaagctttttaaaagagcaaaatacatctaagaagcaggctactaaaaacacacaaaccaaacagctggagcaaatctgtttaaggcagatgtcacaatctgttcttcctgggtccctcggccctaggcacagtgctcagcagagtcggacttcagtcttacataagtttctctaaaataatgcttgccttgcctcttatttgaacttcaaatattcctgcaaaagctaccactcctttgaaagcctcacatttgagaagggttttgcagttttaacacagcatttcgcctttgacacacttcacatcatggggcaggcaggtcagtgtcatcatcccatttcactaaggtgccataaagaagggagctgctggctcagggtccagaggatcagaccaccaaagatttctcctctttcccacaggactctctcctctaagactcttcctggctctgcagggggatgctggactgggttggtacagagcagggaggtggcctgttgcagtggcctgtggcagatggggcacaagactggaggggagggagctggtacgactggcaaagcagc

SEQ ID NO: 2488 - DNA, 3992 bp, Homo sapiens
gtggctcctctaggtgagcagccctcagtgcgcatctccctgaagtccacattgatccggcagagctgtggggttcacagctcacactgaggcattcagggcctaaaccccactttactcttttgtacaatgaatgggaaatcagtgatctaaatgagtttaaatcttattagggattcagactgcccttcagactctgtctctattcctcccagagctgggttcaacatgaattcaaatagaaatatgagacaatgaattatggtagtgacaaagaccttccttcgaattccggatttttctagcagcccctttctttctgcttcccacctgccttcaactctttctcctaaaaaagttcagttggggtgaacgtttgatgacttagaacatcattattttaacgtgatcccaaagcggttttcattatatgcaaagctgcatatttattcacattttaaaaaatgttctaaattggtttcttatgtccaaaagaaggggagctagttataagaaaagagaactgagtaacataagaaagtgctaatcatttcaaattaaagtgggaaacatgcaaagcagaaagaatgaatttcataaactcaacaaattattaacataaataattccaaactcttgtatctatataacatcagtgatctgtgaggtgaaatgagattctgaagaaaaagtaaataataaggccatttttctaagccaaaaaagtttttgtcattagttgtggaatttcaccaattaattttttttcaaataaaactttcttaaacttttactgcctactattgcttgtaggttagtaaaccctagcagaaaacaaaatcattaaggaaatggaaaacaaacattaatgggaaatttatgtaatcttaattcttaacgtgtcttatgagttaatttttaaaatgtgaaggtttattcttggtgtttggtaattaagtttattaatctctcacaaatatgaggaattttattccctaaaggaacgtgaggaacacgagtagttcaagaaaatgctgaagatgcgcttggctgggaagctaggataggctgacgaagtcagacttagtgtgggaacctggtaagcagtggatcgatgttagctgttttcacttattgcactagtataatcagtttgatggtacatacttcagccccagctgttacttaagacctggtttcacattttatgttctttttctgtgcaggctgggaaagggtttcttctgtccataaaagctactccaatggctgtgggagacttaattccaattccaggtgatacagccgtcagtctcccactagctgtaggatggtgtgctgcagttcacaggtgtggatgctcaagtgggctttcaaagatgtcatgagagggaggggtaatgtattaggcacattttccaaatataggcatttcattgtacaagaccccaaatgtgagagggtgtttgtttcagtgttttatagagttcctaatatgccatcatatatacattcagttgttttcaaaatacagtttagtatttggctactcacaaagtaataaaacatttaaatcacttaaccatacaattcttgataaccaaaaggcttttctttctattcagtagtttaacattcagctttcttttttagggcaaaggagatagaagtggatgaaatgacagagtatttttttaattgaactctgattaatgccaaaagtgttcaatcactatgtgtggggaagtttcctggtacaaaggaaaaaaaaacaggttgttcatacacttggctgtgttagtaagtggtaaacagaattaaacttttcttatgtgaactcacacatatgtgcttcataatatgtcactcctatttaacatctctttcacacacacagtcatcccccccacacatacccttttgctagtcttcttccattttgcttattaacccaaagaaagaaaaaaatatggaagccttcttgcataggttgcgttaatcagatgaattattgaagccactctgtctaaatattattttcccttatttttccttcattagtttcccattctgttgtatttatttaatttttatttcattttccagacctaagtcaatgttagtctaccactgtacgtctggtaacctcaatccctgcaaccggagcaaaatgtgattccaggtcttggcaacctctgaaattccaactccatttgcgagagctttgaggaggccatatgctgatttcaccacaagcaacttcacaacccagtactggaatgccatcagccagcaggcccctgccattatctgtgacttctatctgtggctcattggaaggaaacccaggtgagaagctgagtcaatggccttgagaatgtcactgcatatgggagattgaggccccaaagtctttagggcttccttcagccaaagattaaaggagacagctgaatctgacccatatatacagattgaacacacctactctgaaaatccaaaatctgaaattctccaaaatccaaaaagttttgagtgctgacatgatgccacaagtggaaaattccacacatcttacctcatgtgatgggtcacagtcaaaacacattcaaaactttgtttcatgcataaaattatttaaaatattgtataagattaccttcaggttatgtgtatgtggctaagtgtgtatgaaatgtaagtgaattttgtgtttagacatgggtcccattcccaagatacctcattgcattgaagcaaatattccaaaatctgaaaacagttgaaacccaacacacttctgacccaagcatttcagataaaggatactcaatctgtgtaagttttgaacaaacaaagcagtcatagtgagaagccacagaagcctcctacattaaaaatactccagcataataaaggaaggtaaatgttaaagcgcctgcttgatgaattcagcaagtgatcattcacacaaaaagaaaaccaactgagacgctgtcactagggtttttcaaataggtagagaatcttaaatatccagtaatgatgacaacctcacttactgggagcttactcgtggggctaaggaggatgcgtgatgatcccatttttattgtcacagctaccgaaggaagataccctcatcaacccaattttacaaatggagaaatagaagctcagggaagaatctgaagtagtctcaaaggaagtgacaggaaggatgtggagaaagctgagtgtcaaagtcagtattcaagaccggatttactgctacttagagatgaatgaagaaatcagagggaacgcagtgtgctgatgctaaagcggctgtcaccacccagctgtgtgacataggacatcttctttctctgtctcacttgactaatatgttgtgtcaggggagacatgattgtaattgcctaaagcaattcttgtgatcaagaatcagaagcatgaacagtattgccctctgtgttagcccctttataagggaggaagtcatcttcagcatgctgaattgtcatctttcttagcagtgcaaatgactaaaacttagccaatgtagagtttgtccaaatttggagctcataactcagttcttgagcaaagtgaaaagaaaacattgtgattatggggaaaatatttgtacgggacttatcaaataaagataggaaaagaagaaaactcaaatattataggcagaaatgctaaaggttttaaaatatgtcaggattggaagaaggcatggataaagaacaaagttcagttaggaaagagaaacacagaaggaagagacacaataaaagtcattatgtattctgtgagaagtcagacagtaagatttgtgggaaatgggttggtttgttgtatggtatgtattttagcaataatctttatggcagagaaagctaaaatcctttagcttgcgtgaatgatcacttgctgaattcctcaaggtaggcatgatgaaggagggtttagaggagacacag

SEQ ID NO: 2489 - DNA, 1617 bp, Homo sapiens
gacccagtctcaaaaaaaaaaaaaagtgtgtgtgtgtgtatatatatgtatatatatatacacacacacacactttccaataccagtcggcattacccgccctttggtttcttttgctttggatttcagcccccatatcatttctggtaacagagcacagcaatagaatttctgggaagcagaccttgtgaatcgtgcctgtgtcttaattcacaaagggtaagtgaatgccgttgaaaggtgtttcatacacttaccccagaaatgagagcctgtctcatgcaggagtcgggaggcagcgatgtcagggaactgggactatgtctttatgactgtgatggtggtaaccaagtggggtggtcccctctggggagctgagtaagaacgcaaaggtttgggtcagtgattaggaagactataatatgactttgtgcatgcccgggagggctgccttgtagagaggatgtgagcagcttagtcgctcatctggccctgtgattcaggcttatggagcgttaagaataacagctgtcaaatggcctagacatggttaatgcaatttgttgctagtggaaatcctgaattgcttcctttctgtgatcactgctacttcttaagatgcttttgatgaatgtcatctgccttacaagttgacacctgataacttctccctgatgggtttccgaactggctgacttaaccaaaaagccagctcttgccatctatcttgcattaaaaggaattcctgaggctcctaaggggtcagctgccccactcctgacttttttatttttaatggtctataccttctgcaacatttttgtttatggccatttgaatagttggactttgactcctcacttgtgaataataggaatatattttgcagaatctaacataatacccttaaaattcatactggacaaccatcagtgtgatgtatagtatctggtgtaaacaaattttattcagcatattaaattattctgtgttttgcttttccttgatatgtaggaggtgcaccagtaccagtttttctcttgtggtggcttaaaacgctgattgccatttgcattgtctactgaaaagctgtggcagcgagtggtattattgaccatgtgttctcatgtctttttgcagatttaaaggttttattgtagtgtccatttaatatctgcatgtgtgtttaatctctgaataccatgtaattaaactgattaacttgtgatggtgatggtgattagcacacactaaaaacccaatgaagcaattgtctccctcttcttaactggaaatcacacttgtgaggtatggtatccattatcaacagtggattcatgattgacttcatattttgtgtatctggttataaattttgtatagcatttaatttggcacttaatataaatccatttgatttgaatagtgtgtgtgtgtacatggtgtgtgtgtgtgtgtgcactttagtttcgtgagccttgggaaactgattctacaaatatcttatatagagataaatgtatcaggcatttttttgcaaagcgatatatacattcctcttatttattaaatcactggctttggtgttatgtagagatatttgtagatctcagaaca

SEQ ID NO: 2490 - DNA, 775 bp, Homo sapiens
gacaaacttccttaaaaggattggcttgtgttgttattattaagtctaacaagtccaaaagctggagtgtgaggcaggaggctggaaacccaggaaagctgatggtgcaaggtccagtccaaaggtatctgttggaggattctcttgttctgggaagaggacggtctttttttctcttcagaccttcacctgactggatcaagcccactaacatcgaggaggacagtctgcattactcagagttcactgattgatttaaatgtcaatctcatataaaacaccctcacagaaacacctagaataatgtttgaccttataattggaaaatcagagcaaaagttaaatctctaaaaaaaaaaaaaaaaaaagtatgacccagtagctaggcacctgtggccccgccaagttgacacataaaattaactgtcacagtatcatcttagaagtgaaagaagcccctttatcctgcagtgcccctctaccaccacctactgacaaagaacatggtgctatctggcatgggagaaatgttcagtttgctatggcttgtatgtgtcccctcaaattcaagtgttgccaatgtgacagcatcaagaggtggggtctttaagagatcactaggccatgaaggattctcttaggactgggatgaaggcccataataaaagaggtttcagggagcatcctgctagcttgccttctgtatgtgagaacacagcaagaaagccctagtcaacaagtgccagctccttgatcttagacttcccatcctcca

SEQ ID NO: 2491 - DNA, 420 bp, Homo sapiens
atgttgaagcgaggacgtggtgggtcctctggtgtgaaattccagatttccttgggtcttctggtaggagtgtgatcagttgtgctgacaacacaggagccaaaaacctgtatgtcatctccgtgaaaggggatcaagggatggctgaacagacttcccactgctggtgtgggtgacacggtgatggccacagtcaagaaaggcaaaccagagctcagaaaaaaggtacatccagcagtggttattcgacaacgaaagtcataccgcagaaaagatggcgtgtttctttattttgaagataatgcaggggtcacagtgaacaataaaggcgagatgaaaggttctgccattacaggaccagtagcaaaggagtgtgcagacttgtggccctggattgcgtccagtgctggcagcattgca

SEQ ID NO: 2492 - DNA, 548 bp, Homo sapiens
gcagtctgcgcagggactggcgggactgcgcggcggcgactacagacgtgtcgggggtccggggcctgtcgcggttgccaagcgctcggcgcctggcgctggcgctggccaaggcgtggccaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggccggctttgcgagctgcatttggcctttccgaggcagagtttgatacagcatgtgttaccaagctgtttcctaccaggtcacacactgttgcagcgcaggtagaaaattatggcatgccgtttagcagaactgaagatgggaagatttatcagcgtgcatttggcggacacagcctcaagtttggaaagggcgggcaggcccatgggtgctgctgtgtggctgatcggaccggccactcaatattgcacaccttatacgggaggtctctgcgatatgatacc

SEQ ID NO: 2493 - DNA, 1819 bp, Homo sapiens
agttgttactgtatactttgtgtatttatttttttggggggtgggggtgatgcagtctcactctgttgcccaggctagagtgctgtggtacgatcttggcttaccgcaacctctgccttccggattcaagtgattctcctgcctcagcctcccaagtaactgggattacagatgcgcaccaccacacccagctaatttctgtattttctttagagatcggggggagtctcaccatgttggccaggctggtctcgaactcctgacctcaggtgatccacccactttggcctcccaaagtgctgggattacaggtgtgagccaccacacccagccaaaagttattactgtgttttactccttaaaacaccacatccccatgtagcaaaattaatcccaaacacattagctcttcagaaaggatacaatttattcataaaaagtagaataaatgttagtttaaaaaaaaacgagtaggaagtaaatattttattctagtatatgtcctaagactatagattaccaacaccaacaccaaaatgtccttacctttaattccatctcaagtaaacagcatctccattttaccagctgcctaagccaaaaacttggggtgatctttgattcttctctttttctcacacttcacatccagtccatcagtaaatcttgtaggctctacttaagtacatattcagaatctgacttcttcccaccacccccactgctaccactctagtccaaccagtagcatctatccctgaactattctcattgtcttggaattactcatcttacctcagcttttgcccctctacacaggagctagtgattattctaaaatataagtctcattatgttattctctactcaaaacaatcttacttcctatctctgtcagaatgaaattcactctttaacataacttacaacaccctatttattccagaagcgctggaattatctggacagatgttgatgagattctttcagtgaaagaaagtagagaggagttaaactagcaaatcatgaatgtccttttctatggcagattctatgaatctcaaactaagacaacatgtggtaacaaactgaacgcaggagtttacaagacttgcaaaatgtaaaacaatgtgacttgtcacactaattcctgtaactataattctaagcagcaaaactgccaaagcaggtaagagcataggctctgacagcagacaacagcattgtatccactctgccatttattagttctggacacttgggtcatatattttaacctcaaatgtgcctgtgcctcagtttactctactgtaaaatgggcataagtatctgtcctataaggatgttgtggctttgcagtttatgggatctattaggaagatgctcccagaggggtcaaatgttcccagcagtggcatggcagagcaccaatgatggcagatgctcagatatactggctgggctcggtggctcacgcctgtaatcccagcactttgggaggccaaggcgggcagatcatgaggtcaggagttcgagaccagcctggccaacatagtgaaaccccgtctctactaaaaatacaaaaaattagccaggcttggtggcgggcgcctgtaatcctagctactcgagaggctgaggcaggagaatcgcttgaaccagagaggcagaggttgcagcgagcggagatcgcaccactgcacaccaccccgggtgacagagcgagactccatctcaaaaaaaaaaaaaaaaaaccataacccaagacattaatgttattaattaaaacactgccagtatctaaaggcatcttaattgg

SEQ ID NO: 2494 - DNA, 5325 bp, Homo sapiens
agagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgta

SEQ ID NO: 2495 - DNA, 7582 bp, Homo sapiens
gccattttgtgccgccgatcgcttccctttcccctcccgccgccgccgccgctgcgaacagcccgctgccaagtcctccctccgcctccgcagccccccgccccggcacgccccggccgcggctgggccccgaacgggaaagcctgaaggaaccgtccccaccctcccggggcacggtgatactgagatgcggcgtaggggacggaggagaggagaggagcgcccggccggcccggggccggagcactgacctgcggcagccggaggagaatgccggcggcctggatgagctcgcagcccaggatgcgtaagtccgtctcactgggcaggtcgagcccatcctgcatggatggggtgggcgagagcctctcctccggaatcagagagtggtcgatggtaagtgaaacttccgagtacaggcgatcgccgatcaggatccctcccgtcgtggtcgtcgtcgtggtcgtcgtcccggagctggagccgcccgcgcttggggcggccgatgaggcggctgcggcagcagtagctgtcgaatgaggcccggacgccatagtcttagcgagccgcacgcaagcccaacgcagccggaacccgaaacaagactaaccagcgttctcggcgcgacggatattcccgtgaccgccgggttctgggccgcttcacgccgcgtgcgcttccgccctgacgtcaccacgccgggcagccgcgcgccaactagtccctccaggccgcgcctccgccctcggcatctgggcctgcgaggggagtgttgggtgctgcgacagaccttgggatcctcagaggctgaggaggccttctctagccaaggccggtcgaaaccaccttgtttgtgatagccacacgaataacggagctttacaagatcccttatacccaaaatagaggtggcagcattggctagcatctctgcgccccttcgccctgcattccggcctcttcctttagcctcggcgcggcttgcgttccgcgtgtaccaagggaagtggcggccgacctgagcgcgctttggcgggtggaagtggtgactttgttgtcctgtgtggacgaatgtgtaatataaagtgaccctcaaggaatctggagagggctgctttacagtatttgaagaacacagggctgtggaccctatcggttcccaaatgaaagctccccggggagcgtgtttttgccagtatggggaagtagggcggaggcataggaatgaccgcgagagtggctgctttcatagctccgcttgcgaaactcctgcccggcctttgacaccgccacggctttcagtaatctggaaaatccctagtttccaaaaatagtcttagggcgaggacttgacagaggtaatttgattatgcctgggagtctctattcatacatggttacctaccgcgggtagggtgaggtcaacctcgtgttttttgttttttttcctgtgatattagctagcaatttccagcgtttcctgaaccttgaagtaaaaacaatgatactgatctaaactactagaatctaggttggaaggaaaggaatgcatcacgttttactcttgacgctcagaaagcgataccccaaagacagaggctttagaagctgcctcataatgcaggtcccccaaccttgacttgttgctcccacttttcccaagtgcagggaggtactctctgaaatttcctttcctgactagagaagcctctttgtagaagaatcaatcgcattcctcccctcgctgaaatctcgtatcctatttcaaaaagactcagaaatgcagccattcctggagggactttttcacaagattactcaaaagaaaattatttactaatttctgtccattcattgttcctaataatcatttgctgctcctcaaaataaatgtctacatttctcatctaccctttcccctatgaaaaaaagatataaaatcttctgtactccattaagctactgggtaatcatcctcctgcttttaccccggtgttatgtatcccttttctcctgttaatcgcctgttatcagttgattttttttttctttttttttagatagagtctcactctgtcgcccaagctgaagtgcagtggcgcgatctcggctcactgcagcctccgcctccggggttcaagcgattctcccacctcagcctccccagtagctgggattacaggcacacaccaccacgtccagctaatttttgtatttttgtagagacggggttttgccatgttggctaggctggtcttgaactcctgacctcaggtgatccgcccgcctcggcctcccaaaatgctgggattacaggcatccaaagcgctggaattacaggcatgagccaccgcacccggccttatcagttgattaagtgaaccttcagtgggcaaagttgttttaaaatgtactgatacttgagccttgcctgcagaggttgatgtcactgatttaaggtgggcccagccagtggttcagttttgcctgtcttcgagtgattggaatgtacagccaagagagtgtaattatggtgctggcagaagtattaacctatctggatgtcactgtcttcactttctgactaggctgcttccagggaatctttccacctcaatatttatgagatatctataattttataacaaacttttaaaggagcctcggtttccttaaacacaattgatgacaccagttttctggttttcttccatttttgtttatagagccagggtctcactgtgttgcccaggctggccttgaactcctgaactcaagggatcttcccacctcagccacctgagtagctgggactataagtggcacaccactgtgcctggtcagttttctggttttgataatctatggttgtgtgagatattatcattggggaaagttggaggaatacataggagtagtctatctttgcaacttccatgtcttatttccaaataaaaagtaaaaaccctcattgattatgtacttcattaaaacactggacttcaatgaaatcatcacctatatttgtaatgacttgagagtaatataatttaactttttttttgacttctgaactttttattggcctcctgctccccaaagggtaccctgcttctgatggcttaatgtctcagaacttgggtgtcgttggtctcagataccactttgccatccactatccagcagatagtggtcttttggatggtttgcatggagttgctgctgtccagggcatcaccaagattgaagtccttgccatcttccagcaggcggcggtaggtggcgatctcagcctctagcttgaccctgatgttcagcagggcctcgtactcctgggcctggcactgtccctctgcccaggcctgtgccagctctgactccaggtgcagcaggatcccgttgagctgctccatctgcagggcgtggcaggcctccacctccctcaggctgttctccaagctggccttcagatttctcatggagtccaggttgatctccaaggactggactgtatgtctcagctccgtgagcgttatagcagctccaacctcgacggactgcgtggtgacccctgtgttgctctcctcaatctgttaagaccagtacttgtccagcacctattggttcttcatgccagctcatcatattgggcccggatgtctgccattatcttggtgaggtcctgagatttggggacatctacctccacagtcaacccagagctggcagtctgggcttgtaggccttttacttcctcttcgtggttcttcttcatgaagagcagctcctccttgagagcctcaatctatctccagctgcagccgagtgacattagtgtcatggattttgttcccatggatgttgttcttcagaggctggcacgtggccagctctgtctcatacttgactctaaagtcatcagcagcaagatgggcattgtcagtctgcagaacgcattgtccacaatatttgtgaagatctgagccctcaggtcctcaatggtcttgaaataatggctccagtctctgacctggggtccctgcttctccaggtgctcccggattttgctctctagcctccggttctcggtctccaggctcctcactctgtccagttttcctgactctgattctgcgtgggacaaccagtgaaaattgcaggtgaagagaagaaatgcgtatttattcctccactgggaaaaaaaataccatccaaagctacatgacttgagagacaaggtctcactatgttgcccaggctggcctcgaactcccgggcttcagcagtcctcccgcctcaccctccgatgtagctaggactacaggaccgcgacccggcgctgcctaagaactgtttttaaacgtgaaagccacggctatcatttgctttttgctctgctcttcatcttctggataaacctcgtaacacactgcttgttttgggtggtagtctgctgcctacgccccgtcagacaagtggcctgagtcccccgcaacccctgcaggtccggccgccggcgccaagcctcaaggcatccaagccaggaacgatcgcggtcagctctgccacggaacatgtgcaagacccggcagcaggttccgggggaggcgaattgatttcacaacggtcgagaaggaggaccccgcccacttcgtcatttctcggaagcccagggactcgccggaagagcggctcaaaagccggaaaactggcaaatccgagtctcccggcgcatgcgcggcgcaatcggcttcgcgtggttgcagtagagaggatccctccgccagccactgcatccggcggccggatctaacttacccgctagcgttttacccttgcgcggccgtggcgtagggcggtcttttcccttggtcctccgcggcgccgcctcttgtgacgtaagccgcagaatcctctgtcttagttcggctctattgccgcgagcttgactcttcctgggtctgaggaaaagtaaaagtaattttgtcatttcctgaaacttcaagttaaacctttaagctgttcatttcctaaaagggtgaaaacgcgggcacccctcgagctagttcatcgccttttaacctgtgagttctgttaaaaggaagtaactgcaaaatgtcttcgctgttaggtttctttggaagttttgggttgtgttcatgcgttctctcggcgtgtgaactgggagaaagtggagtgccagccatatgaaatgacaactgtatatggaggctgggaagtataatgcgcattctggcttgatgaaattaatgaaattttaattaagtttaattttcatttgaattacccaggaatagcatcttgaaaggcggggcataaaaagcagttaaagagcttcgagaaacggttactcgttttgtaaactaaagaccaaatgaaaatccagctgcactagaaaagaaagaaacttataagggccgaaggttttgtctgcaatttacagctaattagtctcaaagatttctgtgatttgcccaagagaggtggagttggggccactgctttacccaggacaccgccgcggcccgcttgaatactgccgccgttaggacccgccgtacctggccgtccagggcctcttttcttgtcttccactctcacttgtcttttctcccctttccatgtttttggttcctttcctgagtttcccttgtctccactcccctgcccctttgcttcctctatctctttaacttctgttttcttgatggtggagccaactttagtttcccttaaaaggccataaaaggaaatagaataattttaaaaatgtcttttcataaggcttgttttcttgtcttaagcctgttttttggtggggggtgaaaaagttcatatgcagatagacataaacttcttttggtaaaagctgccctctattttcttccatagctgtcctgtgaaagtaggagtgtgtgtgaatggtgaagcaaagagagggagacatggggtcaggagaagagggagcacagcgtgtgtaaggagttaattagaaccagagggcctgggtctgtggctcatgcctgtaattccagcactttgggaggctgaggcggaggaccctttgcaccactgcactccagcctgagcaacagagtgagacccagtctcagaacaaaaaaacagaaacaggagaaaaaccatccatataagcagagaggtacttaaaatgttgcaaaactaaattccaaataacgtctgtggattctacaaaatctaggaaatacacatttccaataaatctttgtacattcatctgtaatgcatttccttaggtgatttgagtcctttaggagtaaatctgtatctttagctgtcccagaagtaatcacaggcgttcattgtctattcaatgacaaagtattgtgaactattctatgaaataataaaatatcagtgttttcagagtacatggccttttcagtagccttttcagtgtggtggcacgtgttcccagttctgccagtggatattgttatctttgatctacaactgggaagctaaaacccagaaagttacttgtctaagactatacacctccaagaaggcagaactgtggctgctatttccaactttctagtctctgaacatgtaataaagaactgatttccaatttacaatgaataatagaatttacaatgaataatataatttactataatataacaaccgaccaaagtgtgctgttttattaccaatttctctctctctctctctctctctttcttttgtgacagagtctcgctctgttgcccaagctggggtgcagtggtgaggtctcggctgactgcaacgtccgcctcccaggttcaagcgattctaactgcgtcagactccccagtagctgtgactacaggcaggcgccactacacctggctaatttttgtatttttagtagagatgggggctcaccatgttggtcaggctggtcccaaattccttgcctcaagtgatttgcccgcctcggcctcccaaagtgttgggattacaggtgtgagccactgtgcccaccccaatttgcttctttggtgtttgtaattctgcttggtcaaccgtaacttgcagaaattgattggaacatatattttgataaagtatttgaaggtattcctgaagtttgatttatgtttcagctgcctatactgaaagaaaataaactgctgtgtattccataatttaaaaataattgttcactttagtgacattttgtagttggatagtggagacaaaagatgatactctctgtgatcttcaatctaaacatttatgttaggacaaattattcccatatctgtataatgctatatttcttccctgacctctacaaatcacagaagcaccgttattcgatcttgttctctttttcaaaaaattctaccttccaaggtggtggttctttaagtttataagtgaaccataaagtagttggaaacctggatcccaggatggtagaaacatgaagcttgtttattccaaggacagttttatatatgtataggactttattatccttactatatacagcattttaatggggagggggaaccaggagcattgttgg

SEQ ID NO: 2496 - DNA, 543 bp, Homo sapiens
tctgaaataagcatttcattaaaagcactttcagcagtaactcttgggcagtgacagaggggcttagttttcctggttgtagctgggcgcctaggcttgatgctagatttagggtcttcacgctgcttggattttgaatataaacctaacagtagcttagttggaaatgcaagttgatctagagaaccccttgtgctggtctactttgagtcacacttggggcctgggattgttgtcctgcagcagggtgtgtgttccctcccttcccaacagcctgaagtgttgcccacctcccaggcacccacctccaactcacttctgaagcaaaatttactgatagtcacactaaggtgaatcgatagaatgagttcaaggcaggtttgcatccagccctgagacatgtaggaaacacctttcagacccaggctctgaagattcccagaagccacaaggattgaagggaaaaggtgatcctggtaactgttccaggattgctccaggtttgagatggtattgctaaatttaaaattaaacaagaaaccc

SEQ ID NO: 2497 - DNA, 4465 bp, Homo sapiens
atccgggctctactggtgaaaataactgcagacggctggtaaaaagttggaatagctttcgttaagcgtcggatgtgtagagtgctgagttaggggctggactagagacgttgggacatctcccgggaacagcagcctggaggggaaaaatctcctgacctaagtggtcattcggccttggcgcttggacacgggagtgcggcgacagccatatgtccatccatcttggcacttttccgtcctctgcctttgaagatgggtgtgcccggcaggctgtgaaagataaacattagagggttgtttagaagacttttttgacctgagcccatgaggtgcataccctttgtttggcggagaaaccagtggcttctgaagatcagggacgggccacaagtgcgaggcattgcagacatttcgaacccagacttccagcctggagacatccacacgcttccagtttcttgcactggtacttcattctgtcattatgattgccaccactcgtaactgagagttgcgtgccctcaagttttgagtgtctgcagggtacctttgagctttcttagctgtgtagtgagtggggggaatggagaaaatgaaggacagatgactgatttgtagtttttcatttggacactgtccttgccgcacaagcacagcagcttgaacctctttgaacaagagtcgagagttcttttacagctaattacccactagttaaacttgatcatactgtgctgttttcttcctctccattgtcaatgtaatacggctcctgacaaaagttaaattcgctgggcgtggtggctcacccctgtactcccagcactttgggggctgaggcgggtggatcacctgaagtcaggaattcaagaccagcctggccaacatggtgaaaccccgtctctactaaaaatacaaaagttagctgcgtgtggtggcgggcgcctgtaatcccagctactcaggaggctgaggcaggagaatcgtttgaacccgggggggcggaggttgcagtgagctgagatcgcgccactgcacttcagcctgggtgacagagtgaaactccgtctcaaaaaaaaaaaaaaaagccgggcgctgtggctcacacctataatcccagcactttgggaagccgaggggggaggatctcgaggtcaggagttggagaccagcctgaccaacatggagaaacctcgtctctactaaaaatacaaaattagccaggcgtggtggtgggcacctgtaatcccagctactggggaggccgaggcaggagaatcctttgatcccgggaagcagaggttgcagtgagccgagatcacaccagagatgcacgccagcctgggcaacagagcaagattccttctcgaaaaacaaacaaacaaacaaaaaaacagttcaaaagacacagaatggactggtggcgatggcccacgcctgtaatcccagcactttgggaagccaaagcggaaggatcgcttgaagtcaggagaacagcctgggcagcatagtgagacctcgtttctacttaaaacaaaaacaaacaaacaaacaaaaaaacaacaggtgtggtgacttagacctgtggtcccagctactcaggaggctgagatgggaggatcacttgggccccagccgttgaggactgcagtgacctatgatcgcaccactgctctccatcctgggtgacagagtgagaccctgtctcaaaaaaaaaaaaaagcacaggatgtaaaatcaggcattaggtttgctattcctacatgtaaacttatggaacattttcttgtttcctttcattttgttttacaaaaaggatgatcccattgttaactttttctctttaccacttagtggatgccttccactgtctcaccacaatcttatccttttaagcagttgcctatcaggtgtctccactgctcacatttgggacaaaaataatgcaatgtgcagtcgctcacgcctgtaatcccaccactttgggaggccaaagtgagcagatcacctgaggtcagtagtttgagaccagcctggccaacatggtaaaaccccatctctactaaaaatacaaaaaagactgtctcaaaatttttttttataaaaataataatgcaatggttatccaaccgtgagaattcggaggagaccttgttaaaacacatttctgggtgtctctaggattgttttgcatttgtaacaagttcccaggtaaagttgctcttgcttattgaggaggacactttgagaaccaccaccataaagggtcataaaacgcaattaaaaaaaaaattcacagtaaaacaaaaaagggtgggtgtaaggccctgcatggtggctgatgcctataatcctagcactttgggaaggcgaggcaggcagatcacttgaggccaggagtttgaggccagcatggccaacatcgcgaaaccccatctctactaaaaatacaaaaattaatcaggcacaggggcacacgcttgtaatcccagctactcgggaggctgagacaggaaaatcgcttgaaccagggaggctgaggttgcagtgagccaagatagcaccactgcattccagcctgggtgacagagtgagaccctgtctcggggggtggggggaaagggtgggtgtgggtagggagctatccattaaaaagtcaataataaagatagaagagatgatagaattagaaaactaccatcttaccactcccagggagataaatgtcaggaaagtataattaatgagtgctaaaactagagaccagcacttcagaggaatgttatagctagtggttaccaccttaaccagatggtcaaaattggtatcaaaaatggtataacaatctgatgtctgattctaatataatgcatgagttgtacacatcacctatattgccaaatgtgtaacctgaacttaactgtgctgaaaacatgagacaagaaatccagactgaggaacattctacaagacaattcatgtctatgtcctgaaacacagaaaacagggcagttgttctatatagaaaaacaaaccatgattgaatcttggattggaaaaggaaaaaaaataaaagccctaatacatttttggaacaactgaggaaatttgaatatgttctgcatattagatattaagttaccaattttcttagtgtgataggattgtggcagggttttttttttttttttgatttttagagtcatggtctcactcaggttgaaccacaggccaccatgcctggctaatttttgtagagacagtgtcttgcgctgttgcccaggctggtcttaaactcctggcctcaattgatcctcctaccctggcctcccaaaacactgggattacaccgctggtgtggtggctcatgccagtaatcccagcactttgggaggctgaggcaagaggatctgtggagcccaggagttcgagaccagcctggccaagatttaaaacaaaaacaatcatgggattacagatgtgagccactgtgctagcagaaagatgcctttttaacatgccacatcttcagtaacattaaaaatcaccaggcacacttggtttatcaaccaaggaaagcacatacctttccttcttttctttactttccttcctttccttactgttctgaggctttttaataaaatttcactcctgctctgaaacttgcctgggtttcttcttctgccttatgcccctcagtcaaatcctttcttctgaggaggcaagaattgaaaattcttaaaaaaacacccaacatcaagctgacaaaaaataaataaataaaatctcaaaagatattgactggccaggtgcggtgactcacacctttaatcccagcactttaggaggccgcggtgggcagatcacgaggtcaggagttcgagaccagcctgaccaacatggtgaaaccgcatctctactaaaaatacaaaaattagccaggcgtagtggcatgcgcctgtaatcccagctactcaggaggctgaggcgggagaatcacttgaatctgggaggtggaggttgcagtgagccaagattgcgccactgcactccagcctgggtgacagagacaccatctcaaaaaaaaaaaaaaaaaaaaaaaagaaaagaaaagaaaaagaaaaagatattgactggccaggtgcggtggctcatgcctgtaatcccaacagtttgggaggccgaggctggcagatcacttgaggtcaggagttcgagaccagcctggccaacatggtgaaaccccctctctactaaaaatacgaaaatcagctgggcatggtggtgaacacctgtaatcccagctactcgggaggctgaggcaggagaattgcttgaaccagggaggcagaggttgcaatgagtcgaaattgtgccagtgcactacagcctgggcaacagagggagactgtctcaaacaaacaaacaaaagtacactccacagggtggtagcaggcca

SEQ ID NO: 2498 - DNA, 420 bp, Homo sapiens
gctgtttcttggatgctgcacttcacaaatgtactaattgcccccaaaaaagcaaagagtagattttcctgcctagatgcatcacttggcattgactacaccatggaaagcaagagtctgtctatgtgggctggattcctgaactacagcttagaagggaagggcgtagaatatcatcattaactggctcacaaggaatagtcatcttgggcgaacacatgctaatacgtttcacagaatgaggggtgacagcctagaatccaaaatgtgatgtttggaacatttctcgccaaaccttactatgaaagcctgcaaccagtgagaggagaactgcaaagacggcagcagagaaacagcaaacagcacaaaagagataatttaccaagagactttccctcctttcagaggcaaccaagccag

SEQ ID NO: 2499 - DNA, 3692 bp, Homo sapiens
ggggctgtacgagctggtgtggcgggtgctgcacgcgctgctctgtctgcaccgcacgctcacctcctggctccgcgttcggttcggcacctggaactggatctggcggcgctgctgccgagccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagacgatcaagttttaaattgccatttggcagtgaaggtgctgtctccggaagatggaaaagcagatattgtaagagctgctcaggacttttgccagttagtggcccagaagcaaaagagacccacagatttggatgtagatacgttaggcagtttacttagttcaaatggttgtcctgatcctgatttagtattgaagttcggtcctgtggacagcacattaggctttcttccctggcacatcagattgactgagattgtctctttgccttcccacctaaacatcagttatgaggactttttctctgcccttcgtcaatatgcagcctgtgaacagcgtctgggaaagtagtggtcattggttgcgtaatttgatttgaggcttgtggaggaaaggacccaagtgactctgatgtttacaaagcacctatgaaaccctgtacacacctggttcataatcctcataatttatcaacaaacacaaaaaagtgtcttacttgagagtgagtgtgtgtgtgtgggtgtgcacgtgcacacatgtgcacgtttgtatgcatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctccagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttttaaaaatttaaacattggattaggcagtcaaaaaaaccaagcaagcataaaaggtcaataagttgtaatcttgatagtaaaggtggaaaacttattataaatggaaagaaagttttggtttccttttttgtttgatgggcagtatgccatattatacccaaagttcttttaaaaaatatttccatcaaccatttttatttaaaataaacatttgagggaagttaccaaggcagcttttttcctcaaaagtaacctgttcctctttggaatagcacattttaggggcatggttaatacctgagatttttactcagtaaatcctgatggttactgtgtgtaaaatatctttaagtaggattgaaggcctctgtggggaaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgttttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaattttggtccagtgacattactttgcactgcataatccattatacattgtacgactttttttttttgttttaatttattactgagagttttgtgtgaagctacagcatatctaatcagagaatttctgattccttatactgtgattatattatattgaggcatttgtagtgccgctgaagactgaatttatgccttttgtaaacatgataggtataaatgtcttataaacattctggagtatgtatagctttaatgaatgaaatttaatggacctgattaaaatgaagggatttaatcgttgttaaagttaagttagtcaaataaattacctactggaatatagcccaagccagtaaaggtttattatttgcattttcatgcttttattttctccttccattcataagtatatacttgaaagtacatctgtagcctatgatttgagtctattgaagttctaggaagaggcaaactacaaactactaggattctgatttcagatgtagtcattccagaaccttctctttatgagttcacctgctagtacaatctccacaacttgaatggcattggttgttctataattcctgccacaagcatcacaagttgtacatcatcaaggctccctttgcactcccaagaagaactggtaattttaaacaaaagtatgtgtctttatttgtattggaaaatactgtctttaaattgtttcttgttgacactccccacaatggaaaaattaccgaattaaacctgttttatggatggcagcttggagcatagcaagaagttggaggatttgaattccattcccagttctcattgtgttttgtttcttaaaactataataatcggttactgttataaagtttaaaaggtggttttaatgtgaatagcaaattctggtatatcgtgactaacgcttaagaatgcctgtctttgagaggaaggtgttataatattaatgaacagtgccaaatacactgtgcatatctgcaatttaatctttgaatgtatgttactggattagctccctcctcctgtgtgatggtaccatgcatagagtcaatcaaatccttgtgatgttttgtatggactttgacaacatgtaaataatgtgtaaagccagtttttatgattaaggaatcaaatttattgaattttattattgaaagttgaaacttaacatgtatgaacaaaaaccaataaaagaatatactcttttcattgaaaaaaaaa

SEQ ID NO: 2500 - DNA, 3034 bp, Homo sapiens
tccagtcaagggaatgaagaacagaggaatggaggaaggataaggggaaacagctatttggaagcagagaaaacaaattgaggccagatcatggtgggccttaaataccatgaaacaagttttaattaaaaaatttttttttcaggctaaggcttgaaaagacatttgtctaaagatgatatacaaatgaccaacaacatatgaaaggatgctcaatatcactaatcatgagagaaatgcaaatcaaaactacagtgagatatcacatcatactcattagattgactcctatacagaaagtagaaaataacaagtgctggtaaggatgtggagaaattggagcccttgtgcactgttagtaggactgtaaaatagtgcagcagctaggaaaaacaggatggagattctacacacacacaaataaaaactcagcaattcacttctaggtatatatccaaaagaactgaaaacatggtctcaaagagataatcgtacaaccatattcacacagcactattcacaatagccaagaggctgaagcaacccaagtaaatgattaggcaaaatatggtatatacatgtacaggactgttattcagctttaaaaaggaaggaagttctatcacatgctacaacatgggggaatcttgtggacattatgctaaatgaaataagccagtcacaaaaaagcaaatactgtataattccacttatataatgtatccaaagttgtcaaattcatagaaacaaagtagactggtggttagttggaactaggggttggagaaaaaggagagtttaatggacatagagtttcagatctgccagataaagttctgaacatctgcttcataacaatatgaatatagttaacattactgaactgtacacataaaaatgttaaagatggtaaattttatgttatgtgttttttaccaaaataaaaaagaattcagtaacttaagtcctcaaaatatttatgctgctttgtaataaacttctaaggggttgtgtgtgtatatgtgtatgtgcatgtgcatgtgtgtatgtgtgtcaggttgtaaaatatatgtatagaaggtccctgccttatgagagtttgacctacgatttttcaactttgccattgtgtggaagtgatatgcatccagtagaaactgtacttccagtttccaattttgaactttgatcttttcctgggctagagatatgcagtatgatactctcttgcactgctaggcagcatcagtgagcctcagttcccagtcagccactgatcagaagggtaaacaactaatactctacagtgcactatgatgctagatgattttgcccacctgtaggctaatgtaatgcaaccgagcacatttaaggtaggcgagactaaactatgatgtttggcaggttaggtatattaaatgtacttttgattcatgatattttcaacttactatgtgtttatcaaaatgtaaccccctcttaggtcaaggagcatctgtagctgcttggatctacattaacctcatttatctataccctacctatgtgagtcttggaaacttgtctcatataaacaatgagctagcctaaaaaaggggactttgacaattgcttcatcggtctttgtcactctggaaatatcagcatctgcatgttgaaaaaggtctcattatattagctttccataagctgtcacctgattataagacctcttttgcaccttcccaggtgagtcatcagaaaattctttagttttatacatttgtaggtccaatgcattttaattaaatttaatctgagacaaattatgtaactttaaatattattaactttggaatccttgtttataacacaactataattgtttatttttcttttgctttttagaactttcctgctatgtttatctgagttttgtggtaacatacgagacttacctttgaatgtataaaactggctagttttacatgatctgaacttgagaagcggtttcttaggtttcaagacaacatgctaaatacataggaccatctactggcaaaggatgatatagtcctaaggactggttttgttggaacttgtaatagcccaagttaaagatcatgaagattgtgaagcccaaaagtgtattattgagggaatcctgctgccagaatatgcttatcacttaaattgcaacagagtggtcttagatagaaaatacaagagctgagaagatactacaaaacaagtaagtcatttatatggagtcacaacatctaactggcatacatttgtttaatattgatatagtaaaatatttcatgagggctctgacaaggactgtcttgttaatctctgaatccctagcatagcaactggtacatggaagtgtcaacaagtatttactgaatcagtgaatgaataatgacaaccagggcctcaaaacttttgaaaatttgccttatattctccctctcccataggaccacacccataatttaaaataaaaaaaatacaaagtgtaacataagttccctttttagatgaaaagtgcatctatctgtttggttaaccagaaaccttgagtcagtaaaaattatacttaatatttacgttaaaaatagtaataatgaaaaatgacctaaactaattaaaagaaggttatgtggacttgcataggctttataatcaaatattgctcatgtcaaatttcagctctatagtttgggtattgtatgaggttggattaattacttaacctttctctcctcattttcctcttttattaaattagcattttgtttataccctacaaagatttggtgaagtctgtaaatgcaatgatttgtgcctacttggtaagtactaataataaatccagctgttgactttttgtctgactgagggcattcattttcctaattttcaatggtcacaagcatcttcggacagggaccaaattttatttagtaatagaacttagcacagtgcctggcataggtagatacttattaaatgtgttgtattaataaagaaaattaatatttaaata

SEQ ID NO: 2501 - DNA, 8353 bp, Homo sapiens
attactgtaccctcccggcagcctccggcagaacacgcagcagcagcagcagttagcgctgatgcaactatcgttgctgttgccaccgcctccccactgacggggcgtgcacctggggggtacttgcagtttccaggggcaacaagcatctctctaccaccctctcctgcgcccctgagagaggctggtaggtagcatcttcttcgggcctcctctatccactcagaaagtgatgaagcggaggggctccaaacgtttgggctgctcaaaagtggggtttgggatgccggtctcaatcgcacgctgagatgccgttttgccgaaaactaaatgtgtctttaagtgagagagtgtgtatgtttgaaagagagtgcgcgcggttgtggctggtcctctgtaatagaacaagactgaaataacccagcctgggatgaggagaagggaaattgctagcgcagctttgcatttgctcatcaacgattatagttaattgctaattgcacaaaatgatagtttgagggcctgtaattaaaagcttaaccttttcttgtttggaagagaggggccccatacgtttattcctcttgatatactttgtaacattcaattacaagaatcgaggaaagaataaaggaagcaaagacaagactcctagaaagggttggttcttcttttgtgcctgacagtacctgagtctataatttgctttttgtgtacttcagttttcttgcacacttagccctggttgaggtgcattgtctgctgtggtctgttgagcatctaaccagagtgggagggcacatcgagcgatttcactttcttaaataaaaggtttttggtattttgaaaaagttgtttttatcttaattcaaacttggaaggtttcaataatatcatattctgactctattctgttggtgatctgaagagcagcgggcactgcctcactgtcttctccttgccctggttctcctggaaatttgtcaaggctagcaatcagaggagatgtttattaggaacttactatatccaggagacacacaggagaggaaaattccagtcaggataggtttctgtgggccaaagatatcctgattgtgactgctaagcatgaaagggcttaactctacgtatggatggtatcttgcactatagctcattttgaatgctattttgcccaccctgtggttacatagttgatacaaactgcagcagccacacaggttgcatgtgaaacaactgaaatttgtttgtatgacatttagtagtgaagatgcatgccggtgttattcacctaatggcattgagatgtgataggaaaaccttagtgcatgatgtctttcatattctcagggttctgaaatgccatctgatgagctactgctttacagaagaggaaaggagtagaagggatgggtggaatcaatacaaaaagaggcagcattaataaacagtcatatgacttgtttttaatactttactcagagatacaggtatactacaagctatacattgatatggtataataagacttaactttgaaaaacgtgtgtgagtactttctaattctccaagggatataaataaactttcagtgaacttagctgcagctctgtattcaatcctgtagcttttttgttgactcaaaagaaagcataacttttggctccatctctgattgactgtgtaacttgggaaaaatcactgtgcctctctgtgtctgccttttggcctgtaaactgaaaagaaagccaagccacattatatcaaagtgctccgtggcctcaaggaccagctctctgcaaggtgttgtttattagaagaaaaaggttgtatggagaaattcattggattatgatagaaagtagctaataactaaaaagataaattgatgataagtggatattgaagtggttgaactaacagagctaattgatcataagtggagactgaaatggttgaactaactgggttcagagaagttgacactgctggattcccgacgccgtcaggtaaatgcagaggcaatcccattcactcctacaatccaccacattcatttatttgttgaagcaacacatagtgagcatccctggctaacgggcactgtgcaaagtagtgggcatacagaagtgcttatctaggaagctcagcatctggtaggggaggcaggcaagtgggcaactgtagtaccctatgtatagcactctgattaagagatgcttaaagtgctagaagattgcaaggaagaagcagctattctggctgcaggatgaaggtatcagaaaaggcttcacagagcgtttgtctctgagcttttttcataatttttacccggtgatctgaattctccctacttctggacacatggtaggattggacgtcctggcccccttatggttggatggggtcgaaagactaactttggctaattatttgtgagcctaagttacagggtgccactttcagaccggagcacttaattgcttatgtgaaaccctctctttgtgtctgcgtggtgacaagaaatgtttaagaggtggctgctgcattagcccaggtctccgagtgattcgattcatttagaactacccatgtgagtagttccctgctgtctatgtgtctttagcactggtcacatagagtagaggttagcaaactagggctcatgggccaagtctagccagtcacctgcttttgtatggcctacaaataagagtgatctttacatttaaaaagagttttacaaagaagaggaatagtgtgcaacagagactgtatgttgctcccaaagcctaaaatatttaccatctagtcctttagaaaaaaaaaaaaatcaaacaaacttgccaacccctaacatagaacgggtgagagagtagtaaatctttgtcatcttcatctactgagattttgttacctcagcataacctagtgttaacctgactgatacaccaggggaagagggaaggaaaaccatggtgagcagagggcacaaaggcaaaacagcagtatctattcaaggcaatggaagggattcagggtgattcaagggtggggttcaaatggactaacaatgtgaagtaaggctgaagaagaaaggcaaggactggattagctggagtctaggatgtcatgctaaggctttggattttatcctgtgaaccatagtaaggacttgtgatagattttgatcagaggcctgacatccagtttcttttactgtgacaatggtatggaaagcaacttgtttagggtgtgggatagggtcagactagaggaagaaacattagttagaggccccagtagtgagggagtgcattgaagaaagtagaggaggctgggtgtggtagctcacacctgtaataccaacactttgagaggccgaggcaggcagatcacctgagctcaggagttcaagaccagcctgggcatcatggcaaaaccccacaaaaaatacaaaaaactagctggacgtggtggtgcgcacctatagactcagctactgggggtggaggggggcctgaggcaagagaattgcttgaggcctggagggtgaggctgcagtgagctgtgatcatgccattgtactgctgcctgggtgattcagggagccgtgtctcaaaaaaaataataataaaaataaggggaagaaactaccgtttgattagtcagaagcattcaaataattcctccatgagatttttctccttgatttttttggctttatctccttgaagcattttccaaacatatataatccctgtgtatcactggctatgtctgctaaaagtacagattctcaggcccctccgttgatgatcctgattcaattggtctagggtagaacccaggaatctgtatatgtaaccctattctagttgattcttaggattagtcatgattaagaaactgttttagagaatgacttcttcagtgccgtttaattgctaagtaggtttacttctgtcatatttgtgtaaattaatttgtcaaatttctcctaagggagtaggttaggacccatagaaaatgctaaggttgatgcttatcattatttttcttcaagatccttagactgataatattggcatctgaaataatcttcaaaccaatttgctaatttgtagtactcatcactgtgatttctaccccacagcctcagcatagaaagtaagatgtgaaatgagctgtcctcttctggggccatccccttctgaagtgtttcgatggtaacttcacaggcctccattccattattttctaattgtgtgacagcccagggaaatgagtgggattccccccttctaggctccatgagtaggacctgatggtcaaaatcagtgggtcatgcattttagcttccatcagaatcacttggaaggcttgttaaaacatagattgctgggccccacctccagagtttctggatcagtaggcccaagaatttgcatttttagtaagttcccagatgatgttaatgccactggtcagggagcatactttgagaaccactgttctgaacccattgacatcacttccccccttagctactgtaattggtttaagggcctcagccagtcaacctatgaccttcctctgttggcattgattggatgcttcagccttaggcacattacaaaagctagctcagttacgacgaagctcagggcttttgcttggctagaaaggcattatcttctaagtaatgagatgtgtggacgtaaggccagaactgcttctgccattttgccaccctgaaggaagccagttggaagacgaaactgacttatggagaagaggaaactgaaataaatggcactcatatttgtaagcccaagcccagatcagcttgtttcaaaagctgccattccatcggacttcttgtttacctgcaccaaaaaattccctttgttgctgaagtcggtttagattgcgttttctcttacttgctacctaaatgacagaggtgccctcttgagggatggaatgtgcttacctgaaagcaataggcaaaactctgcacatggctaacccctcctggagggcattcagaagaggaatacaggtattagtaaggacagttttgaacaactgtattcttgtgtaacctggccagatgaattccccactctaaatcaggggttaatgtggacgtattataagtgaatgccgattgagggttacaatctggtaacgacaaggtttttgaaattccaaggccaaagacaattttacacactgcttttgaacaatttcagaaagtaaaaaatgtggccaaatgtaaaaacagtggaaattccaaaatgggttgaatatgaggctagacaaatgattattaactggaagcaattgtagacccaatcaatgttcgtcaatgtcttgagacatttttcactgtcatgcctggggagaggtactcctgggagatgtaccctctactgggtagaggccagggatgctgctgaacatcctacagtgcacaggactgggccccacaatgagttattcagtctaaaatgtcaatggtgccacagttgagacattctgagctagacttaggagaagtcagatggctctgtatgcgcgagatttttatctgggttgggtggaaggagattacttaggacttgggcggcctagtagaaagatgttctatctcacgacagagcaaggacaagctgggttttgtccggtcaatgacagatgtgaatgcagtgtcagaggaggttgtgggtggatttacagaacggggagatgtaaagcaaaacacatgtagtttacattttaagttgaaataggtcagtgtagggcacattctaggctgcattgtgaactcaccagggttctttgttttgtagcgttgagttttgtttcctttggtttacaatgcaggaatgaaatactgtaccacttatttttggaagccctgataattaattcctacgactctggccccaaatttgattgttctcacttgtcataaatgtaatttataggaggttttggaatatagggctatagcatttaaaacactcttacaatgggagtttctatggaaatagaggcattgtggcctctaccgagttagttaagcatagattgcttattagaacataagaattttaatctgcaagttagagtaatgaagcaagttctttaagtattaccatttcaccatgatatttcgtttttgaacttttaagagttttgtggaagtagatagttgatttatttaatgttttcttacttagttatgtaaggaggtttaaattcatattatactgctgctcacattccttgaagggctgagtttctgaatgaatatgcttccttccagcctggctatttgggagggttatgtcctagcatctctatattgttttggaaacacatttatgaggagttctaatgctgataatgaccatgtctgcagagtggaggggaggcccagtttttgagcctggctttagggttatacggtacatgtaaaaactgcaagtaactcagaatttttggaggacagattccagaggagatactggagaggaaggcaagtacaattaaggaaggcatttgtatattgtttgtttgtttatccgcaaagcatttagtaagccattgaaggtttttgatcaagagatgatttgtttggatatgagtatttatgaatatgactatctgaaaaggtgattatggctgtatgggatccagagggcattcttgtggtacctgaaagcctttgtgtgttgaatgaatgcagagaggcagtattggttaatggttaagagagtgggtgctggagtgagtcttcctcagttcaaagcctggctctgaccctgtgaaatcttaggcaaattatttagcctctctttatgccttagttttttcatctgaaaaatgggggtgggaagaacacccacttcttatgagggttggatacatttataataaagcatttagaacagtgcctggcatataataaatcagcagcttcaatgtataagagaggcaattacaggtatgggcctaggatttgaacaacgtaagactgtggtcctcaaccctgatggtacattaaagtctcctggagagcttttaagaatatcaacacaggaacaactctatctaggccaactgaataacatgtctggagtggggcctgggcacgagcagtttttagctttccaggtgagtctaatgtgcattctaactgtgactcactcggtgtcaagcctgaagctgtggccactggggtatagaaggggagctgtgtggtaggttttgaatgagaatgcactcttaggcagacagggatgttgtggtgactgtggcaggagaaacaaatgcaaattcctcctagtgttccacaacagcctcccagtcgtcactttatgcatcctgctcctggccaagcatctcacatccagctagatttgtcagctgtaagggagccaagaaccatgggaggtcagaagctgggcacagctagactgtttggaacccagctggtgtctacctatcaggtgatggattacatatcactggtctcatgccttcacaaataaatctaccaacaaggacttgttgagcaccttcttttgggacctacagtgtgccaggtgactggagggcagcaaccagatagcaatgtggctgctctcaggggtgagttgttattgttttgtttgctttttctgcaggagccaaaactcaggcttgttaagtggtaattgacagtccttctaaggaagtttctcttggatttgctgccaataggaagagaattatttctcagagcactatagcattcatttatcgagtgctcactcaattatgaggcatgacagagtttgccacctaaaagaggaaagaccacttaatgattcctagagtcaaaagtcaggaataaatggatagacagatcaaagagttaaggggattctattgtaattggagaagcacttttagcaggagccaggtcttccactgagatcttaaaggagctcttgaatgagttgtgtgtgagggaaagtatgcttttgaacataaagaaatagtgatttggccaggtgcggtggctcacgcctgtaatcccagcactttgggaggctgaggcgggcagatcacctgaggtcggagtttgagaccagcctgaccagcgtggcaaaaccccctctctactaaaaatactaaaattagccaggcgtggtggtgggcacctgtaataccaactactcaggaagctgaggcaggagaatcgcttgaaactgggaggtggaggttgcagtgagctgagatcgcaccattgcactccagcctgggtaatagagcaagactccgtctcaaaaaa

SEQ ID NO: 2502 - DNA, 3489 bp, Homo sapiens
aaaaaagaaaaaaaaaaaagtagagattgcattagttccatatctccgcagagttctctggtagattaaatgttctctgtgcactaggccaaggaagttcctgttacctttgaaaatcattgtgtttgctctgattgtctacattagctcatatcagtcttttgaacactggttcaaatctgggtgttgggttaggatctgatgagtagagaatagtggaaagttgatataggaaggtatactggtttctggtgtgattctttagctacatttattccttgtcttatgtcatttcactggatcatgtaactgtcctggctttcagaaattatattagatgcccagcctttctcattcagagatgcctgtattattatgttatttcgattgcctaccaaaaaaaaaaaaaaaagaaaaggtttgtttttagttctctgcctctgcaagtctttgtgatcacatttgttaaattgaatctgagattcaaatatttcatttaatattttctgggttttgataatgggatattctgtaagataaagcaagtaatcctagagtgatttactttatgtttagccatccaccattttcctatttctctactcctcccattctccatttttaaaaggaaattaacaaatgtcttcctttatccctgcctcagataatttttccctgaactcatcttgtcagcagaaacatttaatgtgaaataattctgtatttctgagacaagatcaacacagtagttctttacattgagctgaggtgaatgtatacttaaaaatactctattttctttttatatgaacttaaaatttttaaaatcatatatgggactccccaatgtgaaaatattagtctggacattctcttgccatcaggtgctatttctaccttagctgtgagttagactaaatccaaatttcgtatcattcatctttttataatatttaacttccctagaatcaccccatttcatgtctttaaccccaacttccaacaacttttctgcttttattttcaaatgtcaaattgtatttttgtgttttattttctcattgaagtgtaaaagtatcacatatatgaaggaatggctggtttagacatttactttggcatagtaaagattgatattgataccacccaccatcctttcctctagccccagaaagaaaagtttgacaactcaaaaacgattaaattatcttatcttgttatttaatagaacaatggaagctgtttcgtcaaaattaaaatactttaccaaaaaaatacttttttgtattttaatctgatagtgaatttggggattatttatgtaaatgtatcataattaatagtaattatgagttatttcactctctgtaatttgtgatacccaagattcatatttatttaatgtgaggtgttttttgaggcttttttgttttatcttgttttcttaactttttacagtgttgttagattatcgcggtcatctcggcatgtggatcgctcctcctgtagatcagctgttctctcttagagtcaggacaaggatcttttagaataggtatgttaacttctcatcctaaccctatcaatatatcagaggctttatgaaggagactctacagataaccacaaatcttatcaagaaaattctccttaaaaaaagttatcctttattttgttgttaaatttcccagtttttaaaagtgttttatcaaaatgacttcataattgaagcaaataccttttggaagtatatatgttacataagactttcactaaatctgtgcgtaaagcttttataatctgagatattgttatgtattaggtttgtgcaaacctaatataaaagggttcatctgtaagtatcatttagaggcaaaataatttccccctcacatctaatgtggactcaaattttggcaactggaatgttatcctcttggtaggcattctaaattaatgaatactgctatgtggtgtagtaaacaaatttgccataaaatgccatttaaggattttctttttacctttatttcattataaaagtatatgagttgaagatcatataaaaaatatgaaactcctacacaggaaatccccaattttgtgatttaataggttgtaaaaagagttgttccaaattcagactacatctcatcatataaataatattatgaataataagggtaaaagattagccaacaaaagctaatctagtacaccccatagaggtactccaggtgtcttggttttggataaatttttatagtggagaaaggttactttgatctctcaataattgcttggtacacttcttcctaggcaatatgctcatgataccctcttcatgtgacctattcctcaaatgctgcattctccaaaacttccttacctgccttctatcccctagtcattcttatcaatacttccaaaatataacctatctcaagtgttagaaatttgctttaactaatttatattaaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacatatgaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctctt

SEQ ID NO: 2503 - DNA, 568 bp, Homo sapiens
tggcccttctcccgcgccccgcgctcaccctcctgctcctcctcatggccgctgttatcaggtgcctggagcaggcctagaccaccgactggagggccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggcgttcatcttaacattggtatcccttccctgacaaagtgttgcaactaacacgacaggtgctatgagaactgtggcaaaagcaagaatgactgtgatgagaaattccagtattgcctctccaagatctgccgagaagtacagaaaacactaggactaacttagcatgttcaggcatgtgaaacaacaatggagctcttgtttgacagtgttatacatttaggttgtaaaccatatctggacagccaacgagccacatgcaggtgtcattatgaagaaaaaaccgatattta

SEQ ID NO: 2504 - DNA, 1759 bp, Homo sapiens
tttctccttaacgggctgatttggattgacttgttgagaatggtatccattagtaatgagtcaggagagaaagggatttctgtggttacatgtaaacttgtggtaggtctgcagaagttacacgtgaagaggttagtgaggaagtcagccatgatccatctatgtgaaggtcacaccagcttcactgtacactttgaagactttttcaatggcattgacataggcagctgttctcaggtccaatcccaggttatacttcatggctgtgtgcataatttgcctggcagaacgctccattgtgtatgccaaggcagagtgcacaatgtctttctcagatgcacccgatatactgtcttggaactctgccgtgggtacaatgggaatagttccaccatgctttccaaattttctttctaaactctcttgaacagacaggagcaagtggtagttagaatccctttcatatttgaaggtcaaacggccatagctgacatgatttagattcttcagccactcaaagtaagatactgtcactcctccagcattcaagtagagatctggaataaccaaaatgtttctctccaggaagatcttatcagcttctggagttgttggcccattggcaccttcagcaatgatcttggctttgactctgggtgcgttggatttggtcaactgcttctcagtggcagctgggatcagtatgtcacagtcgacctccaagatgcttccttcatagggctttgccttggggaagcccagaatggacccatgttgcaatttgaagtcttccagttcctttgggtcaataccatctggattccatatactcccatcagactcaccaacagcaatacatttagcaccaaaacgatgtaaatatctcatagagtgtaggcccacattaccaaatccctgaacaacaaatgttttatctctaaaccctggtgtcattcctaaaatgctcatgtaagaagcttcattgatgaagttttcaatcccatggaagacaccacggccagtagcagagatgcgtccatggattcccccttggctgatgggtttaccagtaacacaggcgtgtgcattaatatcatagtgccctatggtgctggcataggtatcagcaatccaggacatctcccgctcacctgtgttcatgtctggagcaggcacatcaacgccaggaccaataaagcccttctttgctagctccatggtgaacctccttgtgatcttttccaattcattttcggtatagttcttgggattgatcttaacaccagctttagcacccccaaacggcacatcaaccactgcacacttgtatgtcatcagagaagccaaagcttttacttcatctacactcacatcagtgctgtaacggatacctcccttgcagggcgtgcggtgctggctgtgctgggcccggtagccttcgatgacctcccaggagccgtcgtcgcgccggatggggaaggagagactcagcacatggttgcagggcttgatgatccgcaggatgccgcgcacccggttccgcttctgctcctcgctttcctgggtcctcaggtccttcaccaacttgtcctccacgatgctggcgccgcgatcgaagaagccctccaccatcttgaagaagttggggtcgtcctcgcggtcgcaggcggaggaggggtgcgtgacggtcgcggaacaggtgcgctttctcagactccccgcgactaggaaggaagggtccggcgcgggttgccctttt

SEQ ID NO: 2505 - DNA, 3818 bp, Homo sapiens
ggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtacaatgacatgtatccatctttatagtcatgcagagtctacactgtcctaaaaacccttggctctgcctcttcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcatttctttttagcatcgagtaatactccattgtctgggtgtacaacagtttatccattcacctgctgaaggacatcttggttgattgcttccaagttttggcaattatgaataaaattgctatagatatccatgtgtaggtttttgtgtccatttaagctttcaactcctttgggtaaataccaaagagcacaattgttggattgaatgctaagagaatgtttcgttttgtaaaaaaccaccaaactgtcctacagagaggctgtaccattttgcattcccaccagcagtgaataagggttcctattgctcaacatccctgtcagcacttggtgttagtgttctgaattttggccattctaaaaggtgtgtagtggtgtctcacttgttttgtgtttttctctgctcagacagctcatccacatcacatttattttaatttgcatttccctgataatatgtgatatggaacatctatttactcattattttttcttcttatgattgaagttataatatttctttaaatattttggataaatcttttgtcagatatatgcactggaaatatttttatgggggaccagtgttaagattagatctgtttaaagagaaaggagagaaagtttcaggcagggaatgcaatcgatgtgaaggtttggggtaatttgtttcatttatctttaacaccatgttatggatggcaaaataacttcactggctttttttatcaagaaaagacttaccttttctgaatgcaacagtattagtaaacctaatggtgacaataaaagcgattctgaataaatgaaaaccaatagattgttctagttttactcataaatataattcttcatatactgagttcagttttttagccataaatgaagacatgggaaaaccataacatgttatttgctgagaagttctggcaaatgaagcaataaaataatcaaaactaaatcaacatttaaatacagaacataaagagataaatccaaaaccagaagatctctttgaaagaaaaacctaagtaattaaaaaactgaaagcacagatattcattatttcacaaataaacgttaatgctttttagacatctttaagcaactttagattgctaaaactaaaaaatgcaattaagacaataatcttatatatagacaataattgtcttaataataatcagcatcaaagattcttagaaatgttgggagactgtgtggcaaagaaagtacttcaattaccagttaccaacacacaacaatttgaaatatccaggaagatcaacccatagaacaaagaaagctaataaattaccttttcttgcaattggtttgatgtaccattaatatatagatattactaatatggcaattagtttatatgctatttgaatatgatagtaatatgaaggaagattctcttttttccacttcattgccaacaaacagctaactctaaacaacagtaaagtgtggaataaattactttgttaattaatgtggtttgaagctttgtaggaatccaattggatggatagcagcagtggtaagagaacattccggaataattacctaaattaaggagcttgccctagaatgtaaatcaacctactatatctttttatttgaaaaagtcttggtagaaaaagcatatcaactgaactgtacagtgtgttcagtgacttagtaaagaacataacttgtgtaaaggctaatgcaataagtttgagattgttctctttatgtaatagtttggaaaacaaacaactgtgattacatttagagatatgatgattatctagagggaaagttctgttgagcatatttgaacatttaattattgctgcaagaagccagtttggtcccagctttataaagatatacattgggctgggtgcggtggctcatgcctgtaatcccagcactttgggaggccgaggcaggcggatcacctgaggtcagaggttcgagaccagcctggccaacatggtgaaaccccatctctactaaaaatacaaaaattagctgggcgtggtggcacacacctgtattccttgctactcgggaggctaaggcaggagaatcgcttgaacccaggaagcagaggttgcagtgagccaagattgtgccactgcacaccagcctggataaaaagagtgaaactctgcctcaaaataaaataataaaatgaaataaagatataaattggccagctagagttacctgaagttactatcttcaattatctgaagacagttctgatagcttcagaattctttcatacaaggcaggaatgcaacttgttttttaatggcagataaaatcaaagagcaaaagcaaaaggtagaagcttgaaagaccagagttgctacagattgttattacatgttccataatttaacaattgtcattgaagttggtgattgtcttgatattgcacatctgtaagaagtaatcaaactattgtgaatttgatagaatgctttaagttttattttccaacaaaagaatgtctacatacggcaaattcatagatctggaatccatttatgtcatcaaaagaggatttaaatttaattgtaagcttatatgatacattgttctaactggcaactaatgaa

SEQ ID NO: 2506 - DNA, 1295 bp, Homo sapiens
atcctgttgcctctaagtcagtagaatgaagagctgtgtccagggacacaccacaccgtgctgaaggagactgctgctgtgtccacctcttattcatagacccagtcatgagcacaagacttgtagtcaaccagttcttcaggcttaaaccgtaggctgatttctttttcagcactttttactgaatcactgccatgaatgatgttcctgccaacctgaatgcaaaagtccccacgaatggtgcctggcttagaatctgctggattggtctccccaagcatcactcggcctgtcttcacgacgttcagcccctcccagaccatggccacgaccggccctgagttcatgtacttcaccagcccagggaagaatgggcggtccttcaggtcaatgtagtgctgcttcaggtgttcttcagaggccgggaggaacttcatggccacgaggcggaaccccttctgctcgaagcgcttgatgatcttgcccaccaggccgcactgcatgctgtccggcctgatggtgatgaagacacagcctcactctgtcctccagtctggagtatagtggcacactgcattcttcacctcctgggctcaagtgatcctcctacctcagtctcctgagcagctgggactacaggcgcccaccaccatgcccgactaacttttttcgtatttttttagagatggggtttcaccatgttgcccaggttggtctggaactcctgggctcaagcagtccaccttccctgacctcccaaagtgttgggattacaggcgtgagccactgcacccagccttgtataagtaccttttttttttttttttgagacggagtttcactcttgttgcccaggctagagtgcaatggctcaatctctgctcaacacaacctccccctccgggttcaagtgattctcctgcctcagcctcccgagtagctgggattacaggcgtaagccaccacgcctggctaatttttgtatttttagtagagatggggtttcaccaaattggccaggctggtctcgacctgctgaccttgtgatccgcctgccttggcctcccaaagtgctgggattacagacgtgagccaccgcgccggcctgtataagtatcttataatcatattgtatcccactttttcccacaaatgatacacacgttacctacatcgttcagtgttatgttttcagatcttggaagctgtttcgtttcagtacatttgagcttcctgggatcttttctgtggctacataattttccgttgtagaactgtatgtgatttaattaaac

SEQ ID NO: 2507 - DNA, 1737 bp, Homo sapiens
ctgcattgcttgttgttgcgcttcggaggcggcgatccccgaaggcgagctgaaatacggctggagcgttcccaggctacagtttgtagccgacgattgtggaagactaggagccggagaggtggcccaccctcagggagcgcttgtgctcggagggcttctcatttccccaataccacattaaatcgtctcatctgaggaggatccacagagctgtcttctatggtaatctggagaaactggagtaccttctgctcacgtatcatgacaccaatgagagagacaaggaggaaagcatccggtgaaagacagagatcacatttcaactagattcttaggaagtatggattcactaacttcagcgaagcttaccctgaaagaagcagatcccagttcaaaagtagccataagaaggaaggattcaccacctccaggaaaagtgtcttctcagaaacaaccagctgagaaggctgcaagtgacgagaaagattctgtttcgaatatagccacagaaataaaggagggaccaatatctgggacagtgtcttctcagaaacaaccagctgagaaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtatgtcttctcagaaacaatcggcctggaaggttatatttaaaaagaaagtttctcttttgaatattgccacaagaataatgggtggtcagaaatctggaacagagtatcctgagaatctgcccaccatgaaggctacagttgaaaataaagattctgttctgaatacagccaccaaaatgaaggatgtacaaacatccacaccagaagaacaagacttagaaatggcatcagagggagagcaaaagaggcttgaagaatatgaaaataaccagccacagcaactggatgatgctcgcaacaaagctgacaatcaagaaaaggcaatacttaatattcaagccagatgtgatgctagagtacaaaaccttcaagctgagtgcagaaagcgccgtcttttactagaagacagtaaaaggttggtaaatgaattgaatcatttgaaagaaaaagaacgccaatatgaaaaaaagcaagcagaaagagaacttcaagaaacacaggatcaacttacagctactataagatgtactaaggggatggaaggcgacgcacaaaagcttgaagtagaaaatgccatgatgagaaaaactattaaaaaacaggatgaccaaattgagcgacttgagaaaatcctgcagcgttcaagtttgatgccacaggtgttcaagagctagatgaagtgcttgtcctagtaccttagcacatggttgctgaatacatgaatgaagagtgagaaaccagaagctctgatatttaactgccgtgataatgaattcaatgtgcaactatgggcaaattgtatttaatagtaattgcatattgtacatatttttcattcttattaacactgataaacttttcaacttatactgactttaataaaattgtattactaggctattaacatgatattttgtttcccattaaatgtgacatgcaaagacgtttattaaatgaaaa

SEQ ID NO: 2508 - DNA, 5702 bp, Homo sapiens
gcggtgtaagcagaattaaggttctgctacctctgtgtgtagaatattcccaatggatttttcatttttcaggtgctattttttgaccctgtatagactttaatttaaaatgaatttggtaacgtttctcctctgtctctacatatattcatgctttcacctgctcttttaacacctgcttttagtatctgaggcactttttctgaactctacttgtgcactggatccctcctcctttctctgccaggctgtgtttactttatccttacatcaccacttagtgattcctttctttgtataaacatggtaaatgtcttcattagcctaaaaggaaagaccaaataaaacctttcctaccacttggatgcatttgcatcctgacttctgaaatgcctccagcctccattttctcccttcccagttattccttagcccagccatctctgtctttagctcctacaattttcttaggatattctgggaaagatgagcggagactgcccgccttgtcaaatctagtgtctttttttcagtcctcacactgcttgacctatgtataacctcctatacttccctctttgcatactcctctgggttttctgtggtagtcaagattcctccctgagatttatttcccatgagtcttgacccctcccctcagttggtgctatttccccctacccgccctccgatgatcttatcagagcccacaggttcagttttctttcatgctacctgaatgtcctgataaactggctcgctctcttctttaccttccataatggcattaccatttaccacgccacccaagatacttactaggaacctcaaagtattgtattctttttctccatcacactcatacttaatcatcaagtccttttgagcttgtctcctcttgaatatgtcccttcttaattcctgctgccttcttagtaaaggccttcattcttttttccctagtaataatcttttccatatgttccagttaaaataccatgttctccctattccttattacatagctagcattccttgaaaaaaaacaattctctcaggcctccatacctttagcatgttacccactctgcctctgctcttctggaactagaacactcatccttgaaggctgggcttctgtatgaaggttggtcctgcctccttacttgaggtgaagctttgtacatgcctgtattacggacatcctcttatttaagtgtttgtctctttcgtcattgggactccagcacccagcatagtccctagtatactagttggtgctgaataaatagtagctattattagaaaaggaagggtgaaattgacatgggagttagtaaaatgtatatggaaatgatttttaaagggaaaggtaatgattttctggcaggaaaagcagcaatgacaagattacttaagtcttgtgaaataacacttctcttccttgacctgctgcttcccttttttaccacacacacacgcacacataccacagccctttgagactgaaagcagctctattgagaatagtagtgtcaactgtattatgtagaaattctaaagtttttgggattatttcatagccctgaccttgctacttctctccactttatgtggcaggtttaatctcaggtctccctcatacacttctcagcctcagcacctaaccctcacacaacactccagtattgatgcagtcaatcttgtataacattttttgaatgtccaatgtgcaaagcacgatgttggaaattatacagaggtgaataagacaaaaactcttgctctcaaagatgtcagtctttttctttgcaaggataacacatgtagagtaaaatgcataaaggggactaattttaaatgtacagcttaattaatttttatgtatgttaacacccatgtcaccaccatgtttaggacatttccagcacccctgaaatttccttcatgccccttcccagtctgtacctacacctctaaatctattttcaatcttaatggccttttaaataactgggcttctcacaaccatagtgaacagaaacagctgggttgtcaacgtctaacctaatacttcaggaaaactcatgatggtttccatgttaagagagacatggagcagggcactggcatggtggatggatcacgcctgtaatcccagcactttgggaggccgaggtagggggattgcttgagcccaggagttcaagactagcctgggtaatataaggaaaacctgtctctgcaaaaaaaaaaaaaaaaagaggatacaaccaaatggaagaacattccatgctcatgggtaggaagaatcaatatcgtgaaaatggccatactgcccaaggtaatttacagattcagtgccatccccatcaagctaccaatgcctttcttcacagaattggaaaaaactactttaaagttcatatggaaccaaaaaagagcccatatcgccaagtcaatcctaagccaaaagaacaaagctggaggcatcacactacctgacttcaaactatactacaaggctacagtaaccaaaacagcatggtactggtaccaaaacagagatatagatcactggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagctgctgcacagcaaaagaaactaccatcagagtgaacaggcaacctacaaaatgggagaaaattttcgcaacctacttatctgacaaagggctaatatccagaatctacaatgaactcaaacaaatttacaagaaaaaaacaaccccatcaaaaagtgggcgaaggacatgaacagacacttctcaaaagaagacatttatgcagccaaaaaacacatgaaaaaatgctcatcatgactggccatcagagaaatgcaaatcaaaaccacaatgagataccatctcacaccagttagaatggcaatcattaaaaagtcaggagacaacaggtgctggagaggatgtggagaaataggaacacttttacactgttggtgggactgtaaactagttcaaccattgtggaagtcagtgtggcgattcctcagggatgtagaactggaaataccgtttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttgtagggacatggatgaaattggaaaacatcattctcagtaaactatcgcaagaacaagaaaccaaacaccacatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaagtaacctgcacaatgtgcacatgtaccctaaagcttaaagtataataaaaaataaataaataaataaataagaaaaagaaagccaggcatggtgacatgtgcctgtggtcccagctattagggaggctgaggtgggaggatcccttgaacccaggaggttgagtctgtagtgagcagtgattacgccactgcactccagcctgggcaagaccctgtctcaaaaaaaaaaaagacttagaattggtgatccaggccgcctaatggcatcaaataatttgttatatctttaatttattgaaggatcaccacatgcttttaaatagcatggagaaatggaaagaatagggactttttactcaggtaatacccagcctgctacctaacaggttgtgttgtactaaataaaatggtacataagaagaaacactgtaaattatatagtgcgaatcaaatattgttaataaaccaatatctgtatatcctatgtcccggattaatctttaatttagatactccttctagttatctaatacacagcagagtgagaaaaatcattatggattaggttctttagtaagaaacctgagatggacttctcattagcattaactagttattgcccagctttggagagccttcttttggcttatcatttattataagcccagaaataggtgactaatcagagataaatgtatgggttgtctgtatctagttttatgccttttttttgcctaagacgtagtcaaattaatattttaactaatacatcttagcagagtttagttaagcacaaagttaacagtgggtaggattgaatcttgaaagtaatcatgtctgtaatgtttttcatgcatgcaaaaagcacagacaaaaccactcatgccctattaataaacaaaatacagatcaaagttttcaaaagtaatcactctatttattctaaatgtctgtggctttaggaaaataccaccagctagtacttacctatttaaagatgtagaatttattatcctctaatattcttatcagttgtttccacaactttagtttactattggactttcaaaaatttaaagaattacaagtaaaattcattaaacacttgtgtgtgaatagtaatacacagtaattagtacagcatgttgcttcttcaacaaattgagttttcagggaaatcagcaagtaaatgaaatataaatttttggtaaaagtatcaaacattcatcttgcccatttttcctcttaaactttattatctaatcaaacatagttttccataagatgtaataaaatatagataaggttggaatatttgaggatccatttgtggaactgaatttaatgagacttcattggtgatacactcaatttttactgggtaattagctaataatgttggtcactgtctcacagttcaagtagctttaagatgatgtggcaaggaaaacacaaagcttttgggtaaccagcgttcttaaatgtatggtttttgaccaggtgaaccctttagaagtgatttctgttttaaaagtatgtacttaaaatacctttggctgtgatgaatgtagatcccagcagaataccaaaatcctattttttttgactgagtatttgtagatgcttaatgactgaaatgaatttggaggcactgatgaaagtgatttttttaaagttctcaggtactgttcaattatttaatgttaagtttagtatcaagatacagttgtttttaaaatgccaaaatgctgtttattatacagaatattttattacatttgcaatatctttgtatatagtgatttttttcttgataataaatggaaaaattctaaaa

SEQ ID NO: 2509 - DNA, 354 bp, Homo sapiens
atggccaagatcaaggctccagatcttcgcgggaagaaggaggagctgctgaaacagctggacgacctgaaggtggagctgtcccagctgcgtgtcgccaaagtgacaggcggtgcggcctccaagctccctaagatcctagtcgtccgaaaatccattgcccatgttctcacagttattaaccagactcagaaagaaaacctcaggaaattctacaagggcaagaagtacaagcccctggacctgcggcctaagaagacacgcgccatgcgccgccggctcaacaagcacgaggagaacctgaagaccaagaagcagcagcggaaggagcggctgtacctgctgcggcagtga

SEQ ID NO: 2510 - DNA, 473 bp, Homo sapiens
caagaatttttttttttttttttttacttttttttggtttgtttttaaagaaactgcatacatcatcagagacaaacaataatttaaataccatgcagtttctgtatgtacaaaacctaggccacagagatccagtttaatttgtattctctatttacatcgttttcctcatacagccatcatctgttaaattagaacctgggagattaggggattgacggtcaccacactcactcctatacaaagacaaactatgtacagacacccaggaagcaactggaaaatgcaaccggtctggggattaacagacagatagggagaaaaagtcatttaaggtgacctttgcccaccggctgtgcacagggagagcctgaaattccattcatcaaagcaacacaccacgattttcattcggcaaataaaaatacatgttcataagcgggagaaaaataaacccagagcttttcatcaca

SEQ ID NO: 2511 - DNA, 452 bp, Homo sapiens
attaggtgattgtagttatacactttcacaaaagattttatctttgatctcttggcgatcttcttcttgcccatggcagctgtcactttgcgggggtagcggtcaattccagccaccagagcatggctgtaggggcgatctgaggtgccatcatcaatgttctaaatgagtaagaattacatttgttattcactgagggcctatttaggccctgtgttagaggtagtgcagtgtccaaaaaatatttccaccctcaggtctccaagatccaccattataaagagaaaaatcacagaaagctatgagaaatgaccaaagagaaacagaacagtgtttatctccatcaggaagcatctggaacggcttactagagattcccagctgcagcacttcaggtaaataacagaacacctccaaaccttagcaacaggaaggaaccccctatagctggg

SEQ ID NO: 2512 - DNA, 1610 bp, Homo sapiens
aacgccccggtggagaagctgaggtcaacatcagatttgaaatatttaaagtggatacaaaactatttcagcaatgcagacaattaagtgtgttgttgtgggcgatggtgctgttagtaaaacatgtctcctgatatcctacacaacaaacaaatttccatcggaatatgtaccgactgtttttgacaactatgcagtcacagttatgattggtggagaaccatatactcttggactttttgatactgcagggcaagaggattatgacagattacgaccgctgagttatccacaaacagatgtatttctagtctgtttttcagtggtctctccatcttcatttgaaaatgtgaaagaaaagtgggtgcctgagataactcaccactgtccaaagactccttttttgcttgttgggactcaaattgatctcagagatgacccctctactattgagaaacctgccaagaacaaacagaagcctatcactccagagactgctgaaaagctggcccgtgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttttgtttgtttgttttgtttaaaagcaaggcatgcttatggatgactctgtaacagactaattggaattgttgaagctgctccctggttccactctggagagtaatctgggacatcttagtgttttgttttgttttttttccctcctctttttttgggggggagtgtgtgtggggtttgttttttagtcttgtttttttaattcattaaccagtggttagcccttaaggggaggaggacggattgattccacattccatttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaagtaatttctaacttctttcactgataaatgaagaaaagtattgcacctttgaaatgcaccaaatgaattgagtttgtaattaaaaaaatttttttccctttcaaaaaaaaa

SEQ ID NO: 2513 - DNA, 1793 bp, Homo sapiens
taattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactatccatatagatcatggatataaagagatacctgatttttattaaaaagatactttttcaaatttaagagttaatcttggaaatttggaacaagtaaaggggcaagtaaaccttttgatgaaatataaaaggaactcattgcatgaagttgactatcaaattctgtgatgtgtggcttcttaaaaatattctcagtgtcttttgtgtgcgtgcagcatgtacatttgatgttatgtgaatgttgagttttttcttctaattttcacttcagcagtgtttagggctttcagatgccttattccagtgtgaacagaaaaagttcatattttatgtggttaatgctttgatgtgtcacataaagagtagtttgtagaaaatgttggcacaattttaacttcttagtggcttgtgacattatatattatatatatatatgtacatatatctttataacattcctgtgtttagtagtgtaaatgttctgggcaagttttaatattttgaatgcctttggatattccagcaataaaggcatcatgttctgcaataggatttcttactcatttacctattttaacactaaaatagaccacaactgagcacaaattccttttataaatgttatagaagcagggaagaataataaacacatttgtgaattgtggttcagtttatttatctttagggaaggctgatcatttatcttatagcagataaccccagcctcttattcattatggttaacttttataatttatcttattttataatttaagaatatagtacatatcagttgggtttggttttggtcatcgagactaaaagctccatcaaaacagaactttgtgttttctgctaacttatttaatgacacaagttttaagagaaccacaattcattgattcacttattcttttccctaattgtgaattttagtgataaatacacctgtactactgaggaaaatattctgacacttcacgtgtgcaaagtatagaactgacagtgtcagtttcagattttgtatgtacgatttctggcttatatatccaatggtgcagattttgaaatttgtaagaacaaaatttgttaagaaaaacaacttgctctagttttgtgaccttgtgtacttttgaaataaaatcaagaaa

SEQ ID NO: 2514 - DNA, 7040 bp, Homo sapiens
ggtctttggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtagctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacactgaagt

SEQ ID NO: 2515 - DNA, 7041 bp, Homo sapiens
ggtctttggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtagctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacactgaagta

SEQ ID NO: 2516 - DNA, 461 bp, Homo sapiens
ttaagttggggcaaatggctatagtgcagagtaatgccatcactgggcactgcgaatgccatgactgaagaattaacagccacccctcaggcgcaggaccagctgcttgcctgcaaagatgagcctctgctggtcgggggggatgccttctttatcttggatcttggccttcacattttcgatggtgtcactgggctccacctccagagtgatggtcttgccggtcagggtcttcacgaagatctgcataccacctctcagacgcaggaccaggtgcagggtcgactccttctggatgttgtagtcagaaagagtgcggccatcttccagctgcttgcctgcaaagatgagcctctgctggtcgggagggatgccttctttatcctggatcttggccttcacattttcgatggtgtcactgggctccacttccagggtgatggtcttgccggtcagggtct

SEQ ID NO: 2517 - DNA, 245 bp, Homo sapiens
gaaggggctcttggccataggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaataaataaataaataaaaaataaacttaacttcctagtaaagcaac

SEQ ID NO: 2518 - DNA, 739 bp, Homo sapiens
gttagttcggcccaatggcggcaccgctgcttcacacgttgtttgtcgggagatgcggccgcttcgtcctctgcagtcaagacgctgggcgcgtcgaggactggcttctacttgaatgaagacaaaaatctaggccgggcgcggttgctcacgcctgtaatcccagcactttgggaggccgaggtgggcggatcacctgaagtcaggagttcgagaccagcctggccaacatgcgaaacctcgtctctactgaaaatataaaaattagccaggcgtggtggcaggtgcctgtaatcccagctactcaggaggctgaggcaggagaattgcttgaacccggagatggaggttgcagttaagctgagatcacaccactgcactccagcctgggcagcagagcaagactccatctcaaaaaaaaaaaaaaatccagccacgtagagatttgggaaaagagtatttccaatagagtgaacagtaagtgaaatgagaaacagcttggcttgtttgaagagcagaaaagacatgatggctgtagtaaaacaagttgttggagatgaggtgagagaggtaggcgggggccagattaatgtaggattttaaagaccacactgagagatttggattgttactgtaagtgcagtgggaagacagttattggttgctgagcaaaggagggattgttggttaagagtggaagcagggagaccagtaaagaggccttaacaatagtcccact

SEQ ID NO: 2519 - DNA, 298 bp, Homo sapiens
attgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaggtgacccattgagctgtgtatgcatttttgtttatttcaataaaatatatttgtattatttgtccttcatactatccatccataccacactatcttctgtatcaggtagtctaatagaaatatacctgttttgttct

SEQ ID NO: 2520 - DNA, 4630 bp, Homo sapiens
tgggcctctcatgggggtgctcattgtggtttaagtcagctttgattcttgacctccaaggctgcctctgagtagctaaccggagaatcgggtggggaggtgaaaaacaccgcagtcaaatgactcaatctttaatcctgtgcttaagacaccactgttgctgttttttatatttgaagcacccaaagactgggcgtccgctcagccttgatgagcgagcagctattttgtcaggccatctatgatgttgggataatggacaaaggcctgattgggccatatatggccttctttagggcctcctggaggtggaggaagttgtgggtaatttctaataaagacgggaaatgacaagccgtgtgtgtaggtaaagtcctaacttaaaaggaaggacaggcctagggaagggtggaccctaaagggcccatgtgccaggggaacagtggacatgtgtgtccagcccaacctccatgtctggtgctgggattctgaaggtggcccccagctcccaaaataaagctttccttttcagtagcgtccgacacttgggtagcttctttctataagcaatgcttgaagatggacgtctgggtcctcatttcctccaaactggctgctacctgaaggcagtcacacatttcttttctgttgggctgagctgggcagaagcctcggactataggcctttccagggcagaggcaatgcgggccacgagtagatacctccatccagcctccaccctggcacacccagaacggcgtggactcaggcgggttgctggatttctctgagccttggcgtgctctacactgcagggctatacatgttcccagcttgagggcgtgctggggattgacaaatatatgaaacatataagcgcaatgattttctaaaattgtgcattcccagcgtgcccattggttctctctcgctggcccaactttgtgtgctgtccataaatccctttctgtggacggtgacagtaggattgggagtgagtgggaagattgtggaaagattgcaaagaggtcattgcaggactcagacagaccttgcagtgggtttcagagtaatactcaggttctcccatggaactttcaaagctggctctaagaaagatgaagaggacaaacccactcctggacatagtgccaacctagaactgtcagctccacacaggatcacagggaagggagcttggtaagacagcccagtagggggccctgcttttcagaagaggaaactggagccatgcaagggcctggggatcaacttagaaaagagcacaggactcacagtcctgggcctgcacgtaaagctagccccctgccccacggaaatggcaagcagtgcttccctccaggggttctacatctgtgctccatctcaaaatgcataaaagcctgagtcattcagatgggagagacagtgtttctacttcctcttagttggggttcctccagaaggagaccctgagagaggacttgaggttatgtagtttatttgagtgaagatcccggaagtagggagagaaggaagctgacggggaaggcgtgcattatcaagtaagttaccgtcatgtgcacaactggagctgaatcccaccggggaaccccgagagacagagctgacaccccagagttcacccagcaaggcggggagacagctggggtatttattcaccaagtctatcacttatgaaaggctgtttctggaaacaatttctgactggccctgcacacacctgagcatacttcctaagccggggatgtccctgagctgagacaggcgttcgtgacaagcagacttcgagtggaaggcaggcatcagaaccaccctgtgagctggttcagacaaagattgcaggcccttccacccccctggccccgccaagttcctgactccctaggtctggagtggggcccgggaatttgcatttcaaaaaatctcgaggtgatgctggtgcagctgctctgaagtcttgactttgagaaccactcactagtgagagtttccagcccttacctgtctcttattgatggctttcccccctctaatttataattatgctttcacaccacttcatgtcacagatcccagggtccgtgctgtgaatttaaaagtggagaattaataagcatttataactccatgcaaccattgctggcagcttaaatgccatctgccagccataatttatttataatggggtttatacatatttataagtttgcaagcaacaaatgcacagttttaaaactggcacattttatagcagccagaaaaattgcaactttataccaggacttgtgaatgtgaattgcatatgtatatacatatacgcatatacttacattgattaaaaacggatctgcatctctgtacacacgcagattggctctgtgttgtgcaccttgggactcctccctgggctttggttttacagctaagtaggaagtcaaacaaacgtgaagaatttgggaattggcaggctgtggcatcagccatggaggatggtcctggatgctgtaggatgtgagatccagcacaaagagaacaagaacaggacatgaggaccacagggattgggggaacccactgtgggaaatgacagagaagccagtgggggaagacaaagaaagaagaaggtggaggcagaataaaggtgagaagaagggaaggggaggataaaacaagtccagatttagatcttccttcatgcagccatgcatagctgtctgaggccagcagggaaggaggagaaagggaaggtgtggtggaggaggctgtgctcgtgatgtcatgctttcgtgtattcccaggtgcagctgcatatacttggcacagtttcttgggatttctagccagtttcttggcctcatttgtgcattagttaatatgtggctggccctgtactgggatggtgggatagagaagtgaatgtatgaggcctctgcctgagtttataacctagaaagaaataaagacacacacacacaaaggtgttggagtgtgacaagccttaaggtacccgtgtgtccaagtaaagtagaaccagcaagggtggagtgcccaggtcagtctggggactctggaggcttcgcactgcaggcgtcagatactgagtgttagtggcacggagaagagtgtggaaggctcaggatgggggtggacagcctggagttgtcactctcagtagagatgctagaaggggcgggaggtgatcccagcctcccttctttcctcctcctggctgtcacagatgctctgaattgatgaatccttcaggccaaaaacacacaggctccttccctaggtctggaaaaatggttctcgctgaaaaagcaccaggaataaaatctcatacaattttaggtgtctattttgttgtctcaccttgaaatactgcagacagaaaaacatgcacatggggagctgtggtcctgagctttgaggtaatgaattcccactcatgtgatcatttttaccataaccaaagtttctaaccatcaaaatcaagtgacaattaaaacaggcattaatggataaatccgtctttaaatattaatggggttaattttgttaacagctatgtgttggttgcaagtggaatgttctctgttcatttgacttttgaatataacttgttccagaatattgtaaaattaagtatgtgaatgtttctttgtattcagaattaaacatttggtgttaaaatcccaggattaggagacaactccatgtaaatttaatgtgtaataataagataataactttttaaaaagcatttggatggcaaattatacatactgacaaatgaatattatctgaaagttgttttgtttccattaacttttgtgaaacaaaaagaattactgtaacagtctatgtcttggcgtattgccaattcaccactttctactttgtgctggaacagaactggcttttttgacatccctgaggagtggaaatgcaaaacgaatttcaagttctctaatctttgttctatgacaaatgaaaaaacctaagttatctggtgttttggagatttgagaatacagcaggtgaagagaattagcttaaattccctcctcccttttgataaatccacagggattccttcactctgtcaggaaatggtgtggtttccaagcattagcccttcatgatctgtctggtgcatttctgtgctcctgggatcgccaagtgcaggcacggcatcgcatccccaggtgtcatcctgtgacccaggaggggaagatgacacacccaatttaggtaatgctgcacttcttgttataattggttattggaaaatgtgcctttattatcagaacagtggtgtgcgcatttctgattatggagctaacttttggatatctgacttagatactaaaaacatttgggtgttgcagttttgcacttgtagatacaacttaaaagcatgaaactggtgatttaattagatgttttctataaaatgcaccttgttacatttctgtgaaagggtcttaccagcgtggaataactggctcaagggttgagagaaacaaccattttctaaacagttaattgtttaaaggactatacatgtaagtctgcaggcaataaaggctgttgtgaaaagta

SEQ ID NO: 2521 - DNA, 559 bp, Homo sapiens
gccattttgtgccgccgatcgcttccctttcccctcccgccgccgccgccgctgcgaacagcccgctgccaagtcctccctccgcctccgcagccccccgccccggcacgccccggccgcggctgggccccgaacgggaaagcctgaaggaaccgtccccaccctcccggggcacggtgatactgagatgcggcgtaggggacggaggagaggagaggagcgcccggccggcccggggccggagcactgacctgcggcagccggaggagaatgccggcggcctggatgagctcgcagcccaggatgcgtaagtccgtctcactgggcaggtcgagcccatcctgcatggatggggtgggcgagagcctctcctccggaatcagagagtggtcgatggtaagtgaaacttccgagtacaggcgatcgccgatcaggatccctcccgtcgtggtcgtcgtcgtggtcgtcgtcccggagctggagccgcccgcgcttggggcggccgatgaggcggctgcggcagcagtagctgtcgaatgaggcccggacgccatagtct

SEQ ID NO: 2522 - DNA, 721 bp, Homo sapiens
tgaagccagaccgtctttcctcacagctccacggctgcatctccgtgggcacgcaagcttcccctggttacctgagctgctcctgccgtctcccgcctgggcttcgccgtggtgcacccgatcccggaatcgtgcgtctgcgccctgcgaaagaaggacctgctggcggagctccggccggggtctcctgcctcgcagctgggcgaggggacttggaggacagggtgaagctgcagaagacctggggtgggatggctagagaggacgccaaggactggggaaggggaagttaggaataccttacatccaatgcccacccgtgctccgcagggcaagggcagccgtcgcctcggccgcgtgcacccagctcaggctgttcccagggatttagtctggggggacaacccatggcgagatgtggtggcattttacctcagagtggagctgaagatggataaacaaggtatctgatgtatctgcctgagaaggcagagctggagaaaggcggagcgagggagcgcgtgaaaagaaagagatgccgaatgccgggtgattgtctgccgcttgctgtgcattctcattctagggaggatggcataatttataacccagcacatggatagaggaactgtaaattgtagtctggatgtccccggcgctgtcgacgaaggaactgatgggctaggctcacaggcagaaggaattttccttgtcttggatg

SEQ ID NO: 2523 - DNA, 1956 bp, Homo sapiens
actggacgttggtggtggcggccaaaataggcgtggtgacgatgctaaatatgccttgcggtttcgagtctgaataccatccttccgcatggtcagtggccggttcacctgccaaaaaggaggctgcgggtgtccccaactccagacctttgcctctctgtgtcaaccagggacaccctctctaccccacttctttcaggcactcttggggctccttggcggttcagtcacagggtctggctgaactaccgtctgaagactatttagcgaccagagtccagaagaccaggggctcctttacttcaggagactctcacgcatgctcctccatccatcactccttcactcaggaatccacacacttcccttcccacttgcctgactcatctgtctgtcccttctcttgttttagaacccaaaatgtcctcaggcctcttctctagctgacatcctcttttttgttgaactcatccagtccctatcttcaaaatatctccagaatctaaccattttaaaaaaatcatctccatgcttgcttcggcagcacatatactaaaattggaacgatacagagaagattagcatggcccctgcgcaaggatgacatgcaaattcgtgaagcgttccatatttttttggcaaggcatgttggtttgcgtgtgggaatcccaaaggagaccccagctctcacgattaataggctctgtggttctggttttcagtccactgtgaataggtgttaggaaatttgtgttaaagaagctgaagttgttttatgcggaggaaccaaaagcatgagccaagctccctactgtgtcagaaatgtgtgttttggaaccaagcttggatcagatatcaagctggaagattctttatggataggattaacagatcagcatgtccagctccccatggcaatgactgcagagaatcttgctgtaaaacataaaataagcagagaagaatgtgacaaatacggcctgcagtcacagcagagatggaaagctgctaatgatgctggctactttaatgatgaaatggcaccaattgaagtgaagacaaagaaaggaaaacagacaatgcaggtagatgagcatgctgggccccaaacaaccctggaatagttacagaaacttcctccagtattcaagaaagatggtactgtcactgcagggaatgcatcggggatagctgatggtgctggagctgttatcatagctagtgaagatgctgttaagaaccataatttcacaccactggcaagaattgtgggctactttgtatctgtatgtgatccctctatcatgggtattggtcctgtccttgctatcagtggggcactgaagaaagcaggactgagtcttaaggacatggatttggtagaggtgaatgaagcttttgctccccagtacttggctgttgagaagagtttggatcttgacataagtaaaaccaatgtgaatggaggagccattgctttgggtcacccactgggaggatctggattggttgatgaattaaggcgtcgaggtggaaaatatgccgttggatcagcttgcattggaggtggccaaggtattgctgtcatcattcagagcacagcctgaagagaccagtgagctcactgtgacccactcttattctacttggccaggccacagtaaaacaagtgaccttcagagcagctgccacaactggccatgtcctgccattgaaacagtgattgagtttgttcaagccatggtgatacaaaaatgcattgatcatgaataggagcccatgctagaagtacggtctctcagatttgtaccagtgaaatatgtatttctgaactaaaactcaactatagaagacattaaaagaaattgtattcttgccaagtaaccaccacttctgccttagataatatggttataaggaaatcaaataaatgttgccttaacttcaaaaaaaaaa

SEQ ID NO: 2524 - DNA, 5400 bp, Homo sapiens
agagttccggagcgcggcgaaggctcccacgccgcgggagggaggaaaggcgtccgcgggacggtggaggcaggcggcggggcaggcctggggagttacacccgctccgcacagcgccctgggctccgggcgcctctccgcaccgggcaggagttttggcgggagggattctggcccggccctcccactttctctgcccctcggaggcaggtggcagcacaggaccgcgtccaggccgaaggacagcggggctggctaccgtgggcagagaaacgtgtcggggacccgggttagcagccctgcaaaacaggcacccgctgatggccggtacgtcctgaatgttgcggtccgatggccggtacgtcctgaatgttggtttactttcccggaagttagggtcagagtcctaactaagaacactgtcccattcctgcccttctcctgcctcagcctcccgagtacctgggactgcaggcgccctccaccacgcccggctaattttttgtatttttagtagagacggggtttcaccgtgttagccaggatggtctcgatttcctgacctcgtgatccgcccgcctcggcctcccaaagtgctgggattacaggcgtgagccaccgcgcccggccttcactcagcaaacttttattgaccactcattatgtgccctctatgagggcctatctcctccacctatgtgcatggcttgctcctgttgaggctctgaaaacgaaaccccaaaatgaaggccccagaggcagcctcagaagcaagtttctctctgaccttctgctccctctctgatctctgattctctgaggctagccatagaaactcaagaatccctcttgcccatgacggagcatagaaacaggaatcccttttctccacagtcagccataaaacctaaaaatattactctctctccacctttctgtgaaaaaactggccataaagaaattattggcctggcacggtggctcacgcctgtaatctcaccactttgggaggccaaagcgggcagatctcaaggtcaggagttcgagaccagcctggccaatatggtgaaaccccgtctctactaaaaatacagaaattagccaggcgtggtggcgcatgcctgtagtcccagctactcaggagcctgaggcagaagaatcgcttgaaccagggaggtggaggttgcgccactgcactccagcgtgggtgacaaagcgagactcagtctcaaaaaaaaaaagaaaaagaaattatctgggctaggtgcggtggctcatgcctgtaatcccagcactttgggaggctgaggcaggcggatcacctaaggtaaggagtttgagaccagcctggccaacgtagtgaaaccctgtctactaaaaatacaaaaaattagccaggtgtggtggcaggtgcctgcagctactccggaggctgagctacaagcatcgcttgaacctgagaagtggaggctgcagtaatcctagatcgcaccattgcattccagcctgggcgacagagtgagactcagtctcaaaaaacaaacaaacaaacaaacaaacaaacaaaaaaaggccagacgtggtggctcacacctgtaatcctagcacttttggaggccaaggcgggcagattgcctgagctcaggagttcgagaccagacggtgaaatcccgtctctactaaaaatacaaaaaaaaattagccagatgtggcagcgtgcgcctgtattcccagctacttgggaggctgaggcaggagaattgcttgaacccgggaggcggaggctgcagtgagccaagatcgcgccaccgcactccaccctgggtgacagagagagactgtctccaaaaaaaaaaaaaatgtatctgacctcctttgttttgctggtaggttgtaagaccccattccaggaagggttctttcccctatccagaaggaaagaatccagacaggcctcgctgggcttccccactcagtctatgagcattagatcatgcccttcttgtccagtcctatttctactcagctgtgcatattttgttgagcctaagcataaaaatagttttccctgtaactttgggtcttaattctgaaggttcctttgtcatgtaaaagcatgaccgaataaatttgtatcactttcctcctattaatctgcctattttcagttgaatttttagagaaacctgagagcaaaggggaagttttcccttacactcccttacattccacttggacttttgaaatcaacttctgttaccttcctttctgtatcactgaaactcctaccttgatttatgttcccttcttagcatttaccattatctctttctcgccacacacacacaaacacacacacacacacacaaaacttattaggttcatctctgccaccaaaatgtaaaacccacactaatagggtcttttctctatcttctttatcccaaggactatcactgtagcacacagcaatcactcaaatatttgtgggattgataaatgggaatacaactcatgcagactgcagtcatctcaaattaagtaaaagacaacagcctgaagccacattttcagtgaaatgatcatcacattctcaaaacacctttgacaacttttataaaatgggacttcggctaggcacggtggctcatgtctgcaatcccaacactttgggaggctgaggcaggaggatcacttgagcccaggagaatgaggccagcctgggcaacatacaggagactctgcctctacaaaaataattttttaattagctaggcgtggtggtgcatgcctgtggtcccagctactcgggaggctgagatgagaggatcacttgagaggttaaggctccagtgagccatgtttgtgccactgcactccagtccaggtaacaaagcaagaccctgtctttaaaaaacaaaaaatgtagtcccagctacttggagagctgaggtggtaggatcacttgagcccgggaggttgaggcttcagtgagcagagatcaagccaacctgggaacagagtgagatcctgtctccaaaaaaagaaaaggtgggagacttcacagacagttctgaaagcaaaggcacagggaaattacatatctgtgtgtgtcttctgggctctactacctactagttttctgaccttaagaccctttccaagcctgttttcctcctcacttccaaaatggttttacccaaggtaatggcagttttgaagcatgaataagacagaccaagtaaagtgcttagtactagatcgagacattacacagtactcaagaaatggtagctacttttattaccagcaggccgttagtttcacagaggaagaacagtttctacaggtggtgatctagtctccggttccacctttcactcttttctgtggccttgggcaaatcatttaatctgtctttgaagctatttcccacattcataaactacgtgggcaagtgaaaataattcaacccttttttcccaaatagaaaaatacttaagattttagcactgatccatcagagaagccacactggaaaacctacgcagaaactaaaacttggtaccattcactatcctcaagtttatagaattaaaaagtaacagacgtaataggtataaatactcagaaaacatgaacatgtctcatgtcaaataagaacagaaagttggtgtgtaaaaaatgtggattagctgtcaatatataaaacacagaatactgtttttaaaaagaattgtttatttaccgaacctggggcatattagatacaaccaattttaaatttacatcttttaaatcagttttgaagtgtttcacacacacaaaaaacttggcatgcaacagttgtcctaaggtgaaagtcacctcattaataaactgttgcaagtgttctcacccaaggtggaagtatggtttatcctgaacatgaaaacctgtaacaaatttaaattaattatataaaactcgttacttgtagttttgcccttgcaaagatccaaaaaaaaaaaaaaaagcacaagtaactaatatgtatcagtcacaacataatcctggatcatccccataccaaaaccggatgctcttttaattttaaacccatcatcagagaacaagagaaagtaatttcattttacacaaaacaagattcacatgtgccaaaaaagaaagacccaaaagaaacaaaaaccaaaaccctaatgctgacactgatggtcagtaccctgaacagtggcccaaaggccactgatcaaaaataaaatagtggctgtatatcaatgaaatgaaatccaagaagctttaaccctttggcatcagaaatccagatttttccaattatgtaaatgcttatttcttacatgccaagagtgggagaagtgaatgtgccaatgtggaaagaaaaaaagccaccactcactgggacacccagagaattggctttaacagacaattagggggttaggcagaaacccagaaatggttattagctgcttgtgtcatcaatttaagtggagatgactgagtcctaaggtacaatgtaaaaatgtatgtgggaaaatgtatgctgagtcgtagttttaaagcaaaacaagaaaacaaagtatgaaagtacccagcctggcagcatacacccaagtcagagagctctgccattaggacgggcagaaaccgtcaagattcatactgctgtttctcataaggactcaacaaaaatgaatctttagtgacttgaaccatagactgaaggaatccaaagaatgcagtcattttagtaaagtactatcaggctttgtgctgatttcctgaacaaactgcattatattatgaaaacaaaaggaaaagaagaaataataaaaactatactcccatatttcacttacagtgtttgagttcctggaaggacctatataatggaggcagcattcaaacaagaaattatgccaatcaactgtcaaattttcactataattttcctaaaaaggcgtttttcccccaatatctattaatctcaaagaaacataagttgtgaatgtacagttcagaaaataaaaatggagaaactaatgacattattatgaccaaggtgtttggtaaacagtgaattctgagttgggatcatcaggaagaggctttttaaacaactctccggacttcaaaaaatctcttcaggtagtagatctgtcccaatgtcatggcaactagaacaagagcttcaaagaaggaccaaaggaccactctgctgtttgtgttgtcgttgactgttgaggacaaaacaaacaaacaaatggctctgtgtattctctcccggacttccatgtattcctgttcgtgctttacagctgtcatcgccactgctagctcattgatcatttcttctagcttgttctggtgagatgctgt

SEQ ID NO: 2525 - DNA, 938 bp, Homo sapiens
agggagggagctgaggagcaacatgcttcttagatacatcagcggctgtaaccacagggctgagggggcctccttgctctggagggggtcttcgtccatccttggtgggggggggtgcccagccccttttcaggcctaagaacagtctctaagagggtcaggagaactgggcagccgctaggacagcgtactacaccccggacaggcaggtgagccacaggcttgtcacagaccacatacacacacacgcacacacacgcgcacacacacacacacacacacaaagagtgcaattgagagccttgggccaggacgctagaagatagggatgtagttgtcgattttggcgcggtggcgctgggcgatacattcagcgatccacacgatgttgcgacactcctgctccttgagcttcacgaaggcatagaagacaccaaagtggaactggttcaggaaggccaacttgttcagctttacctgtggacacgggcagatgtggtgtccaggtggccatggccacagagtcaggtctaaaccaccaggttggcctccctctgacaagcagaccctgcagactcacctcgtgctcaaagaatcggtcctccagcgtcttgtctccagggttgctacctgcaccctcgaagagcagcttgtactcctggccaggggggtggggggaagcacaagcatgagggttctgggtgggggtgcttggtgacaacacatccaaccgctgtcctgccagccggggcactcaccgggtagtaatcggccacgttcttgacctgttcatagtcgtcagcccgagccagctgcgccaggccctcagggtagagccgcccacagtgtggaaagagcttggcacggtcctctttggacagctctgtgccgaaagaattgatggtgatgatgaaggcgcggcggtctgcttcaaactg

SEQ ID NO: 2526 - DNA, 2286 bp, Homo sapiens
aattggctttgggagctgggcgcagtgactcatgcctgtaatcccagcactttgggaggctggggcaggtggatcacttgaggtcaggaggttgagaccagcctggccaagacggtgaaaccccgtgcctacaaaaaattagccgggtttggtgacacggcctgtagtcttagctactcgggaggctgaggcaggagaatcgcttgagcctgggagacaggttgcagtaagccaagatcacgccactgcactccagcttgagtgacagagtgagaccctgtctcaaaaaaaaaaggctttagaaggctttattggatgaaatggctgaaacttggatacagaatgtctagtattagacacctaaaaatctggattctttttggttgttgttttgagatggagttttgctctttcgcccaagctggagtgaagtggcgcgaccttggctcactgcaacatccacccccaggttcgagcgattctccttcctcagcctcctgagtagctgggattataagtgcccaccaccacgcccagctaatttttgtatctttagtagagatggggtttcgccatgtaggccaggctggtctcaaactcctgacctcaggtgatccacccactatggcctcccaaagtgctaggattacagatgtgagccaccgtgcctggccagaaaatctggattcttattcctagttcttcatttctgtcacatgcacttagttgacattacatctacatatattagctttttcctacatgagccatctatttacttagtaaccagtgttcttaatgaagtatttagtcttgggtttcttgtaaaatttctctgcattccttagacagtgtactatacatgaaatattcttgttgacctagtaatttatattattccatttaattcttaaacctatggcctttttattgagcacactcttaaatcattatttggcttgtaaacattcatctgaagtgtggctacaatcctctttaaataatctaggaaaaaagaaagataaagcttacattttcacagttttggctcttaaacacattccacaaatgccattaagaatttattttgttttaggccagtcatggtggctcatgcctgtaatcccagcaatttgggaggctgaggcaagaactgcttgagcccaggagtttgagactagcctgggcaacatagcaagaccctgtctctaccaaaaaaaaaaaagtttattttgttttagagtcatttaatgtgtttttatgcacaataatagtgggaggttgttttgttgcatttgtttgtttgttttgttttgttttgttttgctttccatgtgggaaaagttaacattggaactgtttctagtaaaagatttttttcaggctgggcacggtggctcatgcctgtaatcccaacactttgggagaccgagggagctggatcacctgaggtcaggagttcgagaccagcctggccaacatggaaaaactccatctccactaaaaatacaaaagtagcctggtgtggtggcacatgcctgtaatcccagctacttgggaagctgaggcaggagaatcacttgaacctgggaggtggaggttgcagtgagccaagatcacgccattgcactccagcctgggcaacaagagtgaaactccgtctcaaaaaaaaaaaaaaaaagatgtttttcatttttttcatgttatctatccaagcactgttccatggtcagcaagtcatatttcataatgtggattttccaaaataattattgaatacagctattctatggctacttttagtgtttttgtggtatgtggtgtgggagtgtttatggaattaccagtatcttaaattttcaaaggaaccttggaagtctatcactctaaatgaaagtctgtcactctacatgaattatgtgctcaaatttgaccaactcagtttaagacacaaaacagtaatttgaagaaggaaaaatgaagagagtttctagtttaatgggttaaatttttgttgttgcaatagtaagtttagtcttcttataatatttctaaatgaaaaatcataggtatttgttaccatgtgtgaagattagtttgttaaaagcaaaagtggtcgtgtgatatgctaaatgttaattactgattttatatgtttaaatcacgccaaacaaattatgtctgtgccatccagggtctgttgttaatctttttctgagtacttggattgggataaagggcttgtactatgcactttttattaatgaataaatagaaaacgttagt

SEQ ID NO: 2527 - DNA, 4487 bp, Homo sapiens
attggtttcctgcacagcacccgctgaaggcaggcccttccggctaccccgagaaaaggggaatctggcaggcgagtgcggcgcagctggccagtccctgtcgcccgcctggcagtacagagaccttttttttaaattattttttaaatttcgactttgataaactctaagtagccacgctattttaatgtcagccgttttactttgaccttattccttgtatccagccccataattggtcagaatcgtctagtgagctggtagtttcctcttgcaacattccgaatcactggtagtttccacctatttgtaaaagcccgagcaagtttcaaaagtgcagtattactcactacttaaaaaaaaagtccagaagatgtgagcaaaagcatgcaagagtgcagctccattagagggaactggaaatgcaaaggacgacgtttcaccacaaccaccgccttccaggctcaagcgattctcctgcctcagcctctccagtagctgggattacaggcatgcgccaccacgcgcggctaattttgtatttttagtagagacggggtgtctccatgtcggtcaggctggtctcccactcctgacctcaggtgatccgcccacctcggcctgccaaagtaccgcgattacaggcgtgagccgccgcgccggaccaaaaacagtcctttaggtaaaactgagttactcaacaaaaccaaaccaagacaaattatgccccattattaaaactaataggcaaaggggagtagagggactggagcaatcaaacagtgttagtactaaaactagatagtgtgatgccaaaggatatcaggaactctagatatgggcactctaattgctaaaaggttaagcaggaggtggcaggaggctgcacattgagatacaccatcagtagttcaaacattcgttactctagctttttactagggctcatgaggttttattttaaaatcaagagaaaacaacaatcaaatatgtcttcatacaaacgcagcagaaaaatacaaatcctaatgttttaaatggagaaagtgggccaccaaggcaaaagtgccataatgcagtcctgcttttttttttttagcattcaaacaaattttacaccagaactaaactatttcttaatagaaaaaatagtaactaggagcactacattctgtgtacatacttttctttagtatgtaatctaaaaatttaatagcacataaaaaactgggctaactttcaaaaatacccctaaagtatttaagtatatgtaaaataatggagtctgattctgaacaaataattttctaataaaaatttcaaagttcaatggttcccctaagtcttaaagaatattatctacaaattatcagtagcattccctccttttctgagctgctgtccacactattatacaacagaaactactgcaccgcaatcacatgggcaggaagaggcaagggctagacagaaaagactgcatcaaactcacgtggtgagataaaagtcattatttcactgtccataatagtttctgcctagtagtgaactctcacatagtggccaattatacgaagatcaacccactaattgaacatagtcacacacacacactgaaggttactatgaagaaattcagtcaaaagcagacacttaacacagggctttaatgtaacaccatttagtaacatgacaaattgaaaagtgaggagtactttgtggataagaaaatggaggaacacatctgatggagagtgggcatttgacaacaatggaacaggtaaccagcatgtaaaatcaaaatataagtgtctttttaagagctgaaagctgctgctggtcattcattaatgtgtcagacatttaatcaggatgctggaccttcaaaataactgaaaaaagaaccaagaaaaggcgtttttgttttcaacaaactttactaaataaccctggaaaggcaatgaacgatctgacaatttaagctctaatgatttaaagctcagctagaagaaagtgaggcatgacatatactgtcaacggagggtgaaggaggcagatttctggaaatgcaatgatcccacacatttgcttcaaggagaaacctgcagacatattttcaggtcttgctaagtaacaactgtttatttgtaatcaatacatttgggaaagtctgctatgtagctaaggtcactgtgaccacagaacaacagatgaaaaggaaaaagcactgaacagcaagaaaaatacatcccatcctcaaaagaatttaagtgaacaaactttaaaaagaaaaaaaaatagatacagccttcatcttttacaaatatatttccttcccaatatcttcccaatataaacactgtggagtgtttatatattcagtgcaagaaacagtatcatcggtacatttgaaagcctctaaagaacaactgaagctaaaataatatctaactctgaatacgtttcagtgtagagtaataataacattattacactatagtggtgtgggagaggctctgatagcacccatctgcatcccgcatgaaaaaacaaacctaagatcacttttttaaaaattctacaagccacgttaaaaaaaaatttgaacaggactgctttattgtgtaatttatgacacaactgttacatgaattgcaaatgaaggcttaaaatatatagcagctacaaaaaaaatcagataactcatgcttcatgtcactcctcccacaaatacttctagtctgttcaactgcagtcaattctgtattggtttgcctgtgaattagacttctcaagtctttacacagagtaaaagaaatggataaaaatcaaagtatttttctgtactttgtatcaatgtattctattctgtactttgaccctggaaaggtatgggtctgcttaaaagaaagaagaaacatacacgtaatcacaataaagcttaacattatgcagggcttataatcattttcagcaacggactgcaagctgcactgtgaagaaaatgcatagcagaggagaaagctggggatctgaggaaataggtaaggaaaacagtgtcaacacacagtggaagaagtgatgaagacatctattccggagctcacgtgccatgccctgctagcattccttaacaagccacctgctccagaaggccacagcctgaccctcccaagtggaatataaatgcccaagtgccacatgaagccacctcctccactacctaaaaagctgtctgggaactgagctacagaacacacacactttctggtctaacaaacatcaagtgaaagaattttttcttatatatctatttttaatacaacttaaacgcaacttttatatgaatttgggcttctattcagtccctctcctcaatttccttaggaggaactcaataatggaagcaaacaaaacaagattctaaccacaaatgactgcactttaaacgtaattatcaattttgagggacagaggtgtgaatgttttacaataccaaactttaaaaaaaatctattataaaaactgcaactcatctccctaacatttttaaatggtggtattatgtttgcacaaacagattaatacattaaattaagccaagatcttaaagactggcaaagttctatcattctattttaaaaacaaagatgttaaaaaaaaaaaagttagtttgcttcatgttacatttcacaaccattatgttaaatgttttcttttctacagaaacagggtcctttatatcacaactgcaagtatttactgctagatgtttaaagttacacagactagtgttcaactggagcctgctgatggtgatgtcttgaagttttctgaatgtcaacctaaggtgtgccaggtcctctcctaggaccactcttgcaggggaggagggagaagaaatcacagatcaagctcttaagattgtttcactctcttcgtggctttctgtttcttggtgatctgttcaaaatttcatcctcctattgattgaaaagaaattcattataattagcacatttaaaaaataataaaagttcaccatattttcaagatcagccagactgagggtaacttatttgaggaaaaaaatgaggaaaatgatgagaagaaaatgcaccaagaagaatggttgtctcagaggtggtggaattatgcctactctaattcagtttagtctttattgttttctataaacatacacttttctcaatctaacccataaacattttcttaaaaaaggatcagacactgtgatttcttaatcttgcttaatcccaaacaatctactggcctatggcacactagccccattctgaggataagaaaccaaggattcatgaagatggaaggctatccaagtagactgactccaaggctgctgctctgtactctatcacaagttgctaagattgtaaattaccctatgaaaatattccctttttttaaatgcaccagcaactttttaacgtgtgagggagtttggg

SEQ ID NO: 2528 - DNA, 1241 bp, Homo sapiens
acattgtaactggctaatgagcaagaaattgttgcaaggaagatgtctttagaaggtgattaggccatgagggctctgccctctggatttgtgcattatttcggaggccgaggtgggcagatcacctgaggtcaggagtttaagaccagcctggccaacatggtaaaaccccatctctattaaagtaataaaattttagggttctccaaagaaacagaaccaataggatatgttatgaggttatcacaagtttactgaactttaagcagtaagtctcccacagcatctaacagaatatctcatacatatagcaaaccctccatatgtgttaaattatcaaaataaaatttcaaaacctaatgccattttccttcacttgataccacttcctataatttaatattcactcacatttaaaacaataacagcaataacacaatttataaatatccttggagctacattaaaagccacttacattctattacaacatccaatgattattgaatagccaaaggtgcctaacagattaagttgttataattatagaaggcaagtatcttgcaactgattacattaatttctatttcccagtgctgctcttttccaaaatatttctgggaaatcttaaatagcttttctcttcttgcctgaatatgtaaaattatttctaatacttttaatcctgaggatttataaccaaacattttgatcctttttaacatagaaacatgtggctttaaattcacaatttgtcagcagagtgttcataatgaaacttctcacaaatttgtaaaagaaggcgctaatgtaaacatattagttgtcaggtcagattagtagctctggttgttacgaataatacagtaggttaagcaatcctaaaataaatatacttctaaattttgaacatttttcctcttcctttcacagattttcataatttgttcactggtgtatggctcctactactactgcccaagatatttcacatttagtcttcatcaagatgaaatttagatttttcaaaaacaatgaccagtatatgtttttgatctaatttaccaaatgattatacactaatttgatagtggagatgatacatgagtaaaatattgttaaaatacaatgtatagaatagatgtgtttataattaaaatctttttttttttttgaggtggagtttcactcttgttgcccaggctggagtgcaatggtgcaagctcggctcactgcaacct

SEQ ID NO: 2529 - DNA, 1114 bp, Homo sapiens
caaactatcgctgaggacctggtcgtgaccaagtataagatggagggtgacatcgccaacaggggtacttcggtccttggtggaagcatctagctcaggtgtgtcggtactgagcctgtgtgagaaaggtgatgccgtgattatggaagaaacagggaaaatcttcaagaaagaaaaggaaatgaagaaaggtattgcttttcccaccagcatttcagtaaataactgtgtatgtcacttctcccctttgaagagcaaccaggattatattctcaaggaaggtgacttggtaaaaattgaacttggggtccatgtggatggcttcatcgctaatgtagctcatacttttgtggttgatgtagctcaggggaccaagtaacagggaggaaggcagatgttattaaggcagctcacctttgtgctgaagctgccctacgcctggtcaaacctggaaatcagaacacacaagtgacacaagcctggaacaaagttgcccactcatttaactgcacgccagtagaaggtatgctgtcacaccagttgaagcagcatgtcattgatggagaaaaaaccattatccagaatcccacagaccagcagaagaaggaccatgaaaaagctgaatttgacatacataaagtgtatgctgtggatgttcttgtcagctcaggagagggcaagcccaaggatgcaggacagagaaccactatttacaaacaagacccttctaaacagtatggactgaaaatgaaaacttcacgtgccttcttcagtgaggtggaaacgcgttttgatgccatgccgtttactttaagagcatttgaagatgagaagaaggctcagatgggtgtggtggagtgcgccaaacatgaactgctgcaaccatttaatgttctctatgagaaggagggtgaatttgttgcccagtttaaatttacagttctgctcatgcccagtggccccatgcggataaccagtggtcccttcgagcctgacctctgcaagtctgagatggaggtccaggatgcagagctaaaggccctcctccagagttctacaagtcgaaaaacccagaaaaagaaaacaaagaaggcctccaagactgcagagaatg

SEQ ID NO: 2530 - DNA, 5339 bp, Homo sapiens
agttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgta

SEQ ID NO: 2531 - DNA, 1950 bp, Homo sapiens
gtggctcataagtgtctctaagttataccaaaagtttgagcacaacagtagtagcagaatgcttagaataaatgcttgacttttaagctgacttttggaaggaccatacccacatagaggcatcttttctgctgtggtaattttttaaattaatacattgctttaggattacatctcaaagtaaataaaaaaatcaatatttaatttgtttttttcctgcaaataaattaaatgctgggaccataatgattatttttgcatagtaatagctggtgaagaagttgttttaaaattaaattgccaaaagtattacctcttgaaaaatttattttcccaaagtttttcatatgtcatgaaacccctaatcttgacctttatgacacagtggcattacactgatgttggaagcatgtgtgagatctgtgccctggtcgggagtcatatgccttaaaaatgactgcgagtcagtgtgaagtagtataaagtggagtcctacgtgggaaaaagcaggctactgaggacaaaaacctcccaaccctccccaccttgttttccactgggaatgagaatttgatatgagaaacttcaaccttgcagaagtgtggatttccctctgaaatttaaatgtttcacacatttttgtaccttttgtaaccttgtggtatttactttcacatggctttttaaaaaattattttaatgaacttctatcacactatatgaatgatatgggggaaatactgaactgctcatatttccttttttggcaataaagcactgttatatgtaaatgtaagtgaaaaagaggttcaagactatacaacagcttatgtgtagtatatgttgacatccctaaggtattttgaaacatgaggtgacagacaaggacctcaaatttccagggaaatatttatttcacaacattaggagtgtagctcttcataatgaaatatcttctttctgctaaagattacaatttttcatttagggaactgtgaatattttctgtgaggtttacagaaactagtgtatccttttcactatgttgaaaagacaatctgaactttagctatttatatttcagtattaacacaccttcactgattgagagtcttgagcccttctctacttttataaagtgaatcctatttccaagtcatccatgtcttttgaagtctgtttcttatataagtatttattactttactgtttagcataaataggagacagaaaaggataataaactactaggtcctttattcctattaaaataaatttataaatcccttgaatcaactgaattctaagctttttgaagaggttgctgatgtagtgtgatcaaaagaatctaaggagaacctcctctccaaaatctgattggagctgttcaccctctcaaggacaagataaagattgacttcagagatatatcacatcaagctagaggaaaaaaaaaaaacctcaaataaaatttttcctcattcgaagggatccagggtatccttgggttatgtaggagggaatcatatttgttctaatttacctgaatgtacttgtgtgtgaatccaatcttgattctaaacaccaaatcttgtcaacagtagagaagtatagtaaggagttcctgttgtcaatcaaatgagggtgtgaaacatttagaatgctctgtgttacacttgaaccatgtataaatgtaacctgtgtatcttttttttaattagcttttctgaatttaaattatattgtttttctttgtattgttagcaaaatgcatcagaactggattttttttctcatctgaacataatataaaatttgaaagagtattgtgatattaagcactttaacatacatatcagacaaactgacgtgggtttttcaggtttgggagtacatttaaatatgacttttcatgctttgttctttacaaataaaactgtgggattgata

SEQ ID NO: 2532 - DNA, 5343 bp, Homo sapiens
agttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgtattaa

SEQ ID NO: 2533 - DNA, 1982 bp, Homo sapiens
aaacagctttcattaacggcatgtaggcacaggtccctttcccaaaagtggattgttagtagtagttcattcaacctttgttaaggggtagctttccagaatgtgacattgtcctcagaaagatagacataggcttaaacataatggacatcctaaataggaattttcagattgtttttgaagtgaaaagtgttttaatgtctttaaatggaattgcataactaatggtatttaagtattttacatgttgctaataactttgaatatgattgttgcaattttatggaacctgggtctatgggactgctttttaagcagtttaaaaaaggttttcaaagtttaaaagccaatcttagcatgtataatccttatgggattcttaagttttatcctatcttgtttttgctcaagaacgctttatcagtgacgtttgttagaattttgttttttgttttttttttttaaattgtttttgggctagaaatgagtttctctagttttatttgttctccctgagttggagttatgcaatgaatggcatttttgtggtaaaatactaatcctaaaatctgttaactcactgttcatttaagtagggaatatctgtatacattaatgactaggtaaaacaggaaatacattttgaatatacagcctaaaggcaggcagttacagggtttttgatttctccgattttatagggtgcaagttcccagtggcaggatgccctgctgtgtgactgactacactgtgtcctgagcagtggtaatttcaatcacctctcatcagtttggccagccctacaaccaccattcctagccctgtgttgcttgacaggatacctgtgcttgaatggacataaggaaaagtccttactttctccccaatttacctctcaatcttagttcttccagaacacacttccctttcacaatgcaaataaactgaaagtgagatttgatacatggaattttgagaccaaccaactaaccttacacataatttgagggattcctggattcttctagtgatactgaaaagcacacttgactaaagcatagtgttttttgtttgttatggaaatacggtatacgttcatttaaaaataaatggacatacaaattgcatctccttaggagatacattttatatacatttcggtgcgtttttttccagtatggatttctatttgtttctctcttcctcttgttttttctgtgtcactcttgtatgtcctcatatctttcatacctcttgtgtagtctctagaagcagaacacctaagtcctgggtctggataatgaaaccctcagtctctggggcctctgaaaataaggaagcattggagctattgccatgttgagtaatgggcttcctagaactattgtcatctatcctgccagtgttttatgttgtagctgtttttctttgacaggtgagttccagctatgttgttagtcatgatcctgccattattttctgtgttctgtaggatgtctccaggctacttaaacatattttatgagtttgcaataaaattgttgaatcttgtatgatcaagtcactcctctgctcagaaatccacagtgacttcttagtaagcccctacattatatgcatacttgtttttttcttaactttactcccacttctacctaacagggacctcaacttaagtctcttcagttcttcaaggcctggccttgttcctgattcctcaaaaaatcttgactctaaggcctattttattgtctgtctctgaatccctataaagcttcaagtctgtatgacattcttaacgccaaattatatattgtcttgtactgttcctagctggtacatgtatattagtcttgtctccctcatgagaatgtaagctccttaagggcagggaccatgtcttaatttttgtatccaccacagtgcctagcacagtgcttggcacatgggtgctgaataaatacctttgtttattgatcagc

SEQ ID NO: 2534 - DNA, 825 bp, Homo sapiens
gaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaacta

SEQ ID NO: 2535 - DNA, 230 bp, Homo sapiens
aatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaa

SEQ ID NO: 2536 - DNA, 292 bp, Homo sapiens
atgacttgggccaattacacgactgcaaagctagagctgccaacagggctccagggagcttggcttctgtagaagttctaaggaagcggtacgaactccacggcggtggggcgctaactagcagggacccctgcaagtgttggtcgggggcctcgagctgcctgagctgacacgaggggaggggtctgtgtagccaacaggtgaccgaagggcttgcctgcccacagcttacttggccaaggggtttctgaagttcctgccggcaaacttagccttgctgcccaccctcctt

SEQ ID NO: 2537 - DNA, 846 bp, Homo sapiens
ccagaggcataattttttcaaataatttttagttacagaataaattctaactttttaaagtctaaagctacataaaactcaaagcaatctatttttctacctgaggtcaaaatgactttcctttttcctaactaaacataattcttagcattgaggtaaatctgaattcatgtggtatgctttgtcaaacttttccaaaaaattttaagccctgctttagagagaaattctcatgttacacatatatatttacatattttttcttcaaagactaatgacaatgtatgatgttaataggcctgtaatggaaccatgatactactaataatatgaaataaaaagccactcatttatataaagtgttcctgaatggtgcaataagaaatgggatcacagatttatgtacatatatgaatcactaagagttcagaaattaagctcactttaagaaaactcagccaggcacagtggctcacgcctgtaatcccagtactttgggaggccaaggcgggagaattgcttgaaccagggaggcggaggttgcagtgagcccagatcgcgctattgcactccagcctggacaagagagcgagactctgactccaaaaaaaaaaaaaagaaagaaaactcattctatttttctctttggagcagaggttgcaaaactgtgatgcctaacaaaaacgttgtgtataaaagctccaaaaccaagcattagcctaaattggctataactgcaacttaaatcaaaaactatatccaactagatcttcgttgtggctatgcaactttttgctttgtggcctgaaggtttttactgaggtaacaacctcttatctcttgtcc

SEQ ID NO: 2538 - DNA, 946 bp, Homo sapiens
gggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgagtaagaagaaaaagagcaaagataagaagagaaaaagagaagatgaagaaacccagcttgatacgttggaatctggtgaacagtaacaaactttggtgaaatttcaggaaccatagccattgaaatggatgagggaacctatatacatgcactcgacaatggtctttttaccctgggagctccacacaaagaagaatcgccctgaaatctggctatggaaaatatcttggtataaattcagatgaacttgttgggcattcagatgcaattggaccaagagaacaatgggaaccagtctttcaaaatgggaaaatggctttgttggcctcaaatagctgctttattagatgcaatgaagcaggggacatagaagcaaaaagtaaaacagcaggagaagaagaaatgatcaagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacagagaaccaaattgaaagccgacagatactgcaaatgactggaatttttgtttctgccttatctttttgtgttttttttttctgaataaaatattcagaggaaatgctttta

SEQ ID NO: 2539 - DNA, 2875 bp, Homo sapiens
aaatcagggcacccagtggccgctgccaggctgagctatggagccagagcagctggaaacggcctcccgtgggccgagttaggcgagagagcctggtggtgaaaccgacctggggcccagccctatggagctcacagtctggtggggaagtctatgaaacaagtgtacagtcaccaattgtgataagctcaaaagagagaggtgtgaaccataggcgggaacagatgtgccatcgaaatttttccacctgagttgccgttttccagtatgaatatttttctgtgccacaaatccaaaagacattttggtgacaaacagcctataagaggacactcagcactttgggaggctgaggcggcagatcacttgaggtcaggagttcgagatcagcctggccaatatggaaaaatcccgtttctaactaaaaatacaaaaattagccaggcgtagtcgcggttgcctgtagtcccagctacttgggaggctgaggcaggagaatcacttgaacctgggaagtggaggttgcagtgagccaagattatgccactgcactccagcctgggcaagagagtgaaactctgtctgggaaaaaaaaaaagaagacactcagacttacaataactgacttttgctttattgtgtaatttacacaggacaaccccaaattccacacttcgtttttctcttctgccttcattattctttcaatatctacgtcaacagaaatcgtttctcccaataacatatgtggtttgatcctcagccaggacgcacaggccctacaagatcccagccctccaacacggacacctggaccctcccatttgactgcagccttgtctgtttgtaccggggctctgccctggtcctgtcacccctgagacgtccgtaaggtaggaatgccaaacaggatctgtgtgatgtgtcaactctgagtaaatacaagaggctgctaggagcccccagctgaggattgagaggcaggctgtgtctggttccatttcaaagaatgctgtgatgcattagcagcgtctgctatggcaacacccattagaagcacctggaaggggggttttgggaaacgggctcagaaaggagcaaggtgtgtccgttccattcttgccttaggtggctgttccgttacccaggctatgctgtctcagtggccaggtggctgaggaggaagtctgaaggccgcatagttgcaagtggcttccctagggcctgcaggggacagcataggcccaaagctagaggaagcttggaagggcgcccacgctgggtcctgcggggctctgcatactgcaggccaccatggcgctagctccttaccctctggagtctgtctcatccaggagaagacagctggctggcctcagagcgttacatgcaactcgggtgaaaacatttttacatgacacagacacacaatgggctttacctctggataaacttagaaactttccatccaaacgaaaagggtgtatcttctgtatgttgccaagaagcctaaactgagtacaaggacgatcttactttaatcaagttccagaatgagggtacacagcttcgaaaagcagtctgtagcagaagatgcaagggtgtgtgtagccatgtttccagaatataccaaaggaaacacacacaaccccagtgtggccttttgcgaaccctcgatgctgctccatactgggggcaggcggctacttcgtccagctgactttgggaatgtcgtaatgctccgtgagtgtgtccaggtgtctgttgaagtcctggggaggtggagtagaaggccggtgtcagcgcagacccaagtggggtactggggagaagtggcactgcccagccccacctctcccacatcctatctctcctgagccccctcctctcaaactcaccctgccaggtcttacagactcctgaaccctgggctcccctttgaataaccctggggaagtgtcacttctattaggtaaacttcccttctcgtcaacatgccaacagctccctctgccagctgatagcctctgggcccagctgggaccctgaatggctcagtctcccccactggacacggcgactcacctccactctctgcttgtgggttttggatgccttctttaggatcctttccatttgctggagagagaagagacatggaggtgagtttacaggctcaacacagcccaggctggcatggggtggaagatggagcctggccagactggctctcacatttagaacagctggaggtttcaggctctgtgccttgtccccctccctcaactccacccaggctggtccaacagggaacccaggtcacttgccagcttcgtgagtggcaggaaatgaaccagcaatgcctgagcgcgtacccatgagcagactctgctgggagctgtcggcatgcttcctgcatcctgaggaggctgttagcactcccagtttggaggaaaacaaagtcccagagcgggtttcaggaatgatgagaaagagagaggtaaagggtctgacatagagcaggtgctcaagtgacacttcccatcctgatgttagggctacaagaccaggatcaccatccccagggttattctgaaatatgcctcctgcaccatgacctgctctgatcctcacttcaaacactcaatgacacctggaaaggtcagtatctggtagcagctgggagtgtgggctgggcgcggtggctcatgcctgtaatcccagcactttgggaggctaaggcaggaggatagcttgagcccaggagttcaagactagcctgggcaacataaggagaccccaactctacaagaaaatcagctgattttggtggtgcacacctgtggtcccagctactcaagaggctggggtgaga

SEQ ID NO: 2540 - DNA, 3482 bp, Homo sapiens
ctggaaggtgggcgcttcccccagcgcccggcacagcccggaccccggtgtaaagtcgggcatctgcgcagtaaacatctggcctcggagctgtcctccgcgccttggctgccccagccaggggaaggatatgcggagggctctaagtcaaagcgggcgtttttgcgggtgtagacactgcggcgcctgggtctgcaggaggggcagattttcaggtggccgggacaggtgaaggcagagaggagtggctgtccacctggggaagcatcctgaaaacatcacacacagtggaccacgctttgccctcagagtgactgctccgacccggaaggagaggtcaacgacccctcaggacacaaagggtttcttaggttgttctgcgcagtcacatggcttccagaaccagaacgttcagctcttaaagtctgcacagaagaactgatagaatctgctcctttcaatggaatctgtgactgtttgggaaggatgtgcatggagaagggtctgatgaggctcctgatccaggcggtccacgtgcgttcagtgtgtttggaccctaggcacctctgtctattgctcggtcttgcgtacatagtccatagcttggcatcagcacagatcgatgcttagtgagcacaattaagaaaccaaactatggaaaattaaggacagtaacaaaagtatcatcaacaaaaatcaagcattttcctctttttgaaacaagaaaagcgcatcgtagaaaccaagattctgtacaatattctaacattatatgtacataaaattatattactcataactatattgaaaagtcttatttgtagaatatggctggcaacaaagaaagacccataccatttagcgtttgaagcagggcaggtagcaagagaacattagcaaagacacctttgtgcctggatacacaatcctgctactaagttatgtgactaaccagcacactctaagttctgtggtttgttcgttgtttcacattctagtagggaattctgcagcaggcgatgcgaaaaagaagacatggtcaaatgaaatgtgaaatgctgtttaaaatctgcatattggctatgataatgggtttgtgaatccaagttgcattggaagttcactcattctccattcattatgcatgcctccagtgatttaatgaatttcagcaggtggaaaagacagctttgaacagatcagatgggctgtgagtcagattcttgattctttttcctcatttggctcctgaatgttgcagaaaactggttttgtacactggggaaggagagagtgaagaccctccagttggttcctcagtcagctccgttcttggtgtcgctttcttgcaatttttttcctcccctggcccttcctgtgagggttaaaagggccatctccaagccaggtggagccccaatcccattgaccaagagggcaaggtatggggtcaccttctcatggaagccctcttcctaaaggagcccaaaggggacacctgcagagggcgggctgtgatctgtgtgtgaacttcaacaaaatctcaggttagtatttctccaatttcagttgaaccacgatgtggtatacactacaaatgcagattctggtgcccctctccaagagtcggcctcagttaaaaagggctcagatccaggaacctgttctgaacacgcacccaggcaattctgatgcaggcgagccacaggcccgctgtgaaaaaaaactgacttaatacatcaagtatagatctacaaattatttttagagagacttgaaaaactgaagattttaatgaaacattgcatagcacagattctcttcccaaatttcaccaatgtattcctttcaaaatgtggaattaaatggccaaaactcttagggagatgaaggtgagtgggaaggagggggttaatttaaaatctgtctgcttttcaaggtgaggggctcttctggatgtctggtcttggtgatgcaaacaagaccaatggcaacctcattttcttacccagaattcctactaaggttcactagaattacttatgaactcagaaatcagggctgggcatgctgggaatttatgtcacagcatataatttgggatacgtcagtaactcttcactatctgtttccatcatggcaagttttcacctgctaagaatgtgaggtatcagctctcctactcacaaaagccctagtggattacccaaggctacggttattcttccctgaacctccttgctgtttaaatgatatgagaatctaaaacagtgcccagtgtaggcagccttctaccaccagctaaaaacattcccagttcccactgaatcaccacttttaatcacatgatgaggaaaagaaattaactgcagatgggtggcattttatattgatggccatccaaaaaatttagaaagacaagtctcagatgaagatctcctcctggttcaaagatctcattttaaatctagaaagacagcaatagggcatcctaaattctacataacggagatctgttcaaagcagcgcaaccactgctgcagaaatgtactgattcccttctccgtggccatttcaccacttttgtacctatgaaaactagctgctcctccaggatcctttaattttctatgcctaaaccttaatcttaatttctgtttttctgactccagtgtgccctcaaaagtcactaattatttctagccctgattgttctcatcttccctgctgaaattcacatgggcaatggtgagggtcaaggttagggaaagaacagtcaaggttgaggtcagcagatgcagataagttgagtccaaggggacaggcagcggggcgggagggttagtaatttaagaagtcgatcccaactttgacactcttcgaagtggctatatcaatggctgtggctttgatctcggtgtccccgaactgcataagggtctggatctccctccgggcgggcaccgcagtgccactggtccctgtgagatccaggcggagcgtgccacacttcttcaccccgggatcagtgatgaagctgacgttgtcgtgctcagagctgtagatgttgatgacaatgaccagctgggagggcttggccggggtgtagctacgcttgaccagctcacccagagccacagactggtcggcagagatgaacttgtcaaagacgtcggtgcaccaccgagtgccatccttcaccagcagcttctcaggcgggtgcttgccctccacgtagcggttcagcacgcctaccccgtaggtgagcggcgaccggcgcaccttgatgaccgcggggtccaggccaaagaggacggcacccttgaggatggtgaggcccacgtcctgggggatgatgatccggcactggtccccaaaagcagcctgcaccgcctgctgcagcaggggcgcctcggcaaagccgcccaccagaaagaggaacttgacggtggacacctcgggcttctgaaacaggtcccctg

SEQ ID NO: 2541 - DNA, 24775 bp, Homo sapiens
gacttgtctctccagaatgactatcctccatttctaggtcccaaatcacaaccatgaagttgatcttatggtacttggttgtggcactttggtgcttcttcaaagatgtggaagccttactttaccgacaaaaatcagatggtaaaatagcagcaagcagatcaggtggcttctcttatggtagttcatcctctggtgacttggacagaaaaaagccactctttagcttggaatttggttctccaggagagactgaagacaagtccagacaacgtcaggatgctgggagtccaaagtcagaagacaccccagcaggtggcttttttaacagtagttcatcctccggtgactcagacaggacaaagccattctttagcttaggacttggtgctccaggaaaggctgaagacaagtccggagacagtcaggatgctggaggttcaaagtcagaagacaccccaccaggtggctttttttatggtagttcatcctctggtgactcagacaaaaaaaagccactctttagctttgaatttggtgctacaggagaggatgaagacaagtccagagaacgctgggatgctgggaattcaaggtcagaagacagcccagcagatagcaccaacacaagatatggtgctggctttagtagcagtggtgcctctctggatgtgggatttggttgggggatatctgatgaaaagggattggaagtcagtaaagctgatgggagagaaactagaggcagtggatctgctgggggtgaaaccatagtctttggacctgatgcaggtagctcagttggaactggttcttctggtttgaaacttggagcagggaaaggtgatgctgcatttggttttgaagtttctgattcgaattcatttggtgacactggcattagtagcaaaacagttgaaggaaatcaaacgagtagttctggaggatctgtttccattgatctaggtgataccagtttcagaagtgagaatcaatttgttggtggtggctctctaaattcgatatccaatttatgggattctggtcaagagggatttggaatcaatgaaattggagggaatggaatgagtggcagtgtatctgctgaggctggattcaaaggttttggatctgattcaagtagctcaggtgattcaagtgcaagaaatgggtttgaaaattctagtggtatctctgaagattcaggagtcatattggggtcatctgatcaacatgaagttgaactcagtagaactggtgggaatagaaagagaagcagtgaccctgatgaggctggaaacttgagtcctggatctgatgtcagtgactcaggaggaaacacttggtcttctgattctggaagtggtggaggaggtgtcacaagctcgtctgaatatagtacgtctggaccactcaatactccagaaaaaggatcccacattccagaagcaactccaaaatactcagaaacaaatgcaattattggtgaaatatctacctggagcaaaggagcatataaatctttcaacggccgcatctttttctttgaatcttcatgcccatacactttctgccgtcactgcattgaatctggaggggatttcaatattgagatcaaacgaaacaatgatagtgagattgaaaaaataacagttctaattgacaataacgacgtctctatttttggtgacaccattttagttaatggagaaagataccatataacaataagttgattcacataaaaaaatatggagaacataatgttctgaatagccgtagaggaatcctgactttaatgtgggacaaaaataacaaactctcgctcactcttcacaagcagtatccaacttgtggtctttgtggtaacttcaacagcactccagggcaagatattaatgagcacattgccaatagtaaaattcctggtgattgtcccaatgctgttggtaaaagctatgaagtttgtgaagatggaatacagcactgtaacaaaattattggaacctactttgagaaatgtggaaaggttgctgctctatccaatgactacaaaatgatctgcattgatgaatactgccaaactagagacaaaacatctacatgtgacacttattcagaactgtcccgcctctgtgcctcagatggtcctggcacctttgaatcctggcgaagcgactccgatgtggtttgtggaacacaaagatgtccagaacaacatatctacaaagaatgtggaccctccaaccctgcaacttgttctaatgtggctccttttcaagacagtgaatgtgtgagcggctgcacctgcccagaaggttatctgttggatgacattggagagaaaggaaaatgtgtattaaaagctgaatgtccctgtgaatccagtggaacagtgtatcagccaggagaagtccgagaaggtccttgtggttctcagtgcacatgccaagatgcaaagtggtcttgcaccgaagcattatgccctggaagatgtaaggtggaaggaagttcccttaccacctttgatggtgttaagtacaactttcctggaaactgccacttcctggccgttcacaatgaagattggtctattagtgttgagctccgtccgtgcccaagtggtcagacaggaacgtgcttaaatagcgttacacttctcttgaattcttctgttccagttgacaaatacgtattcaacagtgatggaacagtcacaaatgacaagattagaaatcaaggttattactattcagataaaatacagatattcaatgcatcttcctcataccttcaagtagaaacatactttcatgtgaaactacaaatacaaattgttcctgtgatgcaattgtatgtttctatgccacccaaccaattcacagacactgtgggactctgtggttcctacaacaacaaagcagaggatgatttcatgtcaagtcagaatatattggagaagacatctcaggcatttgctaactcttgggaaatgatgtcctgtcctaaaggaaacccctcttcatgtattagtatagaaaaagaaaaatttgctgaaaggcactgtggaattcttcttgattcaagtgggcctttggcttcctgccacccaattgtgaaccctaaaccctatcatgaggaatgcaaaaaatatacttgcacttgtgaaaacagtcaggactgcctatgtacaattttaggcaactatgtgaaagcgtgtgctgagaaggaaacatacatagtgggatggagaactggcctatgtgaacattcttgcccaagtggcctagtgttcaagtacaatgtaaaagcctgtaatagttcttgccgatccttgtcagaaagagataggagctgtgatgtagaagatgttccagttgatggatgcacctgccctgatgcaatgtaccagaataatgaaggaaactgtgtactgaaatctcagtgtgactgttacataaacgacgaggtcatgcaaccaggcaaactcatccatattgatgacaataaatgcgtctgtcgggatggaattcttctttgccagattcccattgatttaaccctacaaaattgttctggaggggctgagtatgtagactgcagtgatcccaaggcacagagaagaaccaacagaacatgcagtactcggaacatacctgtttttgatgagaacttgccttgcaaacgtgggtgcttttgtccagaaggaatggttcgaaattctaaagggatatgtgtctttcctaatgactgtccatgctcttttggtggacgagaatatgatgaaggaagtgtcacttctgttggctgcaatgaatgtacctgcattaaagggtcttggagttgtacccaaaatgaatgtcaaaccatctgccacatctatggggaaggtcatgttagaacttttgatgggaagagttacagttttgacggtctctgccagtattcatttcttgaggattattgtggtcatgaaaatggcacatttcgtattttaacggagagtgttccatgctgtgaagatgggctaacgtgctcaagaaaaattatagttgcttttcaggatcagaatattgtcttgcaagacggtaaagtaacagcagtcaaatctacagaaagtaagaaatgtgaactcaatgcaaatgcatactccatacatactgttggcctgtacttaattctgaaatttcaaaatggaataatcgtgatttgggacaaaaatacaagactgtctgttattctggatccaaactggaatggcaaagtgtgtggtctttgtggaaataacaatggtgatctcaaggatgatttcacaacaagatactcttcagtagcttctggagcactggaatttgggaatagttggaaaacaagccaagaatgttcagatacagtggctcagactttcccatgtgattcaaacccatactgtaaagcctgggctgtgcggaaatgtgagatcctcagagacagcaccttcagagactgccacaacaaggttgaccccagtgcttaccatgatgtgtgcattgaagaagcctgtgcatgtgacatggaggggaagtacctgggattctgcactgccgtggctatgtacgcagaggcgtgtagtgcagttggagtctgtgtctcatggagaaaaccaaatctgtgtcctgtctactgtgattactacaatgcgcctggggaatgcagatggcattatgaaccttgtggcacagtgactgcaaaaacatgcaaagatcagctcgttggccagaaattttcttcacttttagaaggttgttatgctaagtgcccagatagtgctccttacttggatgagaacaccatgaaatgtgtcagtttatctgagtgcagctgtttctataatgatgtcataccagcagggggagtgattgaagataattgtggaagaacatgctactgcattgcagggcagttggagtgcagtgaaactgctcctaccaattcaacatttgcagtttccactacaacagctaccaccatattaagcaccggagcagcaattacactggttaccggtggcccaagcacagcagcatccattccagcgattacaacatcaagcagtgaaacaacaggaacaactctaggtcctctcaccgaaccttttactacaggcattactgaaacttcagttcccatcatctcaacatctggaaatgcaggcatgacaggagtagtgagccccaccgtcactggtgcttcaggcatggcaggaacaactggaggagtggatgcagccaccactggagctgctagtgaaaatacatctgagagagcaggcacaccgagggtatctggagaaacccctgcagtcggaggtggcagtacccctggagaagcaggccctggagccacagtttctggaagtacaggagtttctgcaggctccatcactgccagccctggagcctcagccacaagctctgaaagcagcaaatcaggaactactggaccctcagtgggtggaaaaactggagccacaagcagtgaagcgacatcatctgaaggcatgtcaggtgtaacaggacagtctcttggatctactgctggatctgacagtgaaatcacagctaaaacatctttcactggttccagtccacctgggaaactcaccaggccaagcccgggctcacctggtcactttagtggtggaacaactgaatggggaaatgtagccaccactggagctgctggtgaaaacacttctggagcattgggttcaacagaagggtctgtggaagccaccaccagcgcaggcagtggaaacacagctggaacatcaggtactggggacactggccctggtaacacagcagtctcaggcacacctgtggtatcacctggagcaactcctggagctccaggtagcagcacccctggggaagcagacattggaaacaccagttttggaaaatcagggaccccaacagtatctgctgcctcaactaccagtagccctgtgagtaaacacaccgatgcagcctcagccacagcagtgacaatctctggaagcaaaccaggtacacctggaacaccaggtggtgcaactagtggaggcaaaattacatctggatggtccagcagtggcaccagcacgggcgcttcaaatacaccaggggcaacaggatcatcgaccggacagacagacacaagtggaccatcagctaaagtaacagggaattatggacaatcatctgaaataccagggacaattaaatcatcatctgatgtttcagggacaatggggcaatcagatacaacatctggaccatcagttgcagtgacaaggacttctgaacaatcgtcaggagtcacggtggcatctgaaccatcagttggagtatcagggacaactggaccattagctgaaatatcagggacaaccagaccattagtttcagggttaaggacaactggatcatcagctgaaggatcagggacaactggaccttcatcaagagaatcagtgacaactagaccattagctgaaggttcagggacaagtggacaatcggttacaggatcaagagcaactggattatcagctacagaattagggacaactgtgtcttttactggaggattaggtacaagtagatcatctgctagagaaacaaggacaactggaccatcagctgacgggtcaggaacaactggaccatctgttgtgagatcagggacaactagattatcagttggagtgacaagagcaactgaatcatcacctggagtgacaggaacaactacaccatcagctgaagaatccaggacaacaggaccatctgttctagtgacaggaacaactggacaatcaggccaaggatcagggacaactggaaaatcttttatagaatcaggaccatctgttgtaggatcagggacaactggaccaacatctgcaggattaggaacaactgcaccatcaaccagaagatcaagcacaacaaaaccatcagttggaagaactgggacaactggacaatcaggtgcagaatcaggaacaactgaaccatcagctagagtggcaggtgtaactggaacatcagctgaagtatcaggaagaattgaaccatcagctacagaatcaagtacaagtagaccactaggtgaaacaacagggacaactataccatcaatggaaggatcagaggcaactggaccatctgtcattggatcagaaacaactagactatcagttataggatcagggacaactggaacttcatctggaggttcaggtgcaacaagatcatcaggtggaggaatggggacaactggacaatcaactgcaagatcagaaacaactggaccactttttggattgacaggaacatttgggcaatctgctacagtgactgggacatcttcaaattcagctggagtgacaacacctgaaaaatcacctggagtggcaatgacaacaggactgttggttgaaggatcagctacaactcaaccacgtattttagaatcagaaacaactgaatcatcagctggagtgatagtgacatctggacaatcagccagagtgactggggcaactggaccatcagctggagagacaggaacaactgaaccatcaactgaaggatcagttgcagctgtattatttgttattggatcagaaacaactagaccattagatataggatcagggacaactggaactttatctggaggttcaagtacaacaagatcatcagatggaacaacagggacaaccagaaaatcaactgcaagatcagaaacaactggactttctggattgacaggaacatctgggcaattggctggagtgactgggacatcttcaaaatcagctggagtaacagtgacatctgaaaaatcagctggagttgcagtgataacaggatcatttgttgaaagaccagtcacaactggaccacctcttttagaatcagagacaactagaccatcaggtggagtaacagtgacatctggacaatcagccagagtgactgaaacagttggagcatcagctggagtgacaggaacaactggaccatcaactgaaggatcaggggcaactggaccatctgttgtgggatcaggaacaactagaccattagctggtgaatcaggtacaactgagtcatcagctggagtgacagggacaaggccatcatcatcaagagaatcagcaacaactggaccatcagatgaaggatcaggaacaactggactatcagctggagtgacagtgacatctggacaatcagttagaaagactgggacaactggagcaccagctggagttacagaaacaacaagaccatctgttgtcaaatcagggacaactggaccatctgttataggaacgaggacaactggaacttcatcaggaggatcaggtgcaacaagatcatcaggtggagaaacagagacaactggccaatcagctgtaaaatcagggacaacagaatcatttactaggttgacaagaacatctgggcaatcagctggaatgactgggacatctgcacaatcagctggagtggcactaacaagtccttttgttgaaggattagtgacaactggatcatctactgtaggattagagacaactagaccttcagctgtaggatcaggaaaaactggacctcctgttgtaaaagcacagacaactggaccatcagctggagtgacagtgacatccggacaatcagctagaatgactggggcaagtggaccatcagtaggagtgacaggaacaactggaccagcaagtaaaggattagggacaattagaccatctgttgtaggattagagactactgaactatcagctgaaggatcagggacaactggaccacctattgtaggagagacaactgtaccatcagctggagtgacagttacatctggatactcagatagagtgactggggcaactgaaccattggctggagtaacaggaaccattaaaccatctgttgcaggatcagtgacaactggaccatctgttacaggagtagagacaactgcaaaaactacatctggaggattaagtacaactatatcgtcagttggaggaacagggaccactggacaatcacctgaaagatcagggacaacaggaccatttactggattgacagggacatctgcacaatcagctggagtcacaatgacatctatccaatcagctggagtgctagtaacaacaggactaaatgttgatggcttagggacaactggaaaagctcttataggatcaggaacaactggattatcagctgaagctacagggacaattggaccatcaactgaaggattagagaaaactggaccatctattactggatcaggaacaaccagaccattagttacagaatcatggacagctggaacttcatctggaggacatagtacaacaagtccatcagttagaggaacagagacaactggacaatcagctgcagaatcagtgacaacagggccagttacaggatacacagaaacctctggtccatcagctggagtgacagtgacacctcggcaatcacctacagtgactcagacaactggatcatcagctgcagtatcagggacaactgtacaatctcttacagtatcagggaccactagaccatcatctggacaaacagaaataactggatcgtcagttaaagaatcagggacaactgaatcatcagctgtaaggtcagggactactggaccaacagctggagtgacaggtacaaatggaccatcatcagctggagtgacagggataactggatcatcacctggagtgacagggacaactggatcatcacctggagtgacagggacaactggatcatctgcaagatcagggacaagtataccatcagttggaaaaacaggaacgactagaacatcagttgaagaatcaaggacaactagaccatcagctggaataacaggtacaaatggactatcagctgaagtgacagggacaactggaccattagctggagtgacagggacaactggaccatcagctggagtgacaaggacaactggactgtcagctggagagacagggacaactggactatcacctggagtgacaaggacaacaagatcatcagctgggctaacagggaaaacaggactatcagctggggtgacagggaaaactggactgtcagctgaagtgacagggacaactagactatcagctggagtgacagggacaactggaccatcacctggagtaacaggtacaactggaacaccagctggggttacagggacaactgaactatcagctggagtgacagggaaaactggactatcatctgaagtgacagaaacaactggattatcatatggggtgaaaaggacaattggactatcagctgggtcgacagggacaagtggacaatcagctggagtggcagggacaactacactatcagctgaagtgacagggacaactagaccatcagctggggtaacagggacaacaggactatcagctgaagtgacagagataactggaatatcagctgtggtgacagggacaactggaccatcagctggggtgacagagacaactggatcatcagctggagtggcagggacaacaagactatcagctggagtgacagggataactggactatcagctggagtgacagggacaactggactgtcaactgaagtgacagggacaactggaccatcagctggggcgacagggacaactggactatcagttggagtgactgggataactgggctatcagatgtagtgacagagacaactggatcatctgcaagatcagggacaggtataccatcagttggagaaacaagaacaactagcacatcagttgaagaatcaaggacaactagaccatcagctggaataatgggtacaaatggactaccagctgaagtgacagggacaactgaaccattagctggagggacagggacaactggaatattagccggggtgacagggacaactggactatcagctggggagacagggaaaattggatcatcagctggggtgacagggaaaactggatcatcagcaagagtgacaggaaaaactggaccatcagcagaagtaacagggaaaactggactatcagctggagtgacggggacaactggactatcacctggagtgacagggacaagtggactatcagctgaagtgacagggacaactggcccatcagctgaagctacagggctacctggagtatcagctggggtgacagggacaactggatcactagctggagggacagggacaattggactatcagctggggtgacagggacaactggatcatcagctggggtgacagggacaactggactatcagctggggtgacagggatagctggactctcagctggggtgacagggataactggaccatcagctggagtgacagggacaactacagtatcagctggagtaacagggacaactggactatcagctgaagcaacagagataactggactatcagctggggtgacagggacaactggactatctgctggggtgacagagacaattagactatcagctggggtgacagggacaattagatcatcagctggggtaacagggataactggactatcagctggagtgacagggacaactggaccatcagctggtgtgacagggtcaactggactattagctggggtgacagagacaactggacagtcagctaaagtgacagggacaactggacaatctgtcggagtgacagggacaactagatcatcaggtggagtgacagggataactggactatcagctggagtgacagggacaaatggactatcagctgtgacaggaatgactggactatcagctgaggtgacagggacaactggactatcagttggggtgacagggatagctggactctcagctggcgtgacagggataactggaccatcagctggaataacagggacaactaccatatcagctggagtaacagggacaagtggactatcagctgaagcaacagggataactggactatcggctggggtgacagggaaaactggactatctgctggagtgacagagacaattggactatcagctgaagcgacagggacaattggatcatcacctggggtgacagggacaactggatcatcaactggggtgacagggataactggattatcagctggagtgacagggacaactggattgtcaactgaagtgacaggaacaactggaccatcagctggggtgacaaggactactggactatcagctggagtgactgggataactgggctatcagctatagtgacagagacaactggatcatccgcaagatcagggacaagtatcccatcagttggagaaacaggaacaactagaacatcagttgaagaatcaaggacaactagaccatcagctggaataacgggtacaaatggactatcagctgaagtgacggacaattggaccattagctggagggacagggacaactggactatcagctggggtgacaggaacagttggatcatcagctgtggtaacagggacaactggactatcagctggagtcacagggacaactggaccatcagctgaagagacaggggcaactggaccatcagccgaagtgacagagacaactggaccatcagctggggtgacagggacaggtagactatcagctgaagtgacagggacaactggcccatcagctgaagtaacagggctacctggagaatcagctgaggtgacagggacaattggatcaccagctggagtgacagggacaactcagctatcagctgtggtgacagggataactggactatcagctgaggtgacagggacaactggactatcagctggggtgacagggataactggactatcagctgaggtgacaaggacaactggactatcagctggggtgacagggacaattggactatcagctggggtgacagggacaaccagaccatcagctggagtgacagggacaactggacaatcagctgaagtgacagggacaactgaaccatcagctgggttgacagagacaactggatcatcaactggggtgacaggggcaactggaccattagctggagtgacagggacaactggaatatcaactgaagtgacagggacaactggaccatcagctagggtgacagggacaactgtactatcagctggagtgactgggataactgggctatcagctatagtgacagagacaactggatcatctgcaagatcagggacaagtacaccatcagttggagaaacaggaacaactagaacatcggttgaagaatcaagggcaaccagaccatcagcaggaataacaggtacaaatggacaatcagctgaagtgacatggataactggaccattagctggagtgacagggacaactggaatatcagctggggtgacagggacaactggactgtcagctggggtgacagggactattggatcatcagctgtggtgacaggtataaatggactatcagcaggagtgacagggacaactggaccatcagctgaagagacaggggcaactggaccatcagctgaagtcacagggacaactggaccatcagctgaagagacaggggcaactggaccatcagctgaagtcacagggacaactggaccatcaggtggagtgacagggacaaatggactatcagctgaagtgacaggaacaactggcccatcagctgaagtgacagggctacctggagtatcagctggggtgacagggacaattggatcaccagctgcagtgacagggacaattcggccatcagctgtggtgacagggataactggcctatcagctgaggtgacagggacaactggactatcagcttgggtgacagggatagctggactctcagctggggtgacagagacaattggatcatcagctggggtgacaggtacaaatggactatcagctgaagcaacagggacaactggaccatcagctggagtgacagggacaactggactatcagctggggtgacagggacagctggactatcagctagggtgacagagagtacaggactatcagctggggtgacagggacaactggactatcagcaggagtgacagggacaactggaccatcagctggaataacaggtacaaatggactatcagctgaagtgacagggacaactggaccattagctggagtgacagggacaattggactatcagctggggtgacagggatagctggactctcagctggggtaacagagagtactggactatcagctggggtgacagggacaattagatcatcagctgtggtgacaggtataaatggactatcagcaggagtgacagggaccactggaccatcagctgaagagacaggggcaactggaccatcagctgaagtcacagggacaactggaccatcaggtggagtgacagggacaagtggaatatcagctgaagtgacaggaacaactggcccatcagctgaagtgacagggctacctggagtatcagctggggtgacagggacaattggatcaccagctgcagtgacagggacaactcggccatcagctgtggtgacagggataagtggactatcagctgaggtgacagggacaactggactatcagctggggtgacagagacaattggatcatcagctggggtgacaggtacaaatggactatcagctgaagcaacagagacaaccggaccatcagctggagttacagggacaacaggactatcagctggggtgacagggacaactggaccatcagctggaatagcaggtacaaatggactatcagctggggtgacagggacaactggactatcagctagggtgacagagagtactggactatcagctggggtgacagggacaattggatcatcagctgtggtgacagagacaactagactttcatctggagtcacagggacaattggaccatcagctgaagagacaggggcaactggactatcagcagaagtgacagggacaactggatcattagctgaagtgacagggacaactgggctatcagctggggtgacagggacaattggatcatcagctgtggtgacagggacaactggactatcagctggaataacaggtacaaatggactatcagctgaagtgacagggacagctggaccattagctggagtgacagggacaactggactatcagctggggtgacagggacaactggactatcagctggggtgacagagacaactggacaatcagctggggtgacagagagtactggactatcacctggggtgacagggacaattggatcatcggctgtggtgacagggataaagggactatcagcaggagtgacagggaccactggaccatcagctgaagagacaggggcaactggaccatcagctgaagtcacagggacaactggaccatcgggtggagtgacagggacaagtgtactatcagttgaagtgacaggaacaactggcccatcagctgaagtgacagggctacctggagtatcagctgggttgacagggacaattggatcaccagctgcagtgagagggacaacttggccatcagctgtggtgacagggataagtggactatcaggtgaggtgacagggacaactggactatcagctggggtgacagggataggtggactctcagctggggtgacagggacaattggatcatcagctggggtgacaggtacaaatgcactatcagctgaagcaacagggacaactggaccatcagctggagtgacagggacaactggactatcagctggggtgacagggacaactggactatcagctggggtgacagggacaattagatcatcagctgtggtgacagagacaactggactatcagcaggagtgacagggacaactggaccatcagctggaatagcaggtacaaatggactatcagctgaagtgacagggacaactggactatcagctgggatgacagggacaactggactatcagctagggtgacagagagtactggactatcagctggggtgacagggacaattggatcatcagctgtggtgacagagacaactagactatcagctggagtcacagggacaattggaccatcagctgaagagacaggggcaactggactatcagcagaagtgacaaggacaactggatcattagctggagtgacagggacaactggaccatcagctgtagtgacagggaaaactgaactatcagcagaagtgacagggacaactgaactatcagctgaggtgacagagaaaactggaccatcagcagaagtgacagggaaaactgggctatcagctggagtgatggagacaactggaccatcagctgaagtgacagggacaactggatcatcagctggggtgacaggcacaactggaccatcagctggagtgacagggacaactggcccatcagctgaagcgacagggctacctggagtatcagctggggtgacagggacaattggatcaccagctggagtgacagggacagctcggctatcagctgtggtgacagggataagtggactatcagctgaggtgacagggacaactggactatcaactggggtgacagggatagctggacactcagctgcggtgacagggataactagaccatcagctggagtgacagggacaaccacagtatcagctggagtaacagggacaattggactatcagctgaagcaacagggataactctaccatcagctggggtgacagagacaactggactatctgctggagtgacagaaacaattggactatcagctggggtgacagggacaattggatcatcagctggggtgacagagataactggactatcagctggagtgacagggacaactggaccatcagctggtgtgacagggtcaactgtactatcagctggggtgacagcgacaactggacaatctgttggagtaacagggacaactggaccatcagctggtgtgacagggacaactggactatcagctggggtgacagggatagctggactctcagctggggtgacagggataactggaccatcagctggagtgacagggacaactacagtatcagccggagtaacagggacaactggactatcagctgaagcaacagagataactggactatcagctggggtgacagggacaactggactatcagctggggtgacagggatagctggactctcagctggggtgacagagacaattggatcatcagctggggtgacaggtacaaatggactatcagctgaagcaacagggaaaactggaccatcagctggagtgacagggacaactggactatcagctggagtgacagggacaactggactatctgctggggtgacagagacaattggactatcagctggtgtgacagggactattggatcatcagctggagtgaaagggacaactggacagtcagctgaagtgacaggggcaactggacaatctgttggagtgacagggacaactagatcatcaggtggagtgacagggataactggactatcagcaggattgagagggacaactgtttcatctgcaaaagcagggacaagtataccattaactggaaaaacaggaacaactagaacatcagttgaagaatcaacgacaactggaccatcagctggaataacaggtacaaatggactatcagctgaaatgacagggacaaatgaactatcagctggggtgacagggacaattggatcatcagctggagtgacagggacaactggactgtcagttgaagcaacagtgacaactggactatcagctggagtgacagggacaactgtcccattagctggggtaacatggacacctggaccatctgctggagtgacaggaatagctgcactatcagctggagtgacagggaaaagtggactatcagctggagtgacagggaaaacaggactatcagctggagtgacagggacaactggaccgtcagctgaagcaacagggaaaactggactatcagctggagtgacagggatcactggaccatttgctgaagtgacagggacaactggattatcagctggggtgatagggaccactggatcatcagctgaagtgacaggaataactggactatcagctggggtgacagggaagactagatcatcagctggagtaacagggacaactggattatctgcaaaatctgggacaagtataccatcagctggaaaaacaggaacaaccaaaacatcagttgaagaatcaaggacaactagaccatcagctggaataacagctacaactggagtgcctgctgcaacttccccaggagctgaaggtgaaagcatagcttccacgtcagttgccacgggagccatccctcggtcaacaattgcaccaggaagtaccactactggtaccactggggtaaccactggcacaactcttgcccctagaagtttcaacataggaacttctggtggaatttctgggaaaaccctcaaacctggaagttatgtctcagaggctacaactgctacagggactcctggagcaggaccgtcaggaggcaccactatcagttctcctgaagtcagtaccatttcagaagtttccaacacaggtatcactggagtaggctctgagacatctattgaaacaggaatttccaacacagctacgactggggtggctcctggcacaacccttgcccctggcagttccagtacagaggccacaacttccataggaggaagtgcatcaacaagaggaggaatagccacagaagccacaggttccacaagaggggtcaggaccactggatcagaagctccagaaggtacttctggagaattctctgggacaaccatttcatctggaggcttccacacagaagccacaactctcacaggaggtaggggcagtattggaactgaatccagagcagagtccacaacttccctaccacaaagtgcaaaaacaagaggtggaatactgacagaggccacaagttccacaggaaggatcagggcgaccggatcagaagctccaggaggtacctctggtgaattcccagggacaacatttacatctggaggttcccacacagaggccacaactttcacaggagacaagggcagtactggaactgaatccagagcagccaccactagggcaactcctggcacaactcttgtccctggcagttccaatacaggggccacagcttccccaggtggaagtgcaatgacaagaggtagaataaccaccgctaccactggggctttctctggaaagactctcgaatctgagaatgacaacacaggcaagccacaagttccaccagaggggtcaggaccaccaggtcagaagcaccaggaggtacttctggtgaattccctgggacaagaattacatctggaggttcctacacagccaccaccagggcagctcctggcacaactcttgcccctggcagttccaacacgggggccacagcttccctaggtggaagtgcaatgacaagaggtagaataaccaccgctaccactggggctttctctggaaagactctggaacctgggaacaacaacacagaggccacaagttccaccagaggggtcaggaccaccagatcagaagctccaggagaggccacaactctcacaggagacaggagcagtaccggaagtgaatccagaacagccaccactggagtagctcctggcacaactgttgcccctggcagttccaagacagaggccaccactttcctaggagtaagtggaacaacaaacattggaagagccacgggtgccacaacttccatagtagggagtgacaccagccaagcagaacgtccaggaggtacaactgtggtttcacctggagccagcagcacttcacagagctccaggccaggcacctctgtcacaccagacagttcagcatctgaaagtgaaacagttactacaaaagaattctctgggacaactgctatatctagaacttcccacaccggcacccctgcagcctcaggaggccaagcaactgggagcctgacagccaccactggggtagctcctggcacaactgttgcacctggcagttccaacacagaggccacaacttctgtaggagaaagagaaacaacaaaagctgaaataatcacaggtgacactggagaattatctggaacaaccattatatctgaaaattccaccacagcaggcatcactgcagcaacagggaagcaagcaggcacctcggaggtagctccttccacaacagttgccccaggaagtttcagcacagcagccacaacttctcctggagcaagtggaacgactggggttacaacaactacaaagaccacaacttccctaggaggaagtggcaccactggagcagaaataaaatcagccaccactggagcaccaggaagtaggacaggcacagctggagtgccctctgctacaacagtctcccctgggagctccaactcagaggccacaacttctgtaggagaaagtggaaaaacaggagctgaaacaatcacagaggccaccacttccacagaagggactggtacttctggaactggattcaaaactggcacctcagaggtagctcctgccacaacggttgccccaggaagtttcagcacagcagccacaacttctcctggagcaagtggaatgactggggttacaacaactacaaagaccacaacttccctaggaggaagtggcaccactggagcaaaaataaaattagtaggaaccaccactacagcaccagaaagtaggacagctggagtgccctctggtacaagagtcacccctgggagctccaactcagaggccacaacttctgtagaagaaagcagaataacaagagccgaagtaatcacagaggccacaactttctcaggaggcagcggggccacctgagcaggattacccagaggtaccactggagaattttctggaacgaactttatatctggaagttctaacacagaggccaccacttccacagaagggacaggtacttctggaactggattcaaaattgcaggcatcacttctgccccagggaaacaagcaggcacctctggggtatctcttgccacaacagttgcccctggaagcttcagcacagccacaacttcttctggagcaagtggaataactagggctggccccaactcagagaccacaacttccctaggaggaagtggtaccactggagcagaaataaaatcagctgcagtgccctctggtacaacagttgcccctgggagctccaactcagaagccacaacttctgtaggagaaaatggaaaaacaagaggtgaaataatcacagatactactgagggcacctctggcaaagttctggaacctggaagtgcccacacagaggccacaactttcccaggaggcagtgggactacccgagcaggaccaccaggaggtaccactggagaattgtctagaatgaccattatacctggaagttctaacacagaggccacaacttccacaaaagggactggtacttctggaactggcttcaaaactggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcagaaataaaatcaggagccacctccggagtaccgggaagtaagacaggcacagctggagtgccctctgctacaacaattgcccctgggagctccaactcagaggccacgacttctttaggagaaagtggaaaaacaagagttgaaacaatcacaggtactactgagggtaaaactctggcagctggaagtgcccacacagaggccacaactttctcaggaggcagcgggagcacccgagcaggaccactgggtggcgcttctggtacatcaggaggatatgtccctggaagggaaacagagcccacaacttccattgaagaaactggaacttccagaactatattcaaaactgtaggcatcacttcagccccagggaggcaagcaggcacctctgtggtggcgcctagcacaacagttgcccctggaagtttcagcacagcagccacaacttctcctggagcaagtggaatgactggggttagaaccacttcaaagactacaacttccctaggtggaactggcaccactagaactgaaataaaatcaggagccaccactggagcaccaggaattaagacagatatcatgggagaatcttctagaacgaccattctatctggaagttctaacacagaggccacaaattccattgaagagactggtacttctggaactggattcaaaactgcaggcatcactgcagcaccaggaaagcaagcaggcacctctggggtggcacctggcacaacagttgcccctggaagtttcagcacagcagctacaacttctcctggagcaagtggagtgactggcactggacccactgcagagaccacaactttcctaggaggaagtagcaccactggagcagaaataaaatcaggagccaccactggagcaccaggaagtaagacaggcacagctaaagtgctctctggtacgacagttgcctctgggagctccaactcagaggctacaactttctctggaatcactgaagcagtaacagtcccaagtaaaaatggatctatgaccactgcactggggagccaactctccagcagtcaaacagtgattccaggttccagtggcaccatctctcacacaactgttgcacctggaagttctgttacaggaaccaccactggtgcatcagatgatcaagtcactggaagtaaaacaggcactactggtgtggccttgagcacaactgttgcacctggaagttccagtacagaagccacaacttccacaggagtccatagaaccactgtagtgggacagaagacaggagctaccactagagggtcagcaaagcaaggaactagaagcacaatagaagctacgacgtcctttagaggcactgggaccacaggaagtggaatgaatacaggtactactggagtggtctctggcaacaccatctcacctagcagtttcaacacagaagctaccagtggcacatctgagaggccaaaccctggaagtgaaataggcaccactggcatagtctctggcacaacagttgcacctggaagttccaacacagaagccacaacttctttgggcaatggtggaaccactgaggctggaagtaaaatagttaccactgggataactactggcacgaccattgtacctgggagtttcaacacaaaggctaccacttctacagacgttggagttgccactggagttggaatggcaactgggatcaccaacataatttcagggagaagccaacctactggaagtaaaacaggctacactgtaacaggctctggaacaacagccttacctggaggtttcagaacaggcaataccccaggatcaacgggagtcaccagcagccaagaaggaaccactgtggtatcaagtggaatcactggaatcccagaaacttccatctcaggtccttccaaggaagcatctgacaaaaccactgctcctggacctcctaccacagtcactgcttccacaggagtcaaagaaacttctgaaactggagtgcaaacaggctccaccttggttacagctggagtgccaacaagaccacaagtatcccagccagaaaccactgtcgtggcaaccagagaagtagaaaccgaaaataaaacagaatgtctagcctcacttccaccagctccagtttgtcacggtccattgggagaagagaaatctcctggagacatatggactgccaattgccacagaggtacctgtactgatgcaaagactatagactgtaaacctgaggagtgcccttctccacccacatgcaaaaccggcgagaagcttgtgaagttccaatctaatgacacctgctgtgaaatcggatactgtgaaccaagaacatgtttatttaacaatactgactatgagattggtgcttcattcgatgaccccagcaacccctgtgtctcctactcctgcaaagacacgggctttgctgcagtagtccaggactgcccaaagcaaacctggtgtgcagaagcaaacagaatctatgattcaaaaaaatgttgctatacatgtaagaataattgcagatcttcccttgtaaatgtgactgttatctacagtggttgcaagaaaagagttcagatggcaaaatgcacaggggaatgtgaaaagactgccaagtacaattatgatatcttactcttggaacattcatgcctttgctgccgagaagaaaactatgaactcagagacattgtacttgactgtcctgatggcagtacaatcccttaccaatacaagcatatcacgacctgctcttgtttagacatatgccaactatatacgaccttcatgtacagttaatgctgacatcaccttcccagttttaacaggcctggtatttattttataagtgaggaaaaataatcatttaaaaagtgagaataaactaaacaatgtgagaataactcaaaacaa

SEQ ID NO: 2542 - DNA, 6704 bp, Homo sapiens
aggggacattgttttgaaagacagatcaagggcatagttaaaggaaacaaactctaattgctaaattttaaacatgtgagactccctgctcaaaggcagctggtctcctgtcttgactttgctgagagcaaagtgggcctccactgaccttgacactctctaaggtgaagctgatctctgaaaacagacgtcactgctgaagcagcctgccacatcagtgcctcaccttggttcttctccagcaattaacatttactttattggtcctggaggcaggaaggaagccctcaaagtcccaaactctgtaaatacccatttccatgtctgcccaacatcccagaaccatattactgatatccaaccagattttgtgtcggctcagctggactagaaatgttccatttaaaaccaagaagcaataggtttcctgggctgcaaagacagaccttcgaggaggccacatggtatggctgaagttgcatgttctgctacctttgagcttgcaaacccttggagacaggtggtcacgtgaaggtgcagagaaaaaaagtggaacagctgtggtctgtcatctcccgagcccatccacctgggagtttggaagagatatttaggacaggattttcatctgccaaaaagtgcttaagctgaaggcaaaaaaagtaagtcttccttccacccaagcctttgctctgtgagtgtctagcacgctgggctggcagcacagctgagactaggctagctttaattaatcttgagaatgaaccctggagatcagacttctgttcctcagaggaagacataacaatactctcttctccatcacacactggctgatacttaagcaaacaagatgagccaaggtagatatcccaagccacggaaatgaacaagcaggaccatggacaaagggaaggtttcctttctgtttaagagactcttttgcggaggtgtgctcacgggcaaggaagacagcggccattcattttctcactggcagagtatcacagcttccccatagcgttcagccttggatttgtattaagaagcatggtccgggggaccagggggaagaaatgtctgttaagatgctgtcattgatgagactcaatttaagaattattttcagtgatttttctatgaagaaattgtatcatttttcttatgcaaaaatgttgctgttagcagtacaagtgcttcatgccaatggaccggtgggggtgatttgcaggaagccgtcacacccttttgccaaccctttttgctggtggtgttgaattgaggcagggacagctggctggggctgggcatgctaggcatgcagtctgtgatctagcatggaattctctgggtaaaaaactagtttatgcataatgtcctcctccctatcgtggcagcagtctagaaaaaatgactaactggccaggcggggtggctcatccctgctaaagcttcatctacacgtccagtattacccaactctgttactgaaacacaagctaacatcattcaacataggccacaatatcatattatttttcccaatatctttttcactgagtccacttaggtttaatcagcacttaactacccatgctaatggcgggtaagtagcagcttgcataacccaagtgatcagatactctgaaatcaatggggtgcattactttttattccctcccagcacccagcagatttgtcttcatcattaaatatggaatggagactaaaatttttgaattaaaatgatgttaacctttaaattagcatgttgattctctcttttagataaaagagaaccagagagcaagttatctttgaaacagatacttcaaaaagtagagaatagctttccctatggtagaaacctaactgtgtatttggatggaattatagcatcagatttaaaggcctgtcttttagccttagaatggtcatcctgctgatgaagacccacagatgcctgggtctgcgtttcattttcaggttacaggtggctgctttggactctggcctccctacaggcagtttctctggttgcagggtcatgggtactatagaattagtctttgttttttttttttgagatgaagtttcgctcttgttgcccaggctggagtgcaatggcacgatctcagctcaccgcaatctccacctcctgggttcaagccattctcctgtctcagcctcccaagtagctgggattacaggcgcccgccaccatgcctgggtaattttttgtatttttagtagagacagggtttcaccatgttggccaggctggtcttgaactcttgacctcaggcaatccacccacctcagcctcccaaagtgtgggattacaggcataagccaccacgcccggcctgtagaattagtcttctctgccttgaaattatttctaccaattcttggtcccttggaatcatttccctaaaactcagcatttattcaaggaccctggaacatcttatgttataataattgtaaagttaggtctaaagcattttcttccaaatctttgcttgtttttgtttaaaaaaaaaaatcacacttcgctaaacatggctgctaggaagccctgagctgaacttacagttgaccttacttttactaatggtgtgggattttcctgcatgcaatttctgccacaactttttctgtagtcttgttttataactatacctctttttatttttgtatggatttatctatccaaaatcttattgaacatatttttctgagccacaggaagtacttttgggagtgaggtggtgtgaatttatacagaacaaaagcagcacattaagaaggacacccacaggtggagcacttagtcactcccaccggccaacagcgcttgcttagggagccggatgaggaaagctcatttaaaaatatggtaacatctatgtgtgagatgctgagtgatgctctcagatgaaacccaaagatgatgacatccttgcagacacccaggtgtgtatttcttcatactctagaaaatgatcagtcaatgaaatggatattgtctcttttcttatcgcttgtaaatgtcagtttggggaacgaaaaaaatgccactttatggtgtgaagtgcctgtctacaatagtccttgcagagcggctcagtgagtccatggcattaaagatatgacagttactatgtatacagtcagtgaggaaggcagcacagcagtatctccgagaggtggggccccaccaacactcacaccacaccccctgcacgctgcatattcattggcaggtgagggtgcttttgttttgtgaacaatgtcttctggtctttagtacgcattgtggttttccttttttttttttttttttttttttttttttttttttgagactgagttttgctcttgttgctcaggctagagtgcagtggcacaatctcagcttactgcaacctccacctcccaagttcaagtgattctcctgcctcagcctcccgagcagctaggattacaggcacgtgacaccacgcccgactaatttacatatttttagtagtgatggggtttcaccatgttggccaggctggtctcgaactcctgacctcgggtgatccacccacctcggcctcccaaagtgctgggattacaggtgtaagccaccacgcccggccatgcattgtggttttcttaatgcccagctttgtatgaagtcctctaaagtcccctttgaggagtcgtcgaattacatttccattttctttcattaggaagctatgtctggcctgaaaaataaaaacaattttatggtttctcataaaggtgtaattttgcttcactcttattcacttattttcacgatggagagaatgaaattgtttccccacaggaatcatagtccattttttgcctttcatgttagtgatttttccccctcatagctccctaagaaaaactaaagcaatttgaaaagaaaaaaatgcaatcttataacaaagttggctttgtcttgataaatacaatgatggatgaccacaaccacttaagtccttttgggcaaatgaataattctctgactatatctgagaagtggaaacacatgaatttacattctggttcttcaaatatcttctccctttcccttcttacattgacctcacttgcctgaaattaatgaagcaaatccccaagggcagaggctagaaggtttgtgaggcttgaagcttatacgaggttcctctttaagaaaaacaatacaaacatatcttactttcacaattttttacaaaaacatatgaccacatgaacatactgcccaagtccctcctgggccttggcaaggcccgtgcaagagagatccctgaagcttgaactttattggcttcacggtaagtccatttctgcgggcagtgtgttgtggcaaatgtccatctacactatgcatactcgaatttgctacttgtgtatgtaaacacaggaacgtaggtaatgcctatacagagaataaataggaatatacaagtatacatataaaaacacaagattacatattgagttttcaatacacaaacacacagatacttatttttttctatttttgttgtttctaaagatcatatccaggcatgatccctcttctccagactttgaattgtctacctgcatttcagtgttcgctttaagggggaggtaatcaatttagcacattatcattcaatcagacaagctgactcaaacaccgttctctgaattggactcatgctgagcaatcctctattctagaagccaggtgtgaggggtgggaggcaggaagccagtgtgggtagggagcccattgccagtagacagagcatggcttggttctttcccaccccccaagcagttcagatactggtttggaggtctccattgaggagggtcctctgggtctccgtggtctcattcagccgggatttgtcctgcttactgtcactccgctccccatcatctgtgccgctcaccttgaccaagcagaggacattctggaagctcttcttgaagttgtcagacaagaaggcatataggatagggttggcacagctgttagcataggtgaggaccaccacaaagtcaaacatgcctttaagggctggggtggggctgatggccatggagacggaagaaacgttgaatatgtagaagggaagccagcagaagatgaagacagccaccacgatggacaccattcgggtgaccttcttctcagacttcttcctcttagaggagcccactcggattccagaggacttcaccttgatgataatgaacaggtagcaaagacagatgatggtgaggggtaccaggaaccccagaatgaaagtgtagatgatgaaccctgtgtaccaagccccagattcacctggccagttgatggtgcagctgcttctcccccactggttgctccggagcccagcatatatcatgatgggcaagatgaccagcagagagactccccacacagccatggtgatcatcttggccgtccggggtctcctccacttggccgacttgatggggtggaccacagccaggtatcggtcgatgctcatgactgtcaggcagaagatgctggtgaactgattgatgccatccacagtcatgaccacccggcaaatggccttgccaaagggccagtggaccagagccacctgcatagccaagaaaggcagacccagcatgaagagctcatctgcgatggccaggttgaggatgtaaatgttggtgatggtcttcatcttggcatagcggaggatgacataaatgacaagtgtgttgccacacaacccaatgatgcagaccacaaaatagatgaatgtgaggactgcattgcttgtcaggtcatagtacggctctgtctggtttgaggtgttggttgacaccacagagccattgaggtcaaatggaatggatagccatgtgtggcttccattgagtggctcatccgccatgtccatggctgcttttcagtcttaggctagttccagccagcccagagatcttattctcaccttaatggaccctggaggccaaggatccagtgtgacatctggaaggaaaagaggaagattggcccgtcggtcacaggctgtttaaagtctcaccaaatttacacatttctggtttagcctctcagacatactcttaaattgaaaaatgtattatctttccacatcaacattaagctctagagttcctcatcagtgtgcagactttttgagttgtttttccaatagtagggaagggtttgggttcagccatcatctgctgacgcacatgtcggggagggctgtggcttcaaaaagcacatactttgacccctaagaagttgactgatctaaactgcagaaaggcagagcttggagaagttcagcgcctgacctcagaagggtctgacactgacattcctggcctcttccctaccaggaaatctatgctgacttgctgactgccttggagtctttccattctgaaaatgccatagtggaaaaaacccagactctagaggcagaacaaaccgggttccactgctgagcccgtgtgaccacatgcctggtccttaatggttctgactcttatttcttcacatgggggcgtcatgaaggttaaatgatggaatatatgtgaaaatgcctagccttgcgttgggctcataatgggaacctcgtaagttgtttccccccatgttttcc

SEQ ID NO: 2543 - DNA, 7464 bp, Homo sapiens
gtttcctgtatggactgatcttggtattccctcagagaaaaatctggctgtgccgtctatcagacttcattcccacacagctgcccagacacagggcagccttcctctcagaacatcttctgtatcctgaaagcctccagtgggttcatccttcaagttaatggacaggaaaactaagaccagtgaggaatcccaacactcatcctgccaggatagaaaggaaagcccagaggcattgcaaagagtgctgaagagcagggattcgctgtatggggacaactcttgctttgtgtttcaggacagggaacccaggagtgcaaacctcagtcaggtgcagtccagagcctgtcttgagcataatggctgctctgctctgcccccgaccctcaccacctccagcggggttcatcatcccagtttatggacagaaaaactaagactagagggggagggcttagctcctgctcggaggagaccttcaactccttcacctgcctggacttggcaccctcccaagagactgcaaccaaggttatgaaaatagcatctactcaccatccttcctcagcacacccccaaccaatccacccctcagtcccacccctgtctcaaggagactgagccccgagaagcacagcctcctgcacctcctcacctcccagcctgccttcctggtctatctgcaatgtcctcaagtcctttcccgtcctcctcatccaaactccaagacctgcctcacctcaccctcctccaggaagcccccttcatggtctgggttcactccctgtcatgacgtccgccctcaccagcacagcaccaagccttgcaatgctctctagtagttatttcctgcacagagaaggggtgagggaagcatcatttctgcctatccctgttcacacgcaaggctggctctgccttcccagggaccgttctgcagagggagaccgctcatcaggcaggtaccacctccagggatctcactaaggtagaactgatgggcctcagttctgttcagagaacagctatacaggctggaggcctccaagaaacagtttccattttccctgaggagtctgtatggatgtgtactgtacagggtataggctgtatggagtctgcaggtaaacatgcctgtgtgtcaaagaatgagtctgtatgggtgtgtactgtacagggtatatgctgtatggagtctgcaggtaaacatgcctgtgtgtcaaagaatgagcatgtgtgtgtgtgcatgtgtcagcatgagaatgcctctgtgtttgtgagtgtgagagggtcatataggtgcagcattctgttgatggagagtcaaactctgtaaaaaaaaattttttttttctttagatggagtctcactctgtcacccaggctggagtgcagtggcgcgatctcggctcactgcaacctccgcctcccgggttcaagcaatcctccctgcctcagcctcccaagtagctgggattataggcacctgccaccacggtcgactaatttttgtattttttagtagagactgggttttcgtcatgttggtcaggctggtcttgaactcctgacctcatgtgatccacccacctccgcctcccaaagtgttgggattacaagcgtgagccactgcacccagcctgtaaaatattttaagagatttattctgagccaaatatgagtgaccgtggcctgtgacacagccctcaggaggtcctgagaacatgtgcccaaggtggtcgggatacatcttggttttatgtattttaggaaggtatgagacatcaatcaaatacatataagaaatacattgatttggttcagaaaggcagaacaactcaaagcggggggcttccaggctataggtaaatttaaacattttctggttgacaattgtttgagtttgtctaaagacctgggatccatagaaaggaatgttcagtttaaagataaaggattatagagaccaagttttattgtgcagaggaagctctcagatagcagacttcagacagagcaagttgtaaattgtctcttatcggacttaaaagggtgcctggctcttacttagttgattatctcctggatctggaaagaaaggaaggaaaacaaaggcggaaggggaatctctatagaatgtggatttttcccacaagagactttgcagggcaatttcaaggtatggcacggaaatatattttggggttaaatatttttttccttgtctcataatgttatgccagagtcagattgaaaagtaaatcacaacatatagggtcaaataaaacccatctgatgagaatgtatggtttgtagggcatgacttcctagacctcttaggtaggaatctgggtaagacagaatatcagacttagtcctcaattcctaatgcaaagttctgagatccaaaatgctccaaaatctaaaacattttttagcaccgacataatgccacaagtggaaaattccacacttgcttcaatgtgcacaaactttgtttcatgcataaaattattcaaaatattatataaaactgcttcaggctgtgtgtatataaaacataaatggatttcctgtttagcctggggtctcattcccaagatatctcattatgtatatgcaaatattccaaaatccgaaaaaaatcttaaatctgagacacttctggccccaagcattttggataagggatactcaacctgtaggtgaatggacaggagtgagactaccaaccaccgtcccccccgtccccgccgcgtccccctcaccccaccccaccccctcccatatccttctctgacctctggggaggtgaggacagcgagggctggacaccacctggtggccctgagctgcactacaagccaccaccaccccactcttttctccctgccccctactccaactcacacacacacagacacacacatgcacacacacagttgatcccagctctcagctctttctctggggcttcaacccactttgtgctcaccatcccaatgccctacaatagtcttgcaaagactgaagatggagaccccgtccttctgagtctcctttccctatcccagaggaggagaaaggaatcagacagctctcggaggggaatcagacaggtagggctcaaatcctaaccttggtgcattacttaacctctccaaaccttagacaacttggctgcagaatagactaatggtatctgctagaatcattgtgaaatttaaataaaatgcaaaatgaaaccattaagttgggagagcaggacagctacaggaagccaatggggtcaagccttgtgttctgtaacctggtgagggctgtcctcaggctctgtgcagagcctcctcccatctgtcctctctcccttcctcccacctctcctccctgggcatcctcagatagctgttttgctcacctttgcagggagctcacccctgccagaggctccacccaatacctgttgtgggtgagggtgatgctgaacagagcccccacagctcttcatggagtggcatagaccccacctcccagggcccctccaagtcctccctctgcatcccccgacccactggtcaccatgttctgccaacctagcatctcctgaattcctctcctcgcccagcccagggcacagcacatcacccatagaataatccctgcccaccctctccccttgcagtcacttccctgctctccagggggatctttctaaaatgcacttctgagtcactctcctactgaaaacctttctctggttctccactgcccacagaataaagccaaactccacaacctggcatttaaggcccttcaggatctggccttgcctcctcctccatctctcggctcctccacctgccagtcccttctgttctcgaggcctttgcaaaagcagtttcttctaccaggagtgcctgtccccttttgcctataaacaacatctgctcatctttcaaacctcattgttgttctcagggttatgatcctgcctggagccccatggccgggcaccccacagcgttgtcatggcctgcatctgagtttagatctagctctccaatcaaactgtgagactttccagagcaggacaaagacaaagccctcagccctagcacagggtcctgcgtgcacaaggaaatatctgtggttgttccctccatttggtgaaaaacagggatgtgtcacagcatgagcctcaaaggagggctgggctggggacagacagatgcagggtcaaggttctctttgcctgaagagttgtggaagaggaacacgcacacacactcagggtcaggggtcaggcagaagagcagctacatcagcccacagtgaccctggggtcagccaggcaccattagaatagccatctcttattggccgtgggccacaaactgaccactcccacccccacctggggacccactggccaagcctgggtcctgtgctgtgagaggatagagacggacttggggagcccacagcaggagctgggaatgggaggagcctggagccccatgacgctaagggaagctggaaacctggagaccattcagccagaggagcagattccaaacccagacaggctagtggggcagggggagctgcagaggaagcagatgggctctgtggtcccaaaggcaaagctggcaatggctgatggtcacaggatggccctgtccatctccttcctgctcccaccaagaaaggagaccccagtgcccaccctcttaacacatcaacctttactgaccaggaagagatgaacacggagaggagctcagaggggggtaggcaagtcggggacagggtctggagactgtgccaggcagagcctccgcgtagccccaacctgcagtctgcccatcttggactgggcggaagtaaacactctcatgcagaggaacagacacaactcctcagacacaacccggggctggatctggtgtggagtctgactcaggggtgcaccttcggcaggactcagagtaactgggatgtgggacttcctgggacacagccaggcatcactgcagctagaaacagagttcagaggcctaggccctcgccgtatgggcactcatgaccagggcaggccagcgctgggagggtctaggacaagctccaggctacctcctccaggcagcctgcctgcttgcctcaacctttgtttttcctctattctacaatctctgccagccaacatgtcccatcactgctccatggccaggccttctcatctgccacccaccccttagcctccacgatctggcctagggagtaccccaacaggtctatgacttccccagaaggggggctaggcaccaagggtggaggaccctggaagccatggagttccaaagggcgtttgcctctcccagttctattccccccctccacccaccccaagcacaaagtctgcaaacagccccatgggggaggactggtagaaagaaatagatttattctcatgtacaaagcggtcagcccacgggaccatatacgacagttgcacagagtcctagaaaaacgcatctctctaaaggcaactcagaaaggtaaggcaggtggaccccctcccccaccccacaacgcacacagaatgaaacagagaaaaagagagaagccagtggccgggctgacccaagagtcccggccctatggggtctcccaagccccagggcacaggtggatatggccttgaagagagagccctgccagggctgaggccaggtctctcactggctgcaggaatgggtaaggggctcaggccaaggggaacactcagggggcctctgagacactcagggttgggctctctgtgccttagggttgcagaaacattccatagcctctgctgggactccgcagagcgatagagctattttagacattgatctaaaatggatcttagagcatggattgtcttacccgctccctgtttggcccagacaggggaagagactcgcccagcgtcacacaggcaggaggaagcatggctggctcattcatacctgggcctgtctcccagtgcggggatccctcctgcccatcaatcccatcctgcttctccccagggcccctctctgcagagcactgagctgcccctctggcagcttcttcctggggcccctgtatcccccaggtcccaatcccaccatcagtatagtagtggtcctcagggggccttcgccccgcggctgtttctagtcctcccacagaactaaggactgtttccaagatgccacactctgctcactcagatgtctcaccttccccttccatgaggatcctggagaccccaaagggtgggagtcctcaaagggaaaggagcaaagatctggtggggcagaaatggggcaaggagaaaccatcaagctgctcagacaaagaatggcttgggaaagacttgccaaggtgtggtcagaggtgcagagtagggcccactgctcattggtcacccctgtgctctcagaaaacaaattacaaagtctccgtgaggttggaagtcttgcttccattatacagacgagaaagctgaggcccaggaaggtagtacttgtccagggtcacacaggaagtcctggtctaggacccaggacccgtggctctgccgcggatggtgaacttgtgggacaccttggtccagtgctcacggttggaggccacgcgctcgtacagctctgccgctttggggaacaggtcctgcaacagcctgcgggtgcatggggggcagagggcgagaggccagaaatcagaccatgggcagcaagaaagactagggctacacaacaaatagaacttccacaagggccaggtacggtagctcacgcctgtaatcccaacactcagagatgccgaggtgtgtggatcacctgaagtcaggagttcaagaccagcctgaccaaaatggtgaagccccatctctactaaaaatacaaaattagctgggcgtggtggtgcatgcctgtaatcccagctacttgggaggctgaggcaggagaatcgcttgaacccaggagggggaggttgcagtgagccaagatcgtgccattgcactccagcctgggcaacagagtgagactccatctcaaaaaaaacaagaacttccacaagaatgtgagacagaggaggacacctaggaaagcatgatggtctctttccactgaggaccaaggatgaagtgaaggacccactgaggggcacagcgggagacagttatgcccagaggcaaggggatgaatcagttggacctgggccaggccaatctcagcacctgtgtttcctgtgatgtccccactccagcctaccctctctgtgcagggtgcagcttgtccccatgagctcactcacttgtagatgggcattgcaatgtgctccatgaagctgatttgcagctcagggatataggccttctcccggtccatcatctccatcggcctgttgcccatggccttctcctgc

SEQ ID NO: 2544 - DNA, 219 bp, Homo sapiens
ctcctggatgctcttctgggccgggggcttgtagttgaccgagtgctcatcctcctcgttctccgctgcaatctgggccagctgctcggctgtgggctcctgctcagccatgctcaagcttagcctgggtcgggacacctgtgggcgggacggtgacaggccttggacctggatccccaacggaggcgcacttctgagcaggagtgtgggctgcagccg

SEQ ID NO: 2545 - DNA, 3322 bp, Homo sapiens
ccccaccatgcttcccatcaccacgttgaccatggccccctctagcccttctcagaccctcacacgtgcctctgtccccgtgtccccttcagactggagcattcgggggctcctgcaaatgcccctttgtgagtgaacccgcaggtgtggggaagcgcccagcagccctcatggaactcgggatcacggcaggaagggggcaacgtggatggacacctgcaccctgtgtgggggtataaatcaccctacagggcgctcgtcacctggccagccaggagagggaccatccgtccccacacccggtccacagcaccgcacccgactcagccccagcatcgaccagaagtccccggccctcagaccggccgcccagagacagtgggagtgaggaggccacacaccgtccaggttgaatcactgcgttttactgagtgcacaggtccacctggcgtccgaactcgtccccgtggcagcagggatccccagaaccttccacggccatcgcggccgcaggaccccacacccgaagtcccccgcaaacccgcactggcgcattcttacggctctggcatcaacctgtccgtgtgagtaagttaatatctcagctaatctgttagaaaactagagttcattccctgggcgtctatccctagaaaatggacggtgcacaaagttgagattgaagtgtgcggggtaacacatccaccaaaaaaaggcctggtcactacggcacaaggacacatacaaaatggtcagaagtgtacgtcggtactgaaggcattatgaaatgttctttggagcatgaacaaaagtgcagacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcctgcctggtagccccggggaccggcccctccttgctggcgcctggccgagagtcagacgctgaggacctctcaggacggggcccctggccagagccagtctcctcggccagccaggggcaccacggcaagtgtccaagcccagagcacactcaactccaccccacaaacgccttttaaaactctgaagaggcccctccatcccaaatggtcccctcccgtctctcctcctccaccgttgcccacaacctcccccggcgatgtcacctcctcccagggtcggccgtcagcccccacccttacaagacggcaaagttcagcaaactggaacccccattcactcatgctcccgggtcatggaaagctcctgggtgtgcagcttctctaggtctcccggagggacaggaacctgcgtattccctcgaccccggagtccaccatcccacatccttcaggaagccgccctggctgtctctccggctgcttagcgctttgctggggccgaggtggagactgcgcgctgggtgggaatgcaggatggctgcccggcacagccacacaggctccccaggcggccattccgtcctgcagcccctaaaggccctgaccaggcctcttcacgccacccccatgccctggacatacgtgcatgtgacctgggagttctgcatgggtgtgggggttgggggaggcaccggacaggatcagaggacactgggggcacccgtgcactgagcacccacccctcagagctcagccccctgctgggcaccctccacagcaggtccaagcctcgtgagctgtccctctcacaccacgtctgctgggcaccctccatggcagcaagcctcatgagccatctctctcccaccacatctgccgggcaccctccatggcaggtccaagccctgtgaaccatccctctcacaccacgtctgccgggcaccctccatggcaggtccaagccctgtgagccgtccctctcacaccacgtctgctgggcaccctccaccaggtccaagtctcgtgagccgttcctctcacaccacgtctgctgggcaccctccacagcaggtccaagcctcgtgagccgtccctctcacgccacgtctgccgggcaccctccacggcaggtccgagctttgtgaaccgtccctctcacgtctgctttgagggtttgtgtcaatggggctgtgcagcatcaacctgtgatcttgccaatgccccagcctctgctctgtacggcattcatagctcaggagggcggggacaagggcgtttctgcaaagctctcacagctccttctgctcctcggcttctgggaagcaactagaaatagctgagagcccagctctttctagagagaagggggtgtcctttatgggggtccctgactgtgggggaccgagcccagctggagtcctcctccccttctctccggcagcaggtctctctggcagcagggtctggaatctagaaacactgagacctccagccccgaagggggcaaacattaaaccacacgccctggctgtgcctctcctccgggcgggacttggggtgatcagacccacagctcaaagggtgccccctggagaagccctcacagtgcctggggtgatttcagcctccaagggggggcttgagacgaggccccccaaaaggtaggggcatcgctgaggggcagcgtgtcctccggtggggggtgttgggcacctgccctgctcagacggctgtgtgcaggaggcatgggaggagccctcccccagcgtgtcccagccgtggtggcagctggaagactcacggactgtgattttatgcagagggagaaggagaagctgggccaggaaaccacaacaggcagcagcacctgcctgggctggggcctgggattcgaggctgagccacccatcccaggagggcccagcacctccagggcagaccaaacacaggacccaaccggacacccatacagacaccggggcaccttggcatctggtagagcccctcctctggatggctgccaggctgtgggagggaagggcagcacgagaccctgattgggctctgcctggcgctctgccactgcggaccaggagcccggacagtcggatacc

SEQ ID NO: 2546 - DNA, 459 bp, Homo sapiens
ccatttattaagagtcaaccatgtcctggacacttgtcaactccgcaagcagttccaagtccttcccacctctcagctgtgaatagaagtgataacccttcccactaagaaatgcaaagaagcacacgtgccccataatctgaagacttatggaaacactgtgagatagagatccctgaagagccccccatataaagaactgtagagctgcactgaccagtaggatgctccattttaaattgcctggatcaagaatgcagtagcagttatatcactgatgggcagtgatccatctgccagcacatatttttatttcagttgacattaaataatatgtctctaacaaatgctttatataaagggaacaactctgaagttggaggattcgcttcataatgcgtgcatataaaagacatttcatcaagagatgaagaatgctaaaaatattaaggtatcatt

SEQ ID NO: 2547 - DNA, 1831 bp, Homo sapiens
acattacaggttttgcaaaagcagaaacttcaacacaggaaaacttttaaagtaaatagactagcgcggcacttacctctctctaatggtgggataaagaccctgccagtttggggccgggataaggttgttgttactgagattctgctggtggtactgctggacgctggtgctgctggagttggctggctttttacgggggaatatatcagcagccatcttcttctttttagtcttcaaggtaattatttcataacaaactggtggcaacttgctgctgttgctactgctgctgctggtatttgctttctttgagcttttcttggacctgttctttaccgtctctggaagcatcaagaagaaggtatggcaactggtgtcagaagtataaggggtttgtgaaaattccacagtaaagaagtggggcaacacctggactacgaggcggatctcctggcttgtcatgttgtttgcttcattcactctaatattcactcacagtaattacctcacacacttacagaatgctcaattgtcatatttctaatctactttaaaagaagagctttcttttaaagtttacaaagatgaaaaccatgaacatatgtagtctgcacccctgtaggggcacactacaggcaagaatgctgaaaggatacttgtggaatgagatggaaggaaggaactgcagtgaggacgctgctcaaaaacagaagaggctctccaggtacttgaaaatagtctatccaaagaaaagtaaaatcaaggctcaggaggtccctttcaaaaaggcctgaatggggctgttccaacaaaggacttcaatcaatcctactgggaatgctggaatggaacaacctcacccaaccattgctgtggctttctccaggtcatttgttggctttaaataacagaagaagaaaataatatgtttcggtcaaagaaaaaggaaagtgtttccaaagatatgttttactttggctagtattagttttttttgtttttttttctgatattcgaaagatagtcaccaagaacatctcctccatcagatcatcaaagtccaaaagcttctctcacatattaaccaaagagtatcttgttctatttgggaaaaacaccttttccaagaacacatgggacgggaagaaagaatccagacaactcccaaatcaccagatattctacatcagtcctgattattagtgaggttccaagtatcacagccaaatttccccaacatccacaactaagttctatacctttagtcactcagtgcttagaaataaacactgctctcctgtccttcaatttactgcctccccgccatcaacaccaaacacctgaattatatcaattatcttagattttaaattgtgctcactgtaaaatgaacaggacaggttgggaaaggcaaggccagaaaaagctttttattttgttgttttgttttgttttgttttgttttgcaaaaccacatagaaaagaccagttacaatttcacattttgacaaacactatacacatatccagaaggtctcaattaattactatttaatgaaatgctatcctttgttttacaatgtatgcgaccagaatgaaatatagttattttgggcaaacaatacaagatctaacattaagaggtctgctatgctgagtgaaatctgagaaatcttgctgtgggaaaacttaaacatacatgaagttacaaagtagcttaacactcaatttctaacataccttctctcgagtagataccaccaaataaaaatgaaaaaaggcacctacatttctaaaataaataacaataatattccctaacaaaaaa

SEQ ID NO: 2548 - DNA, 3430 bp, Homo sapiens
cttcccgcggtcccacctggaaggtgggcgcttcccccagcgcccggcacagcccggaccccggtgtaaagtcgggcatctgcgcagtaaacatctggcctcggagctgtcctccgcgccttggctgccccagccaggggaaggatatgcggagggctctaagtcaaagcgggcgtttttgcgggtgtagacactgcggcgcctgggtctgcagcatcctgaaaacatcacacacagtggaccacgctttgccctcagagtgactgctccgacccggaaggagaggtcaacgacccctcaggacacaaagggtttcttaggttgttctgcgcagtcacatggcttccagaaccagaacgttcagctcttaaagtctgcacagaagaactgatagaatctgctcctttcaatggaatctgtgactgtttgggaaggatgtgcatggagaagggtctgatgaggctcctgatccaggcggtccacgtgcgttcagtgtgtttggaccctaggcacctctgtctattgctcggtcttgcgtacatagtccatagcttggcatcagcacagatcgatgcttagtgagcacaattaagaaaccaaactatggaaaattaaggacagtaacaaaagtatcatcaacaaaaatcaagcattttcctctttttgaaacaagaaaagcgcatcgtagaaaccaagattctgtacaatattctaacattatatgtacataaaattatattactcataactatattgaaaagtcttatttgtagaatatggctggcaacaaagaaagacccataccatttagcgtttgaagcagggcaggtagcaagagaacattagcaaagacacctttgtgcctggatacacaatcctgctactaagttatgtgactaaccagcacactctaagttctgtggtttgttcgttgtttcacattctagtagggaattctgcagcaggcgatgcgaaaaagaagacatggtcaaatgaaatgtgaaatgctgtttaaaatctgcatattggctatgataatgggtttgtgaatccaagttgcattggaagttcactcattctccattcattatgcatgcctccagtgatttaatgaatttcagcaggtggaaaagacagctttgaacagatcagatgggctgtgagtcagattcttgattctttttcctcatttggctcctgaatgttgcagaaaactggttttgtacactggggaaggagagagtgaagaccctccagttggttcctcagtcagctccgttcttggtgtcgctttcttgcaatttttttcctcccctggcccttcctgtgagggttaaaagggccatctccaagccaggtggagccccaatcccattgaccaagagggcaaggtatggggtcaccttctcatggaagccctcttcctaaaggagcccaaaggggacacctgcagagggcgggctgtgatctgtgtgtgaacttcaacaaaatctcaggttagtatttctccaatttcagttgaaccacgatgtggtatacactacaaatgcagattctggtgcccctctccaagagtcggcctcagttaaaaagggctcagatccaggaacctgttctgaacacgcacccaggcaattctgatgcaggcgagccacaggcccgctgtgaaaaaaaactgacttaatacatcaagtatagatctacaaattatttttagagagacttgaaaaactgaagattttaatgaaacattgcatagcacagattctcttcccaaatttcaccaatgtattcctttcaaaatgtggaattaaatggccaaaactcttagggagatgaaggtgagtgggaaggagggggttaatttaaaatctgtctgcttttcaaggtgaggggctcttctggatgtctggtcttggtgatgcaaacaagaccaatggcaacctcattttcttacccagaattcctactaaggttcactagaattacttatgaactcagaaatcagggctgggcatgctgggaatttatgtcacagcatataatttgggatacgtcagtaactcttcactatctgtttccatcatggcaagttttcacctgctaagaatgtgaggtatcagctctcctactcacaaaagccctagtggattacccaaggctacggttattcttccctgaacctccttgctgtttaaatgatatgagaatctaaaacagtgcccagtgtaggcagccttctaccaccagctaaaaacattcccagttcccactgaatcaccacttttaatcacatgatgaggaaaagaaattaactgcagatgggtggcattttatattgatggccatccaaaaaatttagaaagacaagtctcagatgaagatctcctcctggttcaaagatctcattttaaatctagaaagacagcaatagggcatcctaaattctacataacggagatctgttcaaagcagcgcaaccactgctgcagaaatgtactgattcccttctccgtggccatttcaccacttttgtacctatgaaaactagctgctcctccaggatcctttaattttctatgcctaaaccttaatcttaatttctgtttttctgactccagtgtgccctcaaaagtcactaattatttctagccctgattgttctcatcttccctgctgaaattcacatgggcaatggtgagggtcaaggttagggaaagaacagtcaaggttgaggtcagcagatgcagataagttgagtccaaggggacaggcagcggggcgggagggttagtaatttaagaagtcgatcccaactttgacactcttcgaagtggctatatcaatggctgtggctttgatctcggtgtccccgaactgcataagggtctggatctccctccgggcgggcaccgcagtgccactggtccctgtgagatccaggcggagcgtgccacacttcttcaccccgggatcagtgatgaagctgacgttgtcgtgctcagagctgtagatgttgatgacaatgaccagctgggagggcttggccggggtgtagctacgcttgaccagctcacccagagccacagactggtcggcagagatgaacttgtcaaagacgtcggtgcaccaccgagtgccatccttcaccagcagcttctcaggcgggtgcttgccctccacgtagcggttcagcacgcctaccccgtaggtgagcggcgaccggcgcaccttgatgaccgcggggtccaggccaaagaggacggcacccttgaggatggtgaggcccacgtcctgggggatgatgatccggcactggtccccaaaagcagcctgcaccgcctgctgcagcaggggcgcctcggcaaagccgcccaccagaaagaggaacttgacggtggacacctcgggcttctgaaacaggtcccct

SEQ ID NO: 2549 - DNA, 1052 bp, Homo sapiens
ctgggaggcagaggtttctgagctaaaatcgcaccactgcactcctgcctgagcgacggagcaagactccaagtcaaaaaaaaacaaaaaacaaatttatgcagctgtttttttaataattaaatgttaattattattattttttgagacagggtcttgctttgtcgcccaggcagtggcatgatcatggcttactgcaacctctgtttctaggctcaagcaatcctcccacctcagcttcccaagtagtagggattacaggcacatgccaccacaatcggctagtttttgtatttttggtagagacagggtttccccatgatgcccaggctggcctcgaactccctggttcaagtgatccacccgccttagcctcccagaatgccgatattacaggtgtgagccaccgcgcccatctcatgcagcttttaaaatctctgcgtgtgttataacagtttcagctagatgagaaaaaaaaaacattttctgtcacaataaatggcactccagctaagttaggttaaaaaaaattagatttcattagaattttaaaacaaacttgatgtttctgttatttcttcattccactaaatgatatggtttgaaaatatttatgctcagatttttaaatggtctctacaacaaattgtcacttgttgggttcaattaagtgctcattgtataagtgcacatggtacaaatcaacaccagcttataggattgtggaaagaattaagagatgaatttagtgatcttatataccctgtcagttggtcatattgtggaagagctctacaaaacttactgtactgttaactccaagattttcttccaataacagggatgctagccagatatttaataatcaaagaccaaaaatggcagtttaatttttctacccaatatcctatggcatatgaatgatccaaatttgaagctccaaggataggaaaaagcttacttgtgcctgtcctagacaagtactagagtttatattgaaatcaaaacttctaaaaataaaaatcagtaagattaattttactcatttttct

SEQ ID NO: 2550 - DNA, 5373 bp, Homo sapiens
cgcaagggcacttccggtaccgctcctctcttgccagcgcagagaactgccaagtcagttccggtccggcagagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtggttgcatttgggaatggaattgttaaaacttgatgcttaggagcgaatgcagactattcattgggtgtttggggtgggggaagggggggtgggcagaggaggtatgcagggagaggggttctgtgctcctgagattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaata

SEQ ID NO: 2551 - DNA, 926 bp, Homo sapiens
cacaccaaacccaccaattcagaaaggaaaaaaagctaacctcttctgattcttttatagcttaaaaatggtttaaaatgacttttgccattcaactcgtatcagttcaagaagctctggaataagtaaccactgaagaaatctctactccagtgcccacagcacacaagagtcaaaacaaataagcaactaagatcccccgatcacaaatttccaaagaactggaggaggggaagaaacagggtgaaaatggtggtatgaaagggaatggatgttagcagcactgcttcaataactgatctattctggatgaaatacccttttttatgtgcagtaaattctgaacaaggctaaattttaggatattccttgaactgaaattagaaaataccctgacaatggaagcagctctttcatctaagtttaataagagcctctttctccatgggccactgttgtgaacagaagccttttctggcatcaaaagctgtcacagtagcccttccatctctttcatgaaagcctcatagacatcatccttagtttgtactgagacaggaacagaaggaccagatttgggtgctgctttggcaagaggcacagcagaatcatcctctgactttctttggggagcagcagtagcccctttattctcccgacgtactctcagtgcagtgggcacaaatcgagtaatctctgccttgggattagtgatctgtggcttggcactgatggttgctgtggctttcttctcaatggtggctgcacttgtatcatccgccttgggtcgctgaatcaagttgggtggggcacttaaaaccccagggtttggcaagggagctggtgggaacagcccagggggggcaggtccaaggggaggcaccaaaggtgggcgcatcatgccaggacgaggtggaggaatacct

SEQ ID NO: 2552 - DNA, 3412 bp, Homo sapiens
gatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatg

SEQ ID NO: 2553 - DNA, 723 bp, Homo sapiens
ttggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttgctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatc

SEQ ID NO: 2554 - DNA, 1231 bp, Homo sapiens
cttggatctgcaagaaggagtggagagcagcagaagtggtaaattagaacatcattcattcaggacatgctgcatctggggttggcatcatttcccttttgaatgacagaatgtgcataaaagtctcttgcccacgctgaactcacacgtgcccggcaggaaggagctctcacgaagtgccagctggatgtgagcttgctctggcagcagcagtgctgtccttgtttctgagctgccacctattcactggagttaggtgggtcaaagctgaaatttagcttggaatttaagtttctaattttatacttttcattgtggtctggtcagattttagtctgcttcaaaatcaaaaggtcactcagtcactctaatatgatcattttgaatatggaaatttgttatttacatgctgtacctcaaatcaaagaaaaagcacgcgtcaatatcacgcgtaggaaaaactagaaaattgttccttttccattttgccaccctgctcagttttcctcataaacggttccagcttggaaaacaagagcttcccctctcagacagatgcagcagcgggaggaagggctttggtcttaaactagaagctgcagctgaaactctccccgtctaatcctgctgtgtgtatggctcacaccatctttcctgagtggggaaaaccgctggcactgaatagctgaaaggctcgctgaaatctgtgcttcaagaacgagttaaagacaatacaataaaacacatagacactgaaggggttcaactaatgtccatcacttattctgctaatgtcagtgcctttcaataaacttctcaacatctgtgttggtaaacttctcaatatttgttctagcccaaccacggtgacaaagctcccttgcccaaagatcgtgagcctagacaaaggtggataagaaatatgaagtctaaagctatagaatatagcagttagtgaagtaaattaaacatgcccctcgcctgcatgctgatcagagtgttgaaactgaagacgacattggcaaagtgactcagacccacagcacagatttgatcaagggcacagctcataaaaatagcaacaatttcgaattctcctatccaacgtttaggaaacaatccaatggcaagaaatgagaggagttcaatgccaacagtttgacctgtgggcaatcaacctataagtcctcaaaagaaaatttccttgctttccctgggaccaacagagatg

SEQ ID NO: 2555 - DNA, 5416 bp, Homo sapiens
gttcccgccgcaggcaccgagacgtcgcccagatggaagaaactctggagatgcgcgctcctacaccggtgccgcggcgcccgggcccagcaccacgcacctatgcgcgcctctgccggtcctcctagaaatcccgccctgcctacccgcggcgcgagacgcaacgacgctttcaggggtcaaagacctggcagaaatgacttcccaaccccagatgcccccagcagcagtatttagcagtcatacaattgcctgaaatgaagaatgagtaatctggatgagtcggccctgaaatcgacctgcaacttacccggaacgtgagctgtctctctctgacctctgctggctgcttcacctggagtctgagtccgactcatgtagcacttcactgtccgcgttagtttagccttcactgtcagcaactcgtcaccttgtcctcttgcagcgaaggtttggaatcccatcacgggtgtgcagtggttagtcctgagatcatggtggtgctaggagaacctgccaaccaatacagaaagttgtcacgaatagaaacctaagctctggccgggtgcggtggttcaagcctgtgatcccagcacctactttgggaggccaagtcggatggatcacttgaggttaggagttcgagaccagcctggccaacatggtgaaagcctgtctctactaaaaatataaaaattagccgagcgtggtggcgggtgcctgttatgccggctactagggaggctgaagcaggagcaacccgggaggcggaggttgcagtaagccgagatcgcgccattgcactccagcctgggcgacagagcaagactgtcaaaaaaaaaaaaaaaaaaaaacagaaaggagaagaagggaaggagggagggagggaggaaggcaggcaggcaggcaggaaggaacccaagggagggagggagggaagaaggaaggaaggaaggaaggaacctaagccaaggaaggaaggaaggaaggaaagcaaagaaaggaaggaaggaagggcgaaggaaggaaggaatctaagccaaggaaggaaggaacctaagcccaggaaggaaggaaagaaggaaggaaggaaggtagaaggaaggaaggaaccaaagccaaggaaggaaggaaggaaagaaaagtagaaaggaaggaaggaaggaaggaacctaagtcccagaaggaagggagggagggatggaggaaggaaggaagctaagctctctctcgcggtgccctgacttctcccggggaaggacctctgagctgcctgcactggtaatgacacgtaggtgaaccggtcctggctttcttagaagattccctgctgcataaaaccaaatcccgttgcactttcctgggttccttggctttgtcctttgtcatttccaggatggagcagaggcactggtaatttggcttttacttgcctggtacctctggcatggagtggctaaacggtggcaccatgtactagttgctgccatcttcagataaaatattgaatcaatatgacaaaagtcagatgaatactagctgccaattaccctgcttcccttgggggcagcctgtttggagcatagaccagctttgacctgcaagaactctggatatttggaatatttaaaattccaaatacagtatcccaggaattcaggtcagctgaaggccgattgggaagggcttaccttaaatgaatcagaaagaaaaaggtgtgggtgtgtgctaacattttttgagtatcggctatgtgccaggtactttttcttattattttaagcaagtctgtgaacatccctgagaataacaaatcatttgttcccatttcgcaagggggaaatctatgacttaggttcaaataacttgcccaaggtcacagagctaataggtagcacagttaggctttgaaggcaggtgtatctgacaccaaaccctatgtccaatttccaccatactaccagcaagatggaagaataatgaaataaagggaccaggcaagagccagtttcaggaatacttaaagggaaagaggagtcaggaggaacttagagaaagaatcttgaaacaagaggaaatgtcatgccaggtaaatcagtgagtcaaaaaccagaaacagctgtactagttggcagactggacatagtccaaggcaagaaaatcgtttttgtagggagattaggatattttggaccaagattgtgggctttagtcatcccctctgaagccactctgaaatcacctttctcaaaactgccataaggcaggcctaggcactatcacgtggacatcctactaactctgagtatagaccttctacatctcgtcacagacgcaggaggttcacattctgaaagagcatctctaggactaaggagaaacattcaaggacaggtttttcaagttaggaatgctcactggaaatctgctctgtcccctctgggatctggaagtagaatttcccaagcactaaatgctgaggcgtggactttccaagaatttcctgattggttaattctgagaatgtcactgatcattacagacggatcaccatgcaggaaaaggagaggctggtttgggttttttcatggggaaggtgaacttccagatcacagtgccctccaagacacagggcttgaaagtcatgagtgtcagggacaactcactgtgtcagctagcccagccgggctcatgcccagcacccattgatcacacacaaagctccattgtggccaggatagcctcataaaagaccgaaagcctagcagctgcctgccaaaacccagccaggcttcacaagaagtgatttgtgctgtgagcagagctttgaccccagttttgaactcagctgacagtcagcaaaggggaaaccagtctctgtacaaaacaggaaggaaatgagatgaaatgaactgcattataagctaccagagggtgcctaatggcatcttcaccacatagaagtcccaggaagaaagactgatgattttgcatgggagagaagcccagacaagcaccagggaaggaaagaaccgaggaaagctgcatttggcttggctgtttctcttcctccttgcctgacttaacagccactgtctgcaaaaggacacatctgtgtgaacccacttgcatgaggagcctagaagagacaaattcatagagacagaaagtagaacagaagttggcagggcctggcaggatggggaatacagagttattgcttgatggacacagattttctgtctggttgatgaaaaagttctggagagagattgtagtgatagttgcacaatgctgtaaatgtacttaatgccactgaattgtacactgaaaaatggttatgataatacattttgttatattttaccacaaatatttatgtgtatggtgtatgtatatatgtatatattatttatatattttatatatacatatatatgtaaaaaatataaatgtattatcatgatgtaatacttctttggagtaaaagcccaggtgaaagcaatcagctgacagggcccctacatctggaaattcttcacttgaatttttgttcatttctctttttaatttttatttatttatttttgagatggagtctcactctgtcacccaggctggagtgcagtggcatgatctcggctcagtgcaacctctacctcccaggttcaagcaattcctgtgcctcagcctcccaactagctaggattacaggcatgcaccaccacacccagctaatttttgtatttgtagtagagatggggtttcaccatgttggccaggctggtctcgaactcctgaccacaggtgatctgcctgccttggtctcccaaagtgctgggattacaggtgtgagccaccacacccagcctttttgcttttaattttttttttttgagacaggttcttgctctgttgcccagcctgagtgcagtggcatgatcatgactcactgcagcctcaacctcccaggctcaggtgatcctcccacctcagcctccctaataattgggactacaggcaaacagcaccacacccagctaaattttttaagttatttgtagagatgagggtttccctatgtttctcaggctggtcttgaactcctgggctcaaacaatcctcccaccttggcctcccagagtgctgggattacaggcatgaaccactacgcctggctctatgaatgttaataaatctttgccaggcatggtggctcacacctgtaatccaagcactttgggaggtggaggtgggtggatctcttgaggtcaggagttccagaccagcctggccaacatggtgaaactccacctctactaaaatacaaaaattagctgggcatggtggcagatgcctgtaatcccagctacttggtaggctgaggcaggagaatcgcttgaacccgggaggcagaggttgcagtgagccaggatagtgccactacactccagcctgagcaacagagcaagactctgtctcaaaataatcaaataaataaataaatcttaatttatttttctttccatttaggggtgcccagggcccagcttttgggttgttgcagctccttattcagaaggaagagtagttctgccattttactctctgatccagctggtgttaagtagctgggggtttgtggtggcatagtcagagatgtggccctaaaagggactctttacctttgaggactaaactcatttttttttcttgcctaaattcctatctaagcggtctggggagtcatgccctacaaatcataaattctcatcagatgggttttatttaaccctgtatgtcgtgacttactttccaatctgactctggcataacatcacgagacaaggaagaaaatcaaaatattttaccccaaaacgtgtttctttgccatattttgaaatgaccctgcaaagctgttctttgtgggggaaaatttacatctgtaaaagatctctattaaaatagctagatctttttcttccagaccctcccaatctaaagagattaactaggatctgaataggaaacatttgtcatctattgtctctaagggcagacactataagacttcaaaacaactttggtcaccacaatttttatcttaacctgaacattcccttcttatgaatcccaggtttttagacaaactcaatcaattgtcaaccagaaaatgtttaaattcccctataacctggaagccccaccaccgccggctttgaattgtcccgcctttccggaccaaaccaactatttcttcagtgtatttgatggatgtctcatgcctctctaaaatgtataaaaccaagctgggccctgaccaccttggacacatgttctcaggacctcctgagggctgtgtcactggtcatggtcactcatatttggctcagaataaatctcttcaaatatttta

SEQ ID NO: 2556 - DNA, 874 bp, Homo sapiens
ttgtgttgggaatgtgaaagttgttagaattcaaatagagtcactagtgttttaaaaaaacaaaccatgacaaatagagctggggaggccatgaagaggggattctcatgcttgtatgcctaataccaaaaatgatcacaaaagattctgcaaaaattacaaccttgcacataggctgctgcaacctcacacaaaaattacttctgcaaagacatctgcctagcaactgcctgtccaacctcggactggtgtgacctttgttattgatatttgtagccaaggataattatttcaaaaccattatgtaatcctcctcattttttcctttaaaaacctttgtttttctttttttttttctttgtttttttgagtcagagtctcgctctgtcgcccaggctgcagtggctcgacctcggctcactgcaagctccacctcccgggttcacgccattctcctgcctcagcctctccgagtagctgggactacaggcgcccgccaccacgcccggctaattttttgtattttttagtagagacagggtttcaccgtggtctcgaactcctgacctcgtgatccgcccgcctcggcctcccaaagtgctgggattacaagcgtgagccaccgcgcccggccatgaatataatttatatggacaagattcactttaacctaagtgtttccactaattctactaataggtttttaaataagtttactatcttgtgttcccacacagaagacttttctttgctctcagaagcatttgtttacaaacaccattggctttcccttcaattcagagaaaacgccctgtccaagtggcacagtgacatcatcatcatccatgagtcaaaccacctgtcctttttaggc

SEQ ID NO: 2557 - DNA, 399 bp, Homo sapiens
gccatttttttggaaacctcggcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcaaaaacaaaatgcccatgttggtcctctgccctggacctgtgacattctggactatttctgtgtttatttgtggccgagtgtaacaaccatataataaatcacctcttccgctgttttagctg

SEQ ID NO: 2558 - DNA, 375 bp, Homo sapiens
atgccgcccaaggacgacgagaagaaggacgctggaaagtcagccaagaaaaacaaagacccagtgaacaaatccgggggcaaggccaaaaagaagaagtggtccaaaggcaaagttcgggacaagctcaataacttagtcttgtttgacaaagctacctatgacaaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatga

SEQ ID NO: 2559 - DNA, 1486 bp, Homo sapiens
ggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtggactgttcagaagcttagaggtcattttttgtaattttctttttaatgtttactttagagagctagggatgcaaatgttttcagttagaaagcctttatttacttttggaaactgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttccttaaaagaacattaaatgtaaccattttgtcagatccatgtattttggagcataaaatgtatgctgttgtgaccaataaatataaaatatggtaattggaattaaccccacaccatagtatgcattgttatacatactgtgtacctaattatgtatagcagtgtagtctcaattatatctaaaagtaattgtgactaacaagtatgctttgccttatttccacatttaaagtacctgttaatataagggatttgtagtatcagcttgttgagcaatgactttgaatctagttttcagtgatcagaagcagcatttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgttactgtcacaactgttatgttttccagtaaactagaagtacgatatttgataattatatttgtatcctaaatttcaccacctaaatgtaatgttgattcctcaagaatgaaatgaaggcactacattgaaatatgttttgtataaatttgtcatgttgaacaacattttagcatggtaagttcccttagctatatgaattttggcatgtttcagagagatcagtaaataaaatattagataaaatataaaaaaaaaaaaaaa

SEQ ID NO: 2560 - DNA, 1198 bp, Homo sapiens
tcagcatctgccgacaggtctacctaatcttccaaactctgtgtaaatcctggatccaccatttaccagctgtgtaaccctggacaacaattccatctttctgacctcagtgtctttctctgcaaaacagcggtaagaatgatcctacttcaatagagttgctgtgaggattcactgagatcatgtgtaccaagctcctacaatagtactgaacccacagccatggatcaagaccattaacttataatcagtgatagccaagaggatgggaagagaatattaagcctggtgctctgcaaattaatacttgcagcttaaaaatacgctggacatgcgacaatggtgctgagtactttgggggaagatcacaacagtcctggtagcagtgtcacagcaaaatatttcagaggtaccagatgagctagctccaaggcaaatgaggcaatattatgtttaactgtttgttcggaaacttcttttattaaaaaagattttaaatattaatgctattttcaatacaggtgtgataacactcaataaagcatggtgtacttgatataaatttcggaatgtaacagtccatctagttcctggtcccctccagtctccaccacatagcctagtagcaaaacgtacacacccgtttaaaaatgaagaagcttttgggcattgggtgagcacagtggggtggggcaaggaaagtgctcgttcctgaattattcatgcttttggctttgacttcagttagtaacatcaattctaagagaactgagacaaactcttctatgttccgcaaaggaatggagaaaaaagcctgccattcgcaagcagctgtgggcaaaaccagcgcagagtacaggggtcgggaaatgagggattaaaaaaaaaagtcggagtaaagtgcacagttactgtcaaaaatatattattttgatcctaagaaaattaaaagattttatctaatggactagattgctgaccttttaatacatttggttttcattgaacatacaatcaccatcggacataaaaagactagtttgcttaaaaaaaaaaatccttggagttatctacaggaatcttgtggacgcaattcaaggataacattctgcagctctttggatattgaatgatgtcctcggatcagtccacaaaagaaacagggacctgttaatgcactgattcaagtgggcgtttc

SEQ ID NO: 2561 - DNA, 785 bp, Homo sapiens
gacatagatgcagctgttgtcggcctcctgctggtaatcacagttccggcactacgagagggcgagtgtgggggaaagggggtcacggaaggattccagacaagattgggaggagagggcagggtgatcccggaggatatgacgacaggactctctttggggatgggcaggacatgagagtcaggatcacttgaggtgcagcggagggcgaacagggagtccgatcacagaggcagggggcagggcggggccacgctgggaacaggtggacctgccggggaagaccccggcgctcaccgcgtagagcagaatgcggttctccttgtcttccttggggtacagcatgttgttactgtggggagggggaggtgccaggggttagttctggagccattcctcgcccgccttctaacatcacccgctccctccgcctcaccattcctggcagaagcgaatacccacgaagcccggctcgtaagtcccgtcgggctccatggcgacgcgcagcccgcgcagccctcccagccttccgcgcttgctccgccgcgctacaggtcgcgggaggggccaggcctaggtgcttcgccaaaagagggcggagctgcgcacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaac

SEQ ID NO: 2562 - DNA, 2646 bp, Homo sapiens
ctattgaccagaagccttaccaataacataaacagttaacacatattctgtatatatattgtatactgtattctttaataaagtaagctaaagaaaatgttattgaaatcataaggaagaggaaatgtatttataacactgtattgtatttgtactgtacgtgtacatggtctgtttacaagatgaatcgtctgactgaaatgactgctgctgcacactccaaactatggtatatatcaaagcaattcaactttttctagtagtgtcatgactttgcttcttgagaatacttccagcatcactagtggcattttatatgggtcccatggtgttattcaaggtttatgttattgcactaaacatgaaaaatacacaagaaccatgagagattatgtttactgtgatacacaatttactggagagatgaactgcccacatgcagattaacatcacacggtgttttaagcggatactcacaacacttgagctcactgcaatagcaacaggaggtggttatgaaattattgtagtactacagtatgtactacagctaatcttatgcatttatgatttaaaactgcatctttacatgtgtttactttttcccaattgtgaatggtgtcatgtacatctgtgcttgtgcaagttttgataaattttaactttttaaaatagatctttgtatattttccaatagtttataacacaaactagtatctacatatattttatgcattcacgacatacataaatttttcttaatttttttatatttctaggctatgtggttcatctgcaagttctttcaaattattgcaaagctccaaaaaatttcccaaaatattttttgaaaaaaatctgcatagaagtggacctgcacagaccaaacttgtgttgttcaagggtcagctgtatttgggagaggaatcccacagaactttaattgaaagataagggcttacacttcagagtaaaaaattaaagagaaacaaaacaataaaggaaaataataaatgccttctgttctaaagcaaatcttgcagttgaatacttgcagttgaatccaccaagacaaattaagaaattttcttttctatactggacagacccgaattctaaagtgtttgcattagaattctcaaataaaagggaaaaagccacccaaaagagtattgcaaggaaacatgtgaatgctcaccaaattcacttctaggcatatctcttcgattgagagtagcagagagaggtctcacgggtggctccactgtcaatggaggggagcattctccaccactcacaggggatgggccaaaagagccattctggctcagaggacctaaagatgacagcatcttgttagcattttaagacagcctttttttctttattcagttcttgggattattcctagggtaccataaccattacacacagaaacaaaaagtcacttatatacattttacatcaaaaaacagattgttgccctttacaaggtagctcccttacctctccgtggagggttttgtgtatttggttttcctggcattggttttacaatcacaggttcttcttgcagcattgccatcttttgtgttaattctaataatcttgaatatagagaaagaatatttaagaaagagttaaatatgaaatagaaaccaattccttaagagaacacgcgctgaaaatatagccatcaaaatccacatacttgtgtctcaaattggcagcttcccttttctcttcagctatagctctttctgcagcacgagctttgagctattgaagaaaaatatccaaattcagttgtgggagactatgcacaaaataagggaaagaaaaaaagaaatcttacccagttttcatgagctttcttctcatgggtagcgatctgaaaaagataatacatcacaaaatatgcatacagattcattataatagcctctattagttatcaaagaattccgggcactatatagtagggcactagaattattacctggtttttaaatgaccgctctgtcttctgtaattcatcctccatttcttcaattctccgcctaagaattacacttggctttatcatttaaagcacaactgaataaaaacccaaacaatctgactatgttaaccgttaccctaacaactgtaccctaatagagcttatccagaaatataaagcatattttacatggttggttataacaaaagtacaatatgatgaaaactaatgatacataatttcctttaacagctggagattgagttgatatattacaattcctttaactgttcctaaatatgttctcaaataatcctattattaatatcttccactataaaccttttttcatcctttaattacatcataaaaattttcccaaagttaggactactgggtctatcaaatggcaaaatcactttaatggcttttgatacatcatataacaaactgctcccaccccctccaacccccagaactgtttgcacgaatcaagttcccttacagttttgccagcactgggtatttgttaatatttttccatttgttaacttaaaatttagtttttcttttgtgtgaattgatgtattcatgtcctctaaccacttatttatgcttttgtgctaataaaaaaagccaacact

SEQ ID NO: 2563 - DNA, 833 bp, Homo sapiens
tgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggccagtctttctgtaggttgcggcacaacgccaggcaaaagaagaggaaggaatttaatcctaatcggtggaggtcgatttgagggtctgctgtagcaggtggctccgcttgaagcgagggaggaagtttcctccgatcagtagagattggaaagattgttgggagtggcacaccactagggaaaagaagaaggggcga

SEQ ID NO: 2564 - DNA, 4623 bp, Homo sapiens
agaaggaacgtgacttccacgaggcagccgccgggctggcgggccccacgttcagggttgtgtctcggctgaaaaaaaggcacgcccgaacgctgggcagggattacccggccggacccgggattggaagggggctcgaagacgccttagccccccgtgaagaaaaggcttccctccctcccagctccaaatacggtccctgtgatctgagaacattacggcgggcatagagtcgtcttttctttaatggccgtgtagtcgcggcacagccgagggtttctggaattgccttaaacgtatgcgtttgaagagcgtacccttttgtcggagcagtcaccttggagggaccacgcaggctatggcagcccgggttcagcatgtttagggcgagggtgtgctccatggggacctgccttctgatccgttttaccaggcatatatttaaaaaaatgtgtcttcctttccaagtattcacatctttttctactgaccacaaatcagatttaattcaactcacatttattgaacaagctagcctgttttgttttttcactttattcctgcaacagccacgtgatagagggattactatccacgtttcacaaacgataaaattgaggctgccacctgatgttactgaagtcctccacccaccttctttcgttcttttttaagcgtctactatcggctggggatggaatagttcgcgagtcagtttctgccttctgatggaggcagaaatttaaacagccaacacggtttcggtcccagaggtaaagagaaagggaagtccacactctgggtttatggccttgaagtcgagcaagctatactaagagaacagagtaagtacacccagatactattgtccccctcctcttgccattcctcaaacatgccacaccttgctccagtggacaatgggtactggcatcgtactgcaggcacagactgaagtttaactgtgggccctcaagcaaagtgtatgaaaatgtataaatgtactttgtaagctgcatggtgtgccaggacctaagctctgtcataccaggcactatgttagtcagcatgatccttgcttcaacaagttctcagtccagagaaaaacagacttacatatttgtgatacagtatattaaatgccacagtggagagatgaaccaagtgctgtgggagcacccactgtctgggcttagacctggaagaggaggtggagggatcagcaatggattcacacctgatgttagccacagctgtgggcaggctcctgggaagtgctgggaggatttaggattagttaacactacatataaacagtatgtatttctattacaagatacatgttcaaggtagaaaattcaagcttaaataaggcaactgaaaagtctctttgctatctctactctgcagaagtattatccacagtctgctatatatcactgcagagattcctgaaagtcattcaaaataaacagtaacatgcttacataaattactacatcttgactgtcacttaacttaccttagaaatcttgccaacacatccagatctacctctttattttgttaaggctgtatagtattccactgaagagaatggaacctctacgtgtgtaagacttggctgcaatgcaagcagctttgcctttgtactggactggaatggactggagccagacattctctccactcctggccttttcagctggcagagcttctgagtttcaggacagggaacatacagtgtcacatgcccagcaggcacataaatatttgctgccaaatctccagtgttccccagacccatattttcatgtaaaacctcttttctcttgcctggactactactgcagtagactcctcactggcctccagcccatcctccacaatgctgctagaatcatcttctgaacatgaaaattcatctacagtattctgctgaaaatccttaagtggttcatattggcctgattcttttttggagggtcagtgccccttttgagaatctcaggagcacagtggactccttccccaaaagggaaaaattacttcatgcctgaaagtcagcctctgccctcagaataacatatgaactgctaaacttggcactggctttcactactggccctggcctctctccaaccttctcaccatttgcttttcatatcttcctgcttcagtcatattgaattatttgcagcttcctctacacttcctgctgtttcctgcctttgtgactttgcataggctgttccctctgcctggaatgccctgcccagttttagccacctgacaagttatattctttcttgtactaaactgaagcatcatctcttctgtagtctactcaaccactctgggaagatccgggcatttatgctttcctcaccttgttctaaaacctccaatacagggctttattgtactgtaattgtcagttctcccaagagactgagttccttgaaggatggaactgacttttcaaatctgtagcctcatatgcagcatgggaactatcttaattcatcagcgcttagttgtggaatgaatagaggaccagcccaactgccaccaacacatatttcctaatcttcccctacgggaatgtctcgcatctataggtaattctagaatgaaacacagtgtttcctaaaccttagtcattcaaatagcatcttcacaactgttacaatatctatcatccacaggtacaatttattttttaagctaatcactatttgaacttcaatattgcctcactataagctgtaataactgtaaaatgatgtattgtgctaattccgtattttttcctaagatccaaatattaaaataaaagacagtcatcccaccactaactaaagtagtgtttcccacacttctctattaagaagcatgtgagatacttgttacaaacataacatcctggtcccaccccaaagccactcaatcaaatactccagggaagggatctaggaattcgtaggtttaacgagtgccccaaaatgattattacctgttggagaatctaggcaacaatgaattaaggaaagctctctaccatttggtactggtaccaggtttgaggatcacagggaagagggtaagcatatcagactagcagagctgccagaactcgggctttcaaaagagaggtgccaccctctcccatgtccatgtaagtagcaaacaacccattcagactacagcaggagaatcctgagtgtagaggttcatttatgctatacataaccaaattcatcataaaaagttttccaagggctgggcacggtggttcatgcctgtaattccagcactttgggaggctgaggtgggaagatcgcttgaagccaggagtttgagaccggcctggacaacatggtgaaaccccatctctaaaaagttagctgggtgtggtgctgcacgcctataatcccacctactaaggaggctgaggtgggaggaacacttgagccagggaggtcgaggctgcagtgagctgtgactgcgccactgcactccagcctgggtgacagagtaagaccctgtctaaaaaaaaaaactctcccagaactcactgagataaaaccaaggtttctataactaaagttgtacagaccaggcatggtggctcacgcctgtaatcccagtactttgggaagtcaaggcgggcagatcacatgagatcaggagtttgagacgagcctggctaacttggtgaaaccctgtctctactaaaaatacaaaaaaattagccagacgtggtggagcatgcctgtgatccctgctattcgggaggctgaggcatgagaatcgcttgaacctgggaggcggaggttgcagtgagctgagatcgtgccactgcactccagcctgggcaacggagtgagattctgtcttaaaaaaaaaaaaaattgtacacaaaacttcattttcactaaaaccaaagtcagaacctaggaaggcaaaacacaaaggttctggaaagaagtgctccatagggaggtagaattgatcaagtgacccgtcttctatctccttcttagctgtttcactgcatatgtccagtgcctgggcacaaggcctcaaatgcaggattaggtgataccttgatgtgaatgcaatggattcctgctggactagtgccaccaagagagtacttcctcttggtctttttttttttggaatatggcaagttctcaattaaaagatagactcttatcccctattgacttgcctcacagtctgcatcagcatcacctgagagctgattagaaatgcaaaatctcagtccccatccaaacccactgagtcagaaccactattttataacaaatctcctggagatccgtatgaacgttaaagtataagaaatactgcccggccaggcatggtggcttatgcctgtaatcccagcactttgggagtccgaggcggatggatcatgaggtcaggagtttgagaccagcctggccaagatggtgaaaccctgtctctactaaaaaatacaaaaattagctgggtgcggtggtgggcacctgtaatcccagctactcgggaggctgaggcaggagaattgcttgaacctgggaggcagagtctgcagtgagccgagatcgcgcc

SEQ ID NO: 2565 - DNA, 1574 bp, Homo sapiens
caatttagcagttcacatagtttattcagcaatataacaggagagaacctccattgtaagagacataaggcagatacagggtgcatctctggggtacattcttcatacagactaacaaataacttcaggtttcacaacatgtagcaagtatgatttgttgcacaccaacagccattcattcctcacgttttccttgctaaaagagccctggtcaggcacggtggctatgcctgtaatcccagcactgtcggaggtcagggcaggtggatcatctgaggtcaggagttcaagaccagcctggccaacatggtgaaaccccgtctctactaaaaacacaaaaattagccagacatggtggcgggcacctgtaatccccactactcaggaggctgaggcaggagaattgcttgaacctaggaggtggaggttacagtaagccgagatcgtgccactacactccatcctgggcaagagagcgagactccgtcaaaaaaaaaaaaaaaaaagggctgggcacagtggctcatgcctgtaatcccagcactttgggaggccaaggcgggtggatcatgagatcaagagatcaagaccatcctggccaacaatggtgaaaccccatctctactaaaaatacaaaaattagccaagtgtggtggcgcacacctgtagtcccagctactcgggaggctgaggcaggagaattgcttgaacccggaaggcagaggttgcagtgaaccaagactgccactgcactccagcctgggcgacagagtgagactctgtctcaaaaaaaaaaaaaaaaaaaaaaaaaaaaaaaagaggatcgcaagggggaaggacacaaagaagctgggaccttgataatattgataatattgctaaaagcactagatacctagatacctggcatgttaagtgtaatttaaaaattgttcagtggcctttgagatgttttcaacagctttttctaagtggcttaaccccaactctgggtccatgattttcatgaaagtccagaatgtggccaatgttcagcagacctccttagttctaagaaagatgcttcctctagactgttcataatatatatgaagtcaggcttgataatttcttttgtcatacatctcctgataggtacttttccatttccaggggaggacgttgtaaattcagtcaccacaaagacaagacagtcttttgtttatgtaaagccacgtaagtatggacaggtggcatttctgcatgtttctgcataacctatataggtgtttcctaatagaatgtgatttatctgacagtgaccagttatcaataatctcacagccacactgaggatgggccaaacagggccaatgatgaataaatggctatataagagcaaattttatctatctatctatttatatatatatctcatcactgaccaatgcataagaggtgagtttacaacagtgtaatttcttattaaaattcactggactaatctaggatccagctataacgaggctgctttcccacaaaagttatcattagaaataccactatgaagcacacagtataggacttcccctcta

SEQ ID NO: 2566 - DNA, 516 bp, Homo sapiens
ccacaagcgaacgccaggcggtggcacgtgtcaatttccacagagtcctgctttgcggggtgtctgaatgcactgcacggggtctctgctcacacttgctggaaccaatcgtggcagattttagtccacaggtcgcttttccccatatttctttgtaaactcttcagcattcttacagaattttttacggtccttagagtattcttcagctaggtcagcccgaagcgggtgcttgggctgggggtcattcaccagtgctatgagggactggattacttggtcggttttggttgctggcttccagttttcagcactaattactggcagacagacctgccccttttcgtcgatgtttgggtgatagatctttgttttaaatgtgatcttcggtggtttgaatgggtactctgctggaaagttgatttctattctgaaggcccccttatcatatggagggttctccttcatcagcctcctgctggccgccatcttggatttggtgctgctccttcctcc

SEQ ID NO: 2567 - DNA, 637 bp, Homo sapiens
ataggtgcttacaagtacatccaggagctgtggagaaagaagcagtctgatgtcatgcactttcttctgagggtccgctgctggcagtaccctgctctccacagggctggcacagagtggcagctctctgctctccacagggctccccgctccacccagcccgataaagcatgccgactgggctacaaagccaagcaaggttacattatatataggatttgtgttcgccgtggtggctggaaatgcccagttcctaaggctgtaacttaacggcaagcctgtccatcatggagttaactagttaaagtttgcccaaagtcttcagtccgttgcagaggagcaagctggacaccactgtggggctctaagagtcctgaattcgtactgggttggtgaagattccacatacaaattttttgaggttatcctcattgatccattccataaagctatcagaagaaatcctgacacccagtggatcaccaaaccagtccacaagcacagggaaatgcgtgggctgacatctgcaggctgaaagagccgccgccttggaaagggccataagttccaccacactattggtagttcttgctgcgcagcttggagaaggtgcaatactctccagctccaccgttac

SEQ ID NO: 2568 - DNA, 1432 bp, Homo sapiens
tgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgtcttttttttttcttaaattttttttttttttatgtgtaggtgcatgtcttggggatttaaaaatttcaaggctggtttacttatgcaaagcatgcctacgtctggaatacttagggaaagaaagcgactccatgttgtccgaattcctcaagggacagaaaaaaaattggagactgttgaaatgcagatttgaagtaatttttttaaaatattattttgggttctgcgacattgtgaaaaattaaagttgttgtgcaatacttaattcagacatgtaccacaagttaatggtagactaacactggggggtggggtctaggcatcatgcttttgtcagcatactcttgagcttttaagtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaa

SEQ ID NO: 2569 - DNA, 318 bp, Homo sapiens
agccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcccagcg

SEQ ID NO: 2570 - DNA, 685 bp, Homo sapiens
caagctaagaaactgggacgcgtcttgagaggcagaggactctaccgagcctactgggtcatcacctgaatccaagagcatgcaacacacctcagaccagaggccccaatacaagacaaaatatcaccttaatgtccaggtgaaacatactcacttcttcacccgtggacactcacttcttcacccgtggacactcagagctcccgtctctgtcagacacgtgtcacctctgctaacacacccaggcatctccgggaggacagggaactgtcatcttctccaagatggttctgctccacccaacccaggctttcctaaagccccaaactccacaccggaggcaacgcctgatgaagcaacgttcccaccacagcatccaccttaaccttccaaatgccactgctgtgaagaggagccatcgcagatcgccatggcgacagagcccttctgacccaggggatccactgctctcaggcactgtccaaccgacacctggtatagccgattgtttttctgaaaaaaaggtagcaacaaaaaaatactgccaattactggcaaaacatggaaatccagaggagagatggagcacttaagaattcagattaagggatacaatagtcccctcttagccaaaggttagttttctgctgtttgttatctgcagcacaatacaataagatatttt

SEQ ID NO: 2571 - DNA, 521 bp, Homo sapiens
ctcgcgaccgccctgggcggtcactggcgagtcacggactcgttccgccagcggccaatccaccccgagtccgaaacagaagacgtccctgggatgaaagacccaggcctggggcttaaggtcgcccagctccggcgctgacgggtgtggaccgcggacgtcgctgggacagcccctccccgctgctcggcggcggcacctggcccggccgctcctcgctgcgcttcgcctccgcctcctcggactcggactcgggtttatatcgcgcctcacttcatcccagtcccgggcgagcagcgttgggtttatgtctttatttgacgaaaacgagctgttgcgcagccattggtacctgtattggggaaacatagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaag

SEQ ID NO: 2572 - DNA, 3775 bp, Homo sapiens
cagatgccaaaaaagatgccaacagacactacattaccctaatggctgctacccagaacctttttataggttgttcttaatttttttgttgttgttgttcaagcttttcctttcttttttttcttggtgtttgggccacgattttaaaatgacttttattatgggtatgtgttgccaaagctggctttttgtcaaataaaatgaatacgaacttaaaaaataaaagctggtatcttaaaatgtaagagagtaagactgtgaagcctaaaatgactggctgagaatgaaccagaaatgccatttgccaaacagttgtaactagaaatttgattctcacggtccattcttttctttgtccttaagatgacattgttagtgttcacgtcccatgttcagtgtccaaaccggcaatgtaaaaagtatcctgtgtggtttaacaggaaatctgtttatgtctctttatttgaaaccagttttactctcagtggttctttaagttcaatgaagtctgccaggaacattggttggtagtattattccgacacctttaatttccaaaatctgaagttcctgctagtttaccaccttcatgatcttcttgaactggtaactgattaggttgaacttatggaagatttgtggacttaactcaaaagtaacctctcagtgttctatagaacatgtatttgtgtaactgaacctaccaggagaaatgtttggaattctatatgtgcaatttttcaacaaatgcaaaaaaaatacagcacatgtattgacaagcttctgtcaagcagcttgagttgaaatttgatttaagaaaataaatcatgattgttcaaagctgctgggacgttagaattaggccatgatactggtctcattttaactacagtggtatttggcactagtgtaaacttccatataaatcactcttttggaacaacaaagggggagggagaaaaatcacggcctgttaaatgagtaccaaagccgcccaacagtaatgagatgttctcatccttgattctcccagcctcaaacaacacagcttactttttttttcccttgctcagaaagtacctgtaatttaacaaacagactgcctgtaggtatagtgcaattacaaatgctctaatcattgtacatacatctctcttgatattgcagcatccatactggctttgtaatcattaattttttggcagattgaatgtgctgtattgatatgtatctatgtaattgtattgtatgtctatagctaattcacgttttgaataatgttattttatttacttttttaagagaggagaatgtaaatttgtcagtttatttctgactagggatattttctttccatttagaaaagaagaaaaaaaaaaaaccttactgtcatacagagcggtactagcgtcgtgctgtataaaatcatttgcacattcctgagtagaggtatactgattataagacccaaaggtaatttcatagcaaaatacataaaatcagtcggagcttttatacaaacatggaaaccaactttgtagaacttttgccatttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcagcaaaaaaaaaaaaaaaaaaaaaaaaaattaaacaacaacatttgaaggcctacagtgtgtatagagaaaacctcatcacaagatcataagtgttacagttttagggaatcaagatattctatttaatagagctatagtaaatgtagtcaattaaacctgatctcaaagcttgaagaagctgagcaaaacagggaaagattgttatatttgtctttatgaaattgggatggaatttgctatgcagaattgaggtttgtggcttcgctgttcctgtagggtgcatgacaagatcccttctcttgagaaaggaaaaaattgatcaccctagcagcagtgatgcatagaaacctaattttagccacaccagtcaatcgaagctaaaggattttcttttttgtttcttcggggttttattgaaggggctaggggcgggacgggattcttttcagttttgtataaaaacaaagtttactcatgctttatattatattgtgattgcaagcgttataagcgtgtgccactggcctcctattgttgatgcttaggtaatggaggcctgtggtgagttttatggtgacttgggcatgtcttattcaaaaacaaaaacataaaacacagaaacctttcttcagcataccaaggcaagcagccatttcatgactcacttaacacattgcagtgtaccagtttacagatgatttttccctttttgcgtgacatggcagttctaacccccagagaattccttatttgtaaattggaagtttctactatgccttacagagcttaaattcagaagtttgtgcctcatatctgaaacaaagggaaataacacacccattcaaaagtaaataaatctcctagaagtttttgtttttaacatttccatataaagagctctgttgaatgtcatgaatagactggaaaaaaaaattttaagaacctgcatatgttgtttactagcagatgacaactacaaaaggaatctgaagaacacgtaaaacttgtatttttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaataaataatgggaagaaagggctgtataatgaaatactgcaagactcacatattggttggaaatttccctcaaatcacctaccgattacccttgatttccctttgttttcagtttctcaaaacgaatgaaatgaaatatagcagaatgttaacccatataaaaataaagtgtacccaaatattgtaatgtatattgctgctcttcttcaaattaaataagggtttaaaaccacttaattggtaatcaacatctcaattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagttgtatatgattagctagagatttttggagccagacacctgctgtttagtagataacttagtacagaccctaaacttgtcatttgtttttctcacagaatagccatttcctgctgtcttcccaatgatcactgccctttcaataacactcttgcctctagaatcatatgttcaaagtatgaatacacacctagcacatagtaggtgctcaaatattaatttcctccttgccttccttatctaccctgtgtcctccatttccccgtatgattccaacccaatatagcaaatgacatttacatgttatgaaaacatctattgggtaaa

SEQ ID NO: 2573 - DNA, 3281 bp, Homo sapiens
gtttacattcccaccagcagtgtggaagtgttccatgattgccgcatgcatgccaacatctactgttttttgatttttttggttatggccgttcttgcaggagtaagggggtatcgcactgtagtttttatttgcatttccctgatcattagtgatgttgagcattttttcatactttgttggccatttgtatatcttcttttgagaattgtctattcatgtccttaacccactttttgatgggattgtttgtttttttcttactgatttgtttgagtttgttgtagattctggatattagtcctttgtctgatgtatagattgtgaagattttctcccactctgtgcgttgtctgtttactctgctgactgttgcttttaccatgcaaaagctctttagtttaattaagtcccatctatttatctttgtttttattgttggaaactattattctaagttaagtaactcaggaatggaaaaccaaacaacctatgttctcattgatatgtgggagctaagctatgaggacacaaaggcataagaatggtacaatggactttggggacttggggggaagggtaagggggggtgaggaataaaagacaacatatatggtatagtatatactactcaggagatgggtgcaccaggatctcacaaatcaccactaaagaatttactcatgtaaccaaataccacctgtacccccaataacttatgggaaaaaaagatattcatcgacctattccaggtcctctctccaccactgagcctcgtggggacataaagagctgcctgccctcccctgttccccttgcctttttgcagcaggattcctgaaaatgttgacttacagatacgtttttgagatatgaacgtttgttatttcctggtgcttagggaagaaaataattgatgttgtgagttgggcgggactttagggactatgctgaacaatccactgaccactgcaggctcccatttatgatcttgggccaacagccaccagcctctgttcatgcagtctcactgagggcagttacttctttggagtggcatgcctctgagcagataattccaataatcaatgtcaaactagatattgaaacagcccaagtgtcctggtaaagctagctgttgatactcctgactgttgcattattttgttttttgttttgttttgttttgagacggagtcttgctctgtcacccaggctggagtgcaatggtgcgatcttggctcactgcaagctgtgcctcccgggttcaaacaattcttctgcctcagcctcccgagtagctgggattacaggtgcatgccaccatgcccagctaattttgtatttttagtagagacagggtttcaccatgttgtccaggctggtcttgaactcctgacctcaagtgatccacccaccttggcctcccaaggtgctgggattacaggcacaagccacagctcccggcccaactgttgcattattatttgcaaatgttggctatccctgctgttgtctatatatcaattttgtctacccaacacagctgtaaacttctcaaggtgaggagtgagccatcactctttgcacctcttgctgtgattgacatggtataccttaagatatatgttaattcctatgtcttaataaatattggcttatggagaatttgttggagcaagtacagaccctatgtttaacttcttttattcaacagaattaaaaaactagctagttctctcaataaaataatactttcttttctttcttaaaatctagctgatctggtctaaaatacacatgtgggaggcgggattgtagaaatatctcaaattaattagcgtctagctctttgtaaggtaattgacagtctgagttagttgcttcccccactgcaaagcagcaaaatctgctctcaaaggcttcacgtagccgggaaaactccgttcccaattcagatcctctggggagggcatcaattatttcctattgtttttagcaccgattgttctgtctaatttgaaaggatccaaaaaaggaaatgatacttggcattagtatcattctccatcactcttgaaagatatatgaagggaatgttggcgcaatcagtctagaaacatatttctcccataacaataagccagttctttttgctttgaatcagaaatagctccatcaggcccatgaaggaaagggaaacaaaactgagtgccaagcatatgataacatgctcagcatcatatgacattaggggattgcaaattgaaacaacagtaccaccacacacctatcagaatggccaaaatccagaagactgacatcaccaatgctagtgagaatgtggagcaacaggaactctcattcacggctggtggggatgcaaagtggtggagccacttgggaagacagtctggcagattcctaaaaaggtaaacatactcttactaaacaatctagtagatttgctcctaggtgtttacccaaaggagttgaaaacatgtccacacagaaaacctgcacatgaatgtttatagcagctttactcaaaattgccaaaaattggaagcaaccaagatgtccttcaataggtgggcggataaagaaattgtatccaattctatttctatgaggaaaatctattcatacaatagaatactagtgtcagagatttttttttaacaaagagctatcaagccatgaaaagataaggaagaactttaatgcatattggtaagtgaaaaaagccagtttgcaaaggctagatactatatgatcccaactgtataacattctgaaaaaggcacaactatggagacaataaaaagaacagagttttggatgaagggagggatgaacaggcagaatacaaacaaattttagggcagtgaaactattattatgatactttatggatatagaatattatgcatttttcaaaacacatagaatatacaacatgaagaatgaatgctaatgtaaactctggatttttattaataatattatttaattaaaatgatttattttacttattttcattattatctaaaatgttatttaattattaaatttagatgctacttaatttttgctttattattattatgttaatatcatcaactgtaactagtgtacaacactaatgcaagatgttaataggggaaatcgtgttggagagagagatatgtgagaactctgtactttcttttcaatgtttctgtaaacataaagctgctctaaaaaattaaatctattaaaaaaaaaactgagtggaaaaa

SEQ ID NO: 2574 - DNA, 2153 bp, Homo sapiens
ttaaatttctatttagaaacttcagtcaccagtgaagggtgtccacagaaatcatatctaggtcctggaatcttcctctttcttcatttacttcttgtctcttcccagggtagccaggacctgtggactgaagagcaaaacaactttcaggggtacattcaccttaacacgtggccctgaatatttgtctctttatttggttctctcaaaccaaggaaacacaagaccctcaatgtaggccaaatgcctttcttcggtgaagtgtggaagtaacatgaagatgaaaggggaggtcacaaaggagaatccacatagcatcatgcctaagcagttcaagagcatgggttgttgtggaaagccagaggattagaaaactcattgtggaggaggtactcggacctgaaacttttaggaaatgttaacgttcatcaagtctgttccagccaaagtttgagctcaacacacacacacacacacacacacacacacacacacacacacacacacacacacaaaaccagccagggctcttgtgaaaagacttcggctttcacttgtctctagacaaaagaccaccaccccgccagataaaataggaaaacctggaatagacacacacgtacactggattcccttaatgattcatcaatcactaagcctcagattaatccagaatgtgaaacagaagtcacattcgttgacaaaagccaccccatcgattctcaatcactgagccccactggggagtgacccgcgaggaccacaatccctgacctcagtactcttggtcgttgatctattcaggcctttaatcactgaccaccagagcctccatgagggaccccaaagatatcctatcacagacacccaccagggactcctaccagctcccctccaaaaggaaacacccgcccccgcctcccccaacccccgcgctacctccaccatatagcgccaccaacaacgcagacgccctcagaaagctccctcccaccacgtttccacgccctgacccacacactgacctgactctccttggaatcgccgcgacctcttaaaagctgaacttacttccctaaacttcttccacttctgggcccctcgcccaactccctccccctctaaacctccagagacggtcagccgcgtttccatggagagcggaatgcggccttccggcttttcctcaggaggagacgcgtccgcgccggcgtcgcctcgccgctctgggggcggccatctttgagtacgtgacgtacagaaggcacagcggccgggagacgcggtggacggaggcctcttaaactgtccgatttccagacacctcagccctggcagaaaatggagagcttatcagaggcttgagttcacacaggcagacacggcgtgggggtaaagtcctctgaacagacacggaacagaaataagttagtcttctcctcgcaggggacagtgaacggcgcaaacttctcaaaggccagaacccattattaccacaaaggcgcggcatcccttcttagcggttatgatggctgtgacgtctcagctcaatggaaaattaaagtcacctctgggcacctcagtcactattgtaaatgcgaagcgttttagaagccgtataaaaactgaagcaagagagactagaacaaaaaataagcgagcggtgcgttgcaggtaacggagccagagcccttaggggagagcatcatgggggcggccatcttaggggacgttcggtgtccgtacggcagaacatattctctctgagaagcttgcggtggaactggcccatggaaatgtctttagaagagaagaaccacctggctctgttcttgactctggaaaagaatccttttctagaattatttaggttgttgccagattaatttcctttagagagtttccttgcccccacgacttcctatctttaaagccaacaatagtatgtgaaatccctttcatatttgaaaccactgactattgctgctgcatctctccggtttctcctattcttaagtgcttgggcaatccagaataatctcccaatgctaaagtcagctgattaataaacttaattacaatgcagagtcctttttgccatgtaacataaccatgggaattactctggggttgtagatctggctatgatatga

SEQ ID NO: 2575 - DNA, 5228 bp, Homo sapiens
agtggcgttgtagttagggacgtggtgtccccccttcgttgttggggtgtccgaagcttttttttttttttaatgtgatcccgcccctcccccgcgctctgtgacgcaccagagacgtcgtcgtaaactgggtttcctggacgcacgccagtgattgacttggaatgaggagaggggcggggccttagcagttgccctgagccaggtctggtaggaagggcgaggggggccagggtggggggcgggcaagatatttccagtctccagcacccacaagttggactggggaactaacgcagaccttgaaggcagatttactggattggacccccagctccaacacagtcctcctatggccttaggcaagccaagtaaccgctttgtgcttcggtttccccatctgtaaaatgggtataatatggggactacatgagttaatgtatgcaaagcacttagaacagtacctggcatagaattttgctattgtaataaaggctatgtgacatcatctagtggcatatagtcttacatacttatatcgaggctgctcatcttgggaaggagacacagtctgagtaattatcagaagcaaagcaggcagatatttcaaagtaaagctatacatcttttcttggcccagagaggagctacaaagaaagtatactggacgttggaaatgtatcatttttcctctcaaatacgaagctagattaaagcccattatagatatagtatatgttttttttttgtttttgtttttgtttgagacggagttttgctcttgttgcccaggctggagtgtagcggtgtgatctcggctcactgcaacctctgcctcctgggttcaagcgattctcctgcctcagcctccagagtagctgggattacaggcgtctgccaccatgcccagctaatttttgtatttttagtagagacgggtttcaccatgttggacaggctggtctatgttctttttgctcctacttttgccataacagaccctgcccttatgtcctgttgcctgtaaaacactgttgcgaagccccaagaaatcaattacgtaacagtgaagagagaaaccggttgtttaattgcagtcacgtttatttgcagtttctatacacactttctaggtaatcaaacttttctgatacattttttttgagaggggttcacaatgaaactgtcaccatttttactaaaaataaatacaagacttaaagtgttgcacagctctaaaatatacaaaggcttggattgaatgtaaacgttgaaaacatcttacaaaagaaaccatctttgcagcaatttaaaaagttcatatttacaaatattacaaaaatacaaaatggatgcaagtccataaaccattgtcgtttcggccagcatgaactggttctagtaccaaaatagttacactgtaaccttcttcatagttttaaatctttattaccatctagttctctacgtgccaccactgcagcaaatgcactcactcactgacctttggcaagagcaaacagcatgttctgtttgctacaactagtccatgtcctctacttagccaaaaacaaatcaaaacaacaacaaaaccaaagtagaatttttaaaaaatgaaaaaatttcccctacacaacatagatacgttgtataaacataaaagaacaaaaaatcgcatcagtgcaaacaacagaagaaaagttcggattgatgttcttcacaatacctaacgtgtgtaccctgcttcaagacggcagtgatgttaaagacagccctaaatcttggtcttgtttgctatgtaatcaagccatgtagaatattccagattattagggaacttcctgctttttcttctcagtttgtaactcaatactcttttccacagtgaattttaaatccatctttatttgggttttttaaatctatgaaatataaaatagagaaactctgctatagatttttagagtaaacaaaataagtaaaactatattataagggttagttctgtgatcattacatatagaaggtatcttattgcctcacaattcaagtcaatatgtattttaaaaaatatatggtaccattacttaatgtcaataataaaaaggtgacatttttattaaagccaattcatgtgttttctattcaagatttagaatcacttttaaagcccacatacctttcttcacacttaaaaaacccctaactacacaaaagccatactgcaaacgaactgcttttatgaaattacgaaagatcgcctactgtgactggaaatgacggtttcttatcgcatttgcctaaaaactttatttttaaaactttgcaaggtgtacttttcaaatcatgagacagatttattcatgttcccatgtggtgtcaaaccatgctggttttcttaattaatgggttccaatgagaaatggtggtccattttattcaaaccccaaaatatttttcttttaagaaaaagtgtgacattttgtaaatgttcaaaccctttaccaggtagcttatctatccccagtgtgtgtgcgtacacacacactcacactcacacacacccatacacactctctctgactctccctcctcttatacccctccacccccagcacccattttacatacaaggatgacaagaaatttagtaacacagtttggtagtgaaaacaaatagtagaagaagccagacattttttttctttccaaacaaacaaaacaacagcaatcagattatctattcttaatctgtagcagtttagaaatcatttctattgaaagacagtatcttcttagaccaggcttcctccttcattttgcatgaattaatccaaaatgcaaaccctcttccacacctcctactttcccaactaccacttgcataagcttaaagccagcagcttgtcaatttcttggtaacattggtatgttctatcactctaatcacattctagtcttttataagtcagatcccttcttaattctctctctgttctacctctcccattcaaaacctattctaagtacatagctgcttatatttctgacataagattccaaacattagtataagttcatgttaaaatcagaggtgtaaaaaccatttgcagattttaacgtgtaactacatttttttttcagttttaagacaagaaaattcaagtaatttcaagtaattcagcttgtttccctgcctttattttatcagagcacatgccctgacatttcctctcccaccctccaccctccccttttgccatcaagcagacactatagtaaaaccagacaaaaactcagttgtatgtagtattgtgaaccagagctgttccccattcccagtttaacaatgagtataaataatgcatatacacatacctattttccaactacattgttcacagtgtcatttctgttaatttttaggtagcatgaatctcatcagcacagagagaaagcttcactgaaaactcattacaggtacttactgattaatcaatagctctgtggcatgcttaggttttatttttgttagtttaagaacctggagctaatttctaaactgtttaaggagtttaatgattacagtcattagttatgaccgtttatgtccccagtagcctaatataaaacataacctaaaattaactactattttccctactcattctctttaaagcaatccattgaaaaaattaaaatctaaaggacactgtcaaatgctgttgttcagggctttgtgttgagaatgatgacttctctcactgattaaaaaaaaaatcaaaagcatgcttttcattctgtccaaattaccacacaacaaatcacagccatgggttgctattagtttgtttggtgctgcaatttgtcataaaaatgattagatctgaattcattattttaatttattcatatttcagtatatgacctcaagatttcctttagttcaccagtttaaaattcatatttgaggtttaccactcagaaatcatattggtggacatttaaatatggcatttgatatgaaaatggtattcacagaatacagttattacattttatttttgtgtattctataaacagttggtgtgcagtagataattgaccacatgtccactcatcattgataaatctatttacacatttttatcaaaaatatggtatttacatatgtgtagttctttcttctaaattttgctttagtttgttttaatgtaaaaaaataccaaacatccagagtaatttcatcttcttaaagaataatgacagtgagggctttagtttctgaataggcagctctgggaaaacgttttctaggtgtcatgaaaattagacaattttgtatcctctattttcacaaggaaggagattgcgtaaatcaaactatgctaaagaaaaacatgaaagactgcagctacttaaaatatggaaactaatcaagaatgtctaaaccactttctgtttacccagcacatactgtatttagaaattcattcattgcttagcagtgatgctaccccatcaagttgagacttttcccaagtcctctgttctgttcctccatcctcatgtgagtaagggttttggcctttgccaggcagcctggtacaggcagtctatgttgaactctgggaggaacggtcgtcatgtgggctcccgtcagaattttccgtctctccctcggagattgcctgcatgggcgtattgtacagccggcagcggacactgtagcggctgctgctggctgcaggaggggcccgagaacgtccaacccttgctgatgctgaggtggcaaagctcttcgaggaaaagccttctgcattaactcgtggggagcatggagagagtggggacaatgcctcagccccttgtgacccctgatgggcatcatcggtgctctgaggggactctgctgtgagctccccaggaggtttgggcagtatggggctcttcaggatctcagtggcagacatgcggtaactagaatctgagcgactgcctttcttgagcagtaacagcttaaactcttcattggatgtgttggactttttggcatttcggtatatgagaccaggagacctctggctgttgggggttgtcacattactgctgggtgaagtgatggaactggcgctgctgctgctactgctgaggggagctctcgatttgcttcgaacagacatgtccccggaatcttttcttccaagtactttcctcttggatctttg

SEQ ID NO: 2576 - DNA, 2378 bp, Homo sapiens
gttcatgttttcttcttttctcttttcagttatcataatagaaaatgacaacagcagcaacgctaacaaagtgagatttcacagatacatttttacgtcttttaaggttagatatttttaatcaaaagagcacagcgaaatcctttattaagaaagagtcttcactgtagagaagtcagtgatcgcatggtgaaaccaggtgcttgggtagcaaaggactccaagaatagttaaaataccttttatgaagtcaactgcttacatttacaagttgatcatgaaaacatcagtaagacacaaaaacatttccgatgctctcggcatgaagaattggtatctggagagtagcaagttataatagtaaggtttctgcaaaagattaaatagtataaagaatattagtatgccttcaactggcagaaataggactgggcacgtggaaaaaggtcagaaataagagaagatgcagatttgctcaaaggctgctacccagcactcccatgcccaccccattcctaagctcttccccaagcatactcttcatatgcattggtgaggggccaggtccctggaggtcccagagacacaaagttaagggtagggaaaagttcagccccacactcccatccactttgtagggctttctccctccagtctgggggtccctgactcagaacacatcatacacttttatttcagaatttatggcgtccattttgtgtactttttggctcttccattctgcttctggcagtaactgttttctcgctccagggagtctttgatcgtcttcagtcatgaagatttgcattgttttgtcctttgtcactttccctcttcctcaaaaagaaacccagtaaatgctcaaggtctgagctcagaaggacgcgctgggaatgagaaggtgctgtgataattctggttatccagatttttcagagaggtcccttttcctgcttggaagctgtgggctctgtcctctgggttctcagtactcagttcaaccaccttctcctccatccctctccgtgagtgaccatggtcaggggcctgtggagtgggccagggtgggtggggctggggcaggtgaacatagaacattcaggatctggctgttccctttggctccctgagcagaactccctgggcctccctgtcatagcagctcagcccaaccctggcacttgctcttctttttttttttttttgagacagagtctcgttctgttgcccaggctggagtgcagtggcacaatctcagctcactgcagcctccgcctcctggttcaagcaattctcctgtgtcagcctcctgagtagctgggattacaggcacatgccacaatgtctggttaatttttgtattttttgtagagacagggtttcaccatgttggccaggctggtcttgaactcctgtccctgcccgcctcggcctcccaaagtgccgggattacgggtgtgagtcactgcacccagcctaagttgctcttttgaatcacctaattgcttgtagaggagcaatggaggggcacacagaggggtaagcacagagaacattccagaaaatgcaggaccctttctctgaggcacagctatgtaacaggcaaccccacccagggagaagccagtacagaggccccagctagagtctgaatgaggacgatccctctcccctgtcctggggagcctggggtcaccttgcagaacaagatggtcccaggactctgactctgcacttctggctgtagtgagcctctttctacgtgtgggtgcttctgctgggctcctgggtgttgttatttaccaccagcaagcgatcatcaaatcatgtctatgttttaaacttaactagctgtctcatctggtcccatgttcctggaatgtagtttcaaggatccccaatctgccctctgaaggccttgccccgtcatgcctctaggggcaggaggcccatacttccatgtcttctgactcagcttgaccacaacatgggatatttgaaatcagggctgctggggagaaattccagaaggacggccgccgcccctggtcaaaactcctggttctagaacacaggagaagccaaaggccgacagcaagtcagagctacgtgccaagcctcaccccatggtggtgcagggtgtgccgtcctcagaaggtgaaggcatacaccacgcccaccaccacgatgttccccagcgtagctatgatggcaatccatagcaagacggcgtcgttggaggaccgaggaggatcttccggctggccctggccattggcagccgcgtggacattggcagaggagttaaacagggagtactcggtgctgaagtcctcgttgggcgagtccatgaaagctccccccatcatgggcag

SEQ ID NO: 2577 - DNA, 1634 bp, Homo sapiens
tatttgaagagtattttatttctgtattgaaaatgttacacaaagcagtaaagtttttgagaactagtgaagtactaattatcaaggacattttgataaaactgccaaagtttgggtttatatcttccctttgagcagcattctatcagtgctgcctttagctatactcagagagcagcagttgaggaataggtttttactcaaaatctggccatttgtgaatcctgtaaaccttgtgatcttcaattactttgatgttaaattaaacacagactcttctataaatattttcatgagatactgtgttacacaaagtccttgttttaacttaggtatgggtaaatttacattggtggtattgcaggaatttttcaaaaacattactgtaatgaataactgagtttcctatagaagaacctgaataattacttttgtagtaaccaagcaagcatcatatcttaagtatgtgatcatttgcacttgttacctcttaatatggatgcaacttattaaaaatgttggcctgggtatttcaaagggtatatataaaaggtaaaaaactagtgtgccaaatggtataggaacaactgtactttttttgatcagttggcatgaagccatagaattaaattttggctttagaatacagatgtgttcattacattccccaagggtcaaattggagcttttaaagaattaaagcttctatgagtatatggtttaagaattaaattattagtaatttattattttaaatatttgacctcattagttgttaattttttagttggataaaaaaaaaactcgctgacataatctccctagtgaaaacttgggtaatatatgtaagaaatggcaaataaataccttagttaatgactttttatgtagaaatttgacagcattacaaattaagtgaccattaaaaacacagcaatcattcatactgctttcataggtgttatgatagtctctgattaatcaatctagtatgaattattttacaagtgttgtcctgtttcatatctttgaagtagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaattaagaatgattttcattacttgagtgggatttgtgatttaatgacagttgaataatcaaaaatattttattaggcccccaaaatttaatagatatctatttctgttacattttattactgtatggcacaagaaagaagtgacattgggtatgttagaaatgaaataaggagtaaaaatgcattaccatttgtttaataattatctttacagaatgctagtttaatgacttttttaactgaattttttgaataaatcagaaatgtttgtattg

SEQ ID NO: 2578 - DNA, 26931 bp, Homo sapiens
gcagtcattaaagaatgttagccaggtgcagtggtgcacgcctttaatcccagcactttgggaggtggaggtgggtggatcgcctgaggtcaggagtttgagaccaacctagccaacattgtgaaaccctgtctctacgaaaactacaaaaattagccaggtgtggtggcacgcatgcctgtaatcccagctacttgggaggctgaggcaggagaatcgcttgaacccgggaggcagaggttgtagtgagccgagatcacaccactgcactccagcctgggcgatagagtgagactccgtctcaaaaaaaaaaaaaagaatgtcaactgctcctggctctgcagaggtatggcccaggtgacagggctattgagaggccaaagggaccctgatcagccagtggtgtctttggaataggtgctgcaagctctgggaggtgctactgcgcaccagaaggttggtgagttggccaagggtgtggagctggctccagaggggaaggaacaaagggaagggaccctctgggagctggagagacttgggagcctggaggcaggaattccctgccattgcctgaggcctggtttggaaagtacaatgcagttttggcatggtggttgctggcctggaatgtggtggggtgaagagcgtggtggaaggacacactgagttcctgaccatccagcaacaaaggagcaaaaagaccttggaatccatgagaaggtaggagaagtttctgccggggtgggacgggagctctgaactggggctggacagtcagatgggtttctgggtgagaaggctgcttccctcacaggctacaacagttgtaatcagaaatggtcgcaacttttgacagggtccagagcaaaggatacagaaatgaattcgctctgatgaaaagagctggaaggaactgaaaattaaatatgaagcctgtggctatagttagagtttaggaagtaacctatttaaaatgggatgcacataggttggaggtaggtggtgaatgtattcagatgataataactagtctaagtagaaagaatgaagtatggttaaccaaaaaatgcctctggagtgctagagagatgtgatgagaggacgtgtgagtgcatcttcctgtgcactatgaaagaccagtgactttgagatgctgacagtgatgaggctggtgggtcttctcctgtcgccaacctccaaaatggatattcagagtccttccagctctgattctcagagatctaagtgagacgtgggaggtctcattgaacatttccaagagctgcttctgatttgttgctgatgctgaatggtaccgagttcatgcatttcaagtttgtgcaatgaaaataaaatgtgaatattcaccccaaaatgtgaatatgcccccaattctttgaaagactttctaaggaataaataatagagtggtagatttctgccagccttctgccttgatccttgtttcaactggcatatttccaagcatgttgcaggagtactttttcaaattggggcttctgtgattacatacatagagagaattttaaaggggtctcccaaatcatacatagaattttgcatatgattacattttaaagggttataacattgcctccttaaatatgccactgcatgctgaccagaagaattaagcagatctaaaaatcccttgcagactattcactccaactattagatgcagaggtgcaaaactataccaaattagcattgtaaaaaatcacttgcattgtagacactataaggaagtagttaaaaagaaatttactctgatttttttttcattatttcctgtgacagctgaggacactcatgtttgcagaaatgttttcattttcatttagatcccccttctgtttgatattagcaaaagtaacaatgcactgtttatatcccatctgttgttggcgtcaaagaattcttatggccatggaattgatcatgaagaggaacaaggagagtcatgaaaagatgaaaactattctgttaaatgcctttgtaatcaaactactggatctgagaaaaaaagtaccaactgaatttccatgtatttaaaattttttgtgtgtgaaaacatatagcaattggaaatctgtcaaggcaagtaaaaaacttttcccaatgttaatgaaatttgactcatgatatttatctacaagacataaaaatatagatggatcccagatactcaggaggctgaggcagcaggatcactggagcccaggagttcgtactggtggagaaaaacattactcacgtggtgacaaagtaccaggcagttgtaatgcacagccagagttaagattccctgctccttaaaaggggttcccagactcgcagcatatcggcgtcactggcagacccactgcgtcagcatgtgcagctgaaccatgtcccaggtgatcagtgattcatggtgactcgtcatccaagagcgtgttcctcttggctttccccacctccctgctttatgctctaatctctgcctgaaccatcatttctcatgactcctgcgcttcctccttcccatggggtaaagtccacacttttaatgtggcctccagccctttgcagtctgtccagtctccccttcagtctcttttaacatcacgtgaaccctccactccagtcaaaactccctgtagtttttggcctctcagatcctgtgtcattcctgctttttttccccctttgaaacctgagattaaaccctgctggctctgggaagccacttctaactgccatgacacagcacaatatccctttcctccggcacttactgtttcacaatttggtgagcatggcatgctgccttatactgtgatttaatcctttttaaaggttgaggtataaaataacataaactgtgtaaacagtcctgatcttaagtgttcttgatttttttttttaacatctgggtacgccttgtccatttttctttttctttgtatgttttatctacctatctgtactgaatatcatttaagggcagaagcatgttctcatctctagaaagaagccccacatggcatgcatgttttggactaaatctttccctggattgtcatttaaaacgtttttaaatttaaaaaactatttatttttatttttttgagacagtctcactctgtcacccaggctggagtgcagtggcacaatcatggctcacagcaacttccccctcctgggttcaagggagtctcctgtctcagcctcccgaagtagctgggattacaggtgtgcaccatcatgcctggctaattatttttttgcatttttagtagagacggggtttcaccctgttggccaggctggtctcgaactcctgacctcaggtgatctgcccacctcggcctcccaaagtgctgggattacaggtgtgagccaccacgccccacctgtattgtcattttgagtaaacactgctgaattgtttgtcctggcatttctcagcagggagaggatgtacaaaccctgaagaacagaggcaaacatttcattgtggacaaatgctgtgaaggaagaggacacagctcttgagtgtccatacttgggactctgtgcgcttagggtgcctgctttacctgcctgtctgctgtcatcagaaagctcgaggcactatcaggagtgaccacccaggccaggcacacgtttgctatgcagtgcaaggagcccactgtgggaggcaccacaccaggcccagagactgacactatgacagacattgcctggcccgggctccctatggaatttgcaatctaatgtagaaaaacaaacctaggtaaaccagacagcattttgctaattccagtcagttgattcaacacaaaaacaaaaacaggggtctgctcatcagtttccttagtgtccactggcttgcagctttttgctataaagatcttgagctttggactttggctacagaattgccaagaggatgttgtgtttttgcagaggaagtccctcccttctgctttatagtgtgcttggccagctgatgctgatactatgctcagttaataaggttctcttatcagactggtgcttattttcagcacttttttttttttgagatggagtttcgctcttgttgcccaggctggagtgcaatggcgcgatctcggctcaccgcaacctccacctcccgggtttaagcaattctcctgcctcagcctcccaagtagctgggattacaggcatgtgccaccatgcccggctaattttgtatttttagtagagacggggtttcttcatgttggtcaggctggtctcgaacttccaacctcagatgatctgcctgcctcggcctcccaaagtgttgggattacaggcgtgagccactgcacctggcccagcagtcttttccaaatcaaagacagcagggcgggcacacagtgtccaaacctcatggtctgcctgtatttaaaaggcatctagatacattggcattccttcagcaagaaacagctttagtaagaaaattccccagcagcacacacagtatcatctgggttcctgaactgaaataaactaaaagtagaggaaagtattttgtgaattaatccagtctaccttttttctttcaatcctaaatccatgttagaaattgtgcacttgaaggcggaaaaatgaaaggaagaaatataactagtagttaaatggaagattaactagttaactagttccctgatgtgtttcagttggatacttttgtaaattatatccatctttggtgtagggaagtttcaatgtgaaaaaaaatcttgtagttatgaagaaacaattacagtgaagaagccaggggaccgggcgcggtggctcacgcctgtaatcccagcactttgggaggccgaggcaggcggatcacttgagggtcaggagtccgagacaagcctggccaacatggtgaaaccccgactctactaaaacaacaacaacaacaacaaaaacaaaaattagccaggtgtgttggtgcgcatctgtagtcccagctactcagggggctgaggcaggaggatcgctagaacctgggaggtggaggcagcagtgagccgagatcgtggtggcacttcagcctgggcgacagtgagactccgtctcaaaacagcaacaacaaaaataagccagggatcctagaaatatgcaagaaaaagccatactaaccaaacaaaaatttaagtgctaagactgagggtgaatttggaaaaatatcatgctttctgacccaaatctacctcagaatttttttttttcctttttttgagactgagtttcatccttgttgcgcaggctagagtgcaatggcgcaatcttggctcacctcaacctccgcctcccaggttcaagcaattctcctgcctcagcctcctgagtagctgagattacaggtgtgcagcaccacgcccagctaatttcatatttttagtagaggcggggtttctccatgttggtcaggctagtctcaaactcctgacctcaggtgatctgcccacctcagcctcccaaagtgctgggattacaggcgtgagccactgtgccccgcaattcttttttcttaagtgttttttaaaacaggatgcacactcacatccaataacatgcagtttaaaatgatttaattgacaaattcttgtgatttacatttcagtaatcaactgcaaaagtgaggaagtaattcatgggcctgtagtgcttttgaaaataatatttatgactcataaaaatgtacattcataatagtatgacatggacatattttaagaaagttcaagcatatacaagcattgtttaatctcacaaaatatattaattttgttgggaatatgtgcattataaaagggtctttagtttaccaaagggttcaacactaagctatttttaaagttgtaattattttttccaatctaaagaggggttaaggccaggtgcagtggctcatgcctgtaatcccagcactttgggaggctgaggtgggcggatcacctgaggtcaggagttcaagaccagcctggccaacatagtgaaaccctgtctctactaaaaatacaaaaaaactagctgggcatggtggtgcacacctgtaattccagctactcggcaggctgaggcaggagaatcacttgaacccgggaggtggaggttgcagtgagcagagatcgcgccacagcactccagcctgggcaacagagcgagactctgtctcaaaaataaaataaaagaggggttaagactcatgctgtcttcacacatggccctgcacaaccatgtggaggacaggagggatattcttgagagatgctgggcagacaactaacaagtgtcccttaaagcacacttctgaacaatgtccagtcaaatataaaataacttaaatatgagggtcactcctcatctgcacgcacctgttacactttttttttccttactcatttacactgggaaacatgttataatagtgaatagttggttatgaatctttcaaagaacttggaagggcccctataattattttctgaaacaatggaattctcttatggaaaaatcttccagtgaaggaaagggtaagttaaaaaaaacttgaattaacttaggttagcatgcttgccaaggcaaaagcaagttgcttttctccatgtttcgaggctatgagaaagcggtggatacatgctttacttttcagccagaaaatacgcactgccattcctgagaagatggcaggcagcacagctgggctctagccttaaagactcaagctttctccttccttccagtcctacctctttacttctcagatttccagctggctggatgtatacataaatgacttgcatggctaagtaaaacattccagcttatattttcaaggatttccaagagttcttgcttttggacaaattaataaatgcaaattagaacttaaaacgcagttctaattttatttctatttttggttgttaaaatcaaaacaaaacctacacacacacagtcctagggttttctcaaacgaaatcaacagttctttggcaatgttaagagtgtgtaacatgactgccatgctaattagcataatttataagacttctaatagtgttgaaacaggaaaataactataaacttgttagagaagttcgtttgaaagacactgtcaaatgtcacactaagtctttttaaaaactcaatttagtaagtagaaaatataaatgaacaaatttaatttttccagataataaaggaagttattcggcatttttcccagttacgcaaagacaattatcacgtgaaaaatttatagaatgtaagcagtaagagagtattatgcaaaaatatcctaaggtaatttcagtataaattataggaccacatttattaataatatacgttatgagaacaatcatttgcagtctcactgtgaaggcaaaaaaaaaaaaaacaaaaaccaaaacccaaaggataaacagaaatagcacagtccaccgaatacactgcatggtgtttataactgtataaccaaactaagtaatctttcccctctctttaacttttatgcaccacctgccattctagatactatcaatcacactaaataataataaaaaccaaccaccttcaatctgatcattctgggcaggaaactgaatacagttttgaccagatcttcgagaaagattcatatacacgaaattaactagttctgttaaaaggctgctataaaaataccatcattacgagctatacagaactttagaatccagctaagagtgcagaaatactgaatttcttaatttatgtggagggggctgtaaacccaaaggtagaagggcatttcagcattctggcgtgttcagagtttctagggtatagtatctctctaacacacagagagcatttcaaagggtggctatggccaggaaacctcagagcgggttctgccgtcacacttgatcccgaaggcgggccagtctctgagacagttcatcctgctccgccgaagccacgctcgtgcccacggagccggtctggccctgcggcagctccatgttgaggtcgaggcccgcctcatctgccatttcctggagcagcatatccacttggttctggggagtggtgagcgtcgtcgtgctgctcatcgtgtcttccatttgctgcgtctggacgtccagagtctcaaactggtgctcgaatttgtccatcaaagcagaaatcttctccagattcatggtcttcaatgtcgcatccatcgacttaaccacaccagccatcgacttggtcaccttgcccatcgtcaccgccgtctggaccctggcagccactgcatcgactcgcgcactcattctcaagaaattcaccgcctggttcttctggcggatggcattttcggcgtgtatcctcgcaacttccatgttgcccttctgaatggcctttttaattttggccttttcggccttttcctccttatcgcattttttggcactcctactcagttctttggccgcgaacttcaggttgaacaggtgtttctccatgttagacatagtcggacggctcctttgggtcggcggcccggctgagaagcgcgccgaaggcagagaaggtaaggtaagtccgctcccggccgccgctcctttgttttggtcccacttcctgtttctactgtgagcggcgcaggtggtgacgtcagagcccagcgccaaaggcggagcctgcgggacggaaggcgccggggtggggcctgtgggacgtaagacgccaggggctgcgcatgcagggggattctggctggacgctccggcgctgcggcggggaacgctcgcttcctgcgctgcgttctacccggtttttaaaattctaacgcattagtcaattcacaaaaattagtgcccccacgcactttcctagtaataaatctaccgaagtagacaggatctgtggagacccgcgtgtaaaattacccacgctccaaacttggcaggctttataaagggtgactggctagcgggctaaaaaccagccaaacatcagctaggtcttcgcactaacgcttgctttattagcatgggtaatttccactttctcaggggaactggaaaccatggatacattaaaaacaaaaacattaaaacacattaaaaacaaacgggtcattgacgcgtctccatctttgactacaatttgtgctagagttctgtaatatccttttattgcattgagtgaaaataatcttcaaaactgtggcaccaccaaatttatactttgtctggaagttcagcttctaggtgagttgccagcaattatccaaaaatcgtcccgtggtttagtaataaaaagacccatcttttgctgacaccattctgtctttttgatgttttataaatatccaaggaacttcactcacatttaagtttgacaggctaaactgtcattttaaattatgcaggcagagtatgttgagatatcaggacccacacccacgggcatacatcaaaactgtcactatgtattacgccctttaaaaatgctggctttcaaatggcagcaatgtgtgctgtcacttttctctttagaaagattcctccgatacagcaataacaatgtgagaagaccaaatctgccctaatgaggtaggctgaaaatgaactctgagagcgaattctgtttagagatcattttaatctagcagcctgccacctcgcttagcttcctgtgatagcttgccagtcagtttcacaacacaagaccttctgaagacatagctctgatgttttcactctcttgctccaaaccccgggcatggaggctaaacctgctgtgcagcatgctggctcgtctttcgcgcccctccacctccgccagtcaaagcaaaccgcagcatggaatttgagcattatttgcgtcattcggccagcggggagaatgtgactgacgcccggtcctgtggctatgctgttcctgttgcctggattttagtgtccatgcatctctgcctattgacaccctgccagtccttcaaaagccaccttcaccatggagcctccccaggactcctcctctgtgtggccatactacagggcacattgcctggcaaggggtctgtgtgtataggtcacctgttacagtgtgaactacttggatgcagacactgattccttcccctctccatggagcccagcaggcgctctgcacacagcagccactgaatccagatggcgttgctgaatttaattgtatttcagaggggataggatgttaccctagttagcagcttagctatggttcctttttgccccgcaaagcagtagaaccctttttccaaatgaaacttttctagaaatggaatataaacaaccaaaaaaaaggggaagaaatctgttcaaagtggatatagagagcttaggccccctactctgctcaccctccattccactcttcccttcttttaggtcctggtttttcttggagtttgcaaacaagtttcttatccagcttccatgtcatgctccatagttttcttttttcttttctttcttttttttttttttttttttgagatgaaatcttgctttgtcactcaggctggagtgcagtagtgtgatcttggctcactgcagcctcccccttctgggttcacgcgattctcctgcctcagtctcccgagtagctgagattacaggcacacgccagcactaccggctaatttttgtattttcagtacagctggggtttcgccatgttggtcaggctggcctcgaactcctgacctcagttgatctgcccaccttggcattccaaagtgctgggattataggcgtgggccaccgtgcccagcccatagttttcttaatgacaaattctgactaggtgagatggtttggaatataatcatgagagactccgatagatgatgatgataatgacaactaacattaataaagtacttatgcaccagacattgttctgggcactttacataaattaactcatttcagcttcgcaaaccctatgaagtagatactataaatgtctccagttcacaggtaatgaaaaggaagcacagagagctaagaaacttgcctgaacccacacattaggtaagtgttagaaaccggattccatggatgtattgggaccagtaataaggcaatggggaatccaatgaacatgaattaataagaataaaataatgatcatcatgtagcctaaagaaagaagttgactttccagctgtttttttgagaagacagagttgcattgactgcaaagttaatatgaactttataaagtgtggttgttgactgggcatggtggctcaggaatgtaatcctagcactttggggggctgaggtgggtggatcgcttgaggccaggggttcaagaccagcctggccaacatggggaaagcccgtctctactaaaaatacaaaaattagctgggtgtggtggtgcatgcctgtaatcccagccacttggaaggctgagacaggagaatcgcttgaactggaaaggtggaggttgcagtgagctgagatcacgccagtgcactacagcctgggtgacagagagagactccttctcaaaaaaaaaaaaagaaaagaaaaaaaaagaaaaagtatggttgctaaaagaagttgccatcacctgaagctacattccttggatgatgacacctctactttctgtgctggagagaaggtataggtggagttccagaagccatcttcccagagagaccagggctgactagaattctgaagagaaggctgttctcctcctctccctgacagttccccagccctgccctcttctttctcttatcaacaccccagccatttccacggtgttcaataggatccatagctaactgctctcatgttcacatttccacggagagatttgcttctgagctccaaacccatatgcccagctgtctccttggtgctgggcgctctgtggcccaagactgattggcaactcctcaaagtgactgaactcagtcctttcccccaaatctgctcattcccatttactactggcacctccatctaccttgtcattcgagttggatttggaagaattatctctgaccaccgtggtatctgaatctgcatctaccctggctctaagttttttccattctttatattccattgaggttgacaaccttcagggtctgtttcagcttggtatgctttctctttttgtgtatctagcaaaaggaagattattttgggattattattaaaggaggttttggtcctacaaccatgctaattgtacgtgaaaatgttttggacccaatacagatgtgaaaacagaacatacagtttataatgactggaattgtttagcaactaccacgttaacattgaaaccttgcaagtcccatagccaaattttcttagtgaaaaaaaaagaaatttttgattaaagtgcagacatttctagaaagctgcgggtcaaaccagttaattatttttatcatgaaatggggaagaaaaatatgctatcatttggcacatctggctgatttctttccttactttgaaataatacaagtggttaaaatgaaaatatttaagcaggacattcagttttacttcactggaaaagaatcatttgctaagtctgaagtcactcaaaaaaaaaaaaaagaaaataaaagatgtgaaaaataactttctcttgtgagttaaactatttctggattctcatcagtatgtttctggtgattttgaaatgttatatctcaaactaagggctcctcctacttatcacagtttgcattttttgcatatatttgtgtttgctgagcagcaggctttcctattaggtgtggcatggtgacctctggttgactacctatacctggtactattcaacctctggaaaacagatacccaataaatttctgttgaatgtaggaatatatgaatgtagccaaaggaaatggcattggatacatattcacttggtgaccattttgaggaatacattacatatatgtatatatatattatacattacatacatatataatattaatttattacacatgtattaaatgtatgtatatatatattttcctctgcatcacctttttatttgggaacacagctagaattaaaaacgctgagactcctcaagccttgggaaatttcaaagtcactgtccagggctgggtgtgatggccgatgcctgtaatcacaacactttgggaggatgaggcggcccaggagtttgaggttgcagtgggctatgatggccccactgcactccattcggggtgacagaacaagatcctgtctcaaaaacaacaacaacaaaacaaaaccaaagtcactgtccctcaaaatatgttaacaacagcctggacaagatggcaagacccggtctctacaaaaaataaaaaataaaaattagctgggcatggtagcatgtgcctgtagtcccagctacttgggatgctgaggtgggaggatctctgtgtccaggagttcgagactacaatgagctataatcatgccactgtattccagcctggctgacagagtgagtctgtgtgtgtgtgtgtgtgtgtgtgtgtgtatatttatatatatatttatatttatatatttatatatgtatttatatatttatatataaaaaaatgatgtcgatttaaaaataaaaataagaaagagaaagaaatagaacagcagcatgtaaacagaattctgcattcctccatctgcagtttaaatgcacggtttattattcctcttggtgatgtggtgagttaatactgttatgagaaacctaacttccatgttagtcgaagttggcattcactcatttagcaacacagtgattctcctcctccttctttacactgaacaacttaccactttgagaagctgaaaatgaaatctcaacacacctgtccctctaaggctggtacgggatgcctctcttttctggcctcaatttcctcatttataaagctggaaaaaataaggcctatgatctaacagtgggtaataatccctcatcaggtcagatcaccagagagggccactcaaaaccgcttaacttaaaaaatccctgaaacaagacttactaagagaaaaaaatgtattatttaagtggcgttttcctggcagtttgtattggatatttgcaaatattgtgaagaccatatagagctgacacagcaaaactgagaaggctgactgggccccttctctctctgtctctctccccctctccctccctctctctttctctctctctctctctcttttctcttccttccttccctctctccctccctcccttccttcctttatttctttccttcagggtgtcactctgttacccggagtggcgcaagctacctctgcctcaactgggcccatttctctctgactcctctagttggagagcattttgtaggaggaaaatctactcctttggtcaggttcctacaaactaacgtacaaactcaagcaatatggcagggaaccaaacacgtgaaatattgttaggtctatgaaacacacgatatattcctctttccaatctgtgttcttattatttgttagcagtctttattatgctacttttttttttattttcaagaaaagtgcactctcctgcacacagcattttgccatatctcacagctgtctggttgactactgggaaacatagtttattctgaaaacatgcttctggatggaaaatgattttactattacaaacctgaagatagaaggacaggattgcgtctggcgtaatacggtacaaatcccacctctgaaggaatatggaagccagttgttcttacgtaatttttatgtttaacctgaacattaagcttacaatctataagttaaaaatagcgaggctgggcgtggtggctcacatctgtaatcccagcactttgggaggctgaggtgggcggatcacaaggtcaggagattgagaccagcctggctaacatggtgaaaccctgtctttactaaaaatacaaaaatcagccgggtgtggtggcacatgcctgtagtcccagctacttgggaggctgaggcaggagaaccgcttgaacccaggaggcggaggttgcagtgagccaagatcacatcattgcactccagcctgggcaacaagagtgaaactccatctcaaataaaataaaataaaataaatcaaaaaataaataaataaaaaataaaaatggcgaatgtacaaattggccagttaattttgttgcacattaaaatcttctctcgtcctcctcggggagcaccttctgttcatgatgggaacagattgtgagaagtcaggagctcttcccagggctagtctgcattgagtattggtagatggtggtggagggaaaaagcatttttcttcttcactgctgttcccggggacatgtgtgtgcagctgactcactcgtacccttaattgatgctgtgattgatctgccttagacccagcttttacttagcatcatgtctcaattagattaagtttaaggcacaagtgatttaaaacggccatggccacagaatggagagcactggttccaggaaccatgtatcctgagaacctatttatttatttattttgagatagagtttcgctcttgtcacccaggttggagtgcagtggtgtgatctcggctcactgcaacctctgcttcccgggttcaagcgattctcctgcctcagcctcctgagtagctgggactacaggcgcccgccaccacgcccagctaatttttgcatttttagtagagacagggtttcactgtgttggccaggctggcctcaaactcctgacctcaggtgatctgcctgcctcggcctctcaaagtgctgggattacaggcgtgagccactgtgcccggccctgagaacctttcaatttaaaatcccttcaattctagtctaacccacacacttcatgtaaagtaaggagtcattagccattagtgtccatggaaggctaatcttggccatttcttttcgtcaaggaataactgtaattaaacttttcggccaaaacataaagttttttgtttttttttgagatggagtttcactcccgttgcccaggctggagtgcaatggcacaatctcggctcactgaaacctctgcctcccaggttcaagcgattctcctgcctcagcctcccaagtagctgggattacaggcatgcaccaccatgccctgctaattttgtatttttagtagagatggggtttatccatgttagtcaggctggtctcaaactcccgacctcaggtgatctgcccacctcggcctcccaaagtgctgggattacaggtgtgagccactgtgcctggtgacataacgattttgttagtttaagctactgtctttcgttaggaagcaaaatggtattagaaatcaaatataacttaacttggtgagtcctactagaaataatttatttttaacatctctttatttctttcctttttttcttttcttcttatctatttatttatttttgagacagagtcttgctctgtcgcccaggctggagtgcagtggtgcgatctcagctcactgcaacctccacctccctgcttcaagtgattatcctgcctcagcctcctgagtagctgggattacaggtgtgcaccaccactctccgctaatttttgtatttttagtagtaaaaaattttacatattttctatttttagtaggtgaaaccatattggtcaggctggtcttgaattcctgacctcaggtgatccacccaccttggcctcccaaagtgctaggattacaggcgtgagccaccacacccagccccttttttctttttttttttagcgacagggtcttgctttgttgttcagctgcagtacagtggcacaatcatagtccaatgtagcctcaaactcctgggctcaagggatcttttcaccttggcctcccaacatgttgagattacaggcatgagccactgtgcctggccttaacatctctttagaatgtgaaaaatcctctaacaaagcagaatacttatcacttttgtacctttataatgtaccataatagcattcagtttcttctgaaacagtcaacaccctaaagtcactcaacagtgaaacagtcaacaatcaaatagtcaacagttgaaagaaggccaaagatgaatgtttttaaaagaagtgctaactttacaatgagtatgaactaagtcaggggtctccaaaccctaggccacattctcatgctgtgtgaaccaggccacacagcaggaggtgagtgccagccagcaagcaaaacgtcatctgtatttacagctgttccccatcaatcgcattaccacttgagctccacctcctgtcatatcagcgatggcattagattctcataggagcacgaaccctattgtaaactttgcatgtgagggatctaggttgcatgctccttatgagaatcgaatgcctgatgatctgtcactgtctcccatcacccccagatgggaccatctagttgcaggaaaacaagctcaggggtcccactgattctacattatggtgagttatataattatttcattatatattacaacgtaatcgtaatagaagagcacagtaaacgtaatgcactggattcatcttgaaaccatccaccccaccacggtccatggaaaaatagttttccacgaaaccagtccctggtgccaaaaaggctgggggccgctacaccaagtcattagatataagatatctgaactaggccgagcgcggtggctcatgcctgtaatcccagcaatttgggaggccaaggcaggtgtatcacctgaggtcgggaattcgagaccagcctgaccaacatggagaaaccctgtctctactaaaaaaaaaacatatacaaaattaactgggcatgatagcacatgcctgtaatcccagctactcgggaggctgaggcaggagaattgcttgaacccgggaggcgaaggttgaggtgagtcgagattgcaccattgcacttcagcctgggcaacaacagcgaaactccgtctcaaaaaaaaaaaaaatctgaactaaaatataacatatgttttctttcgttatttgatggagttgggctacaatcttccagttcatacgtatattccacaaacatttactgagtttcaggctagagaatgaacagtatgggggataggtaagtaattccctatgcaaacctgatgcatttgtaacattccataaagcagaggtttttatcttccccagaatttcttctcatggaaggatccccgcagttgggaagcagaggtgctcacagagcttcctccataaatctgatgaatgaggaattctagcaggtatttctttctttctttcttttttttttttttttttgagacagacccttactctgttgcccaggctgaagtgcagtggcaggatattggctcactgcaacctctgcctcccaggttcaagcgattctcctgccttagcctccagagtagctgggattacagcatgcgtcaccatgcccgactaatttttgtatttttagtaaaggcagggtttcaccattttggccaggctggtcttgaactcctgaccccaggtgatctgcccaacttggcctccgaaagtgctgggattataggccaccgtgcccggccctagcaggtatatcttttccgggaaccacaaagctgtcttcaaataatcatgattaaccttgccctaaatataataaattgtagctgtgactgccatctgaaaaacaatacttcatagtaaatcttaacatatttgtaggagacagtgtattttaagattagtttaggggttaaaagagaattgaaagctgatgaaggctgggtgcggtggttcatgcctgtaatcctaacactttgggaggccgaggtgggcaggttgcttgagcccaggagttcaagaccagcctgggcaacacggcgaaacctcgtctctactaaaaatacaaaaaattagctgggcatcgtggtgcacatctgtgatcttggctattcaggtggctgaggtgggaggtcacttgagcctgggaggtccaggccgcagtgagctgtgatcgtagcactgactccagtctgggcgacagagtgagactgtgtctcaaaaaaaaaaaaaaaaagaaaagaaaaagcaaattcctcaatgtcatttacgtgaactaaatcaaagaaagaaggacaaagtgcattcaacatggctcttgctcactggaggcctccgggtgcttcctcttctctgcagctatgactgtgtacattgactgaatctgtcacagcattcccgaatacgtccaccaggtctcctgtagatcattccagggaagaacgctaactatgagaagcacgtggtcaacaaagggtaacaaagggaagtctgaggactcctagataaagagctttctcagagggggtgccccagataccaaacacacagatttgctcaggtcacactatgtttcaaaggaagagctggaatgagaaactgacctttgcatcagtgttcacctctgctgagtctcctattttaaaagagatctgggatgtcattaaacatgttcaattgaggttaataaaaaatttccttttttggcaaaacgatctgttaagtcttgtctatcttagaagatatatttagtcactgcatgtatcctggcagaaagtcatggcaaagcagtttctttcttagcaatgactacctgcctcagtagctggataaggaatctttcattctttcttcacagaaataatgcagagcactgcattttcacaaatatcgaatagaatgagaaatacgagcatcccatgcacttaattgttgtcacatgaataaaattgtaagtaaatggaaattctatttgtgtggagagttccttaagtcagttaatagaataatgccatagttcaaaggtagcttttgttgatatcatggatcctagttattatgtgatcaagggagtttggtgaaataaagatatttaattctaaccgctaatgcatgcactaccctaagaaaggttttactttcttccttttttgaatgctttctttgatatgaaattatcaaagagcagcttccttataccttaagttctatttgaaaagctttcattacattccttgatattgtgaacacattattattgttcactgggacgaaggaagtgctcacacaatgcacgattacagctttcgcttttctctgagctagaacgcttgtgctctaaaggaggctgtgctgtagcacagttcagctcctcattcctttttgcggtggaatcatattccattgtagggatacaccacattttgtttatccatttgtcagctgatgacacttgggttgtttccactttttgcccaattgtgaataatgctgctatgaagagatattatgcttacgtctatctgagctttaaagaaaaaaaatttttttttttttttttgaggcaaggtcttgctctgccacccaggctggagtgcagtgacttgatcatggcttactgcagcctcaaactctagactcaagcaatcctcccgctttcaccatatcaaggagctgggaccacaggtgcacaccaccatggcccagctaatttttttttttttttacttttagtagagatgaggtctcgccaagatgcccaggctgctctcaaactcctaggctcaagtgatcctcctgccttggcctcccaaagtgttgagattacaggcgtgagccactgtacccagccaaaaattaattttgtatacataggaatactgggctatgaatggtagagagagcagaaaaagaacagtgataacacaaaaatctattcatgtaacaagtttattaaacacctattatatgccaggcattgttctaggcacagtggtacacaataatttcatgtcagttagcccatcataatgaacagtttacaaaatttggttagatttagttgttcattcatgtggttcaactattgaaaggaatgaagtagtgatatatgctataacatctcatatttatatgttactgtgtcacgcactgcatggagaagaacaactccaaatcctatggaaacaacttagaaattacctgccaatttccacaaagatagtcttttagaagagatttttaagacatattttcagtatgggtactgtattttgaatcagtattttttgcttttctatttcatttcttccgcctttctctcttaaactgatttttaaaaagacaaagtaagtacatgaacaatctgaaatgctatggatctcataccgcatcctctcagaagcatccccacactgtcaccatgcgtggcacatggatgaaacataatgcatcttacccacttggtattaaatcagaaggccctgaaattaggcagactcgaatgatcaggagtctccaaattaattttactgaagtgtccaagtaaagctctcacaagccagttgcaacagggagtcttgattaagatgcacaattcaatgacttttttgttgtatattcaaagttgtgcaaccatcaatcacttttagaacattttcatcactccaagaggaaactctgtacacattaaagcgattcctcatcccccaagtccacctggctccatgcaacattcgtctactctgtctctgtagatacacctattctggacatttcatataaatgaaatgataccatatgtggtcttttgtgtctggtggctttgacttagcataatgttttcaaggatcatccatgttgtagcatgcatcaggacttcatttctttttgtaactgaataacattctatcgtgtggatgcgtcacattttgtttatccactcatcggctgatgggcatttgggtcgttaacgcttttttttgagactgggtctcattttgtcacctaggctggagtgcagtgatgcaatcttggctcactgaagcctcgacctcctgggctcaagcaatcctcccgcctcggccccccaagtagctgggactaccagtgcgcatcaccatgcctggataatttttcgtaagaagggatttcaccatgttgccaaggctggtctcaaactcctgagctcaagtgatccactcaccttggcctccaaagtgctgggattacaggtgtgagccaccatgcccagcctgtttacacattttgattattatgaataatgctgctatgagtatttgcctagaagtttttgcatggatgtatattttcaattctcttggacatacacttgggagtggaattggtgggccatatggcaactgtgtttaacgttttttagaactaccagtttgttttccaaagtggctggactattttacattcccaccagcagtatatgaggatcccaatttcttcacatcctcagcaacacttgttttatctgactttttaggcacagccaccctagggttatgaagtggaatgtcactgtggttttgctttgcattttcctaacagctaaagatgtttagcatcttttcgtggctgattagccattcatctatcttacttgggagatgtctatttagatcctttgctgatttaaaaatcggtttacttatgttattattgatttgtaagagttctttatgattctagatacaagtcctttatcagatgcatgatttataaacattttcccccttctatgagcttgttttttcactttcttgaatcataaggacctctatatgtacatcaaaagctatcctgggctgagtgtggtggttcacgcctgtaatcccagcactttgggaggccgaggtgggccaggagttcgagaccagcctgcccaacatggtgaaacgccagcactactaaaaatacaaaaattaactgggcgtggtggcatgtctaaaaatacaaaaattaactgggcgtggtggcatgtgcctgtaatcccagttactcagcaggctgaggcaggagaatagcttgaacccaggaggtggaggtttcagtgagccaaaactgtgccactgcactccagcctgggtgacagagcgagactccatctcaagaaaaagctatcctggctttcattggaaaactaggttcaagatatgaagtggatggagatgtgaagttgatgacagttccttcagaatctgagaaaaaggatgtccctgaggcaatctccttcaaatgcataggtccatgcctcattcatctttgtcattcagtggctggcagtgtctagcatgcatctgatgctcacagaatgcttggtgaacttttaatctaaagtagtctctcataatctttaggtttaaaatttgaaatcctggatcaatcaagtaatagttggtattgtgtagtcttatgtaatcttatgtgcctttatatcctcatctgcaaaataaagataatgaactcattgggttagtgtgaggattactatgttagttcatctaatgtgcataaaatgtgcctccacagggcaagtttcaataaatatgagctatcttacagctacacttgggtactaagcaatacagagcacacacctctttattattattatttattattattattttttgagataagagttttgctcttgttgcccaggctggagtgcaatggtgtgatctcggctcaccacaacctccgcctcccaggtccaagtgattctcctgtctcagcctcctgagtagctgggattacagacatgcgccaccatgcccagctaattttgtatttttaatagagacagggtttctctatgttggtcaggctggtcgcgacctcccaacctcaggggatccgcccacctcggcctcccaaagtgctgggattttacaggcataagccactacagccggcctattagtattattttttgcgacagggcctcaccctgtcacttaagctggagtgcagtggcatgatcattactcactgcagccttgactcctgggctaaagtaatcctcccaactcagcctctggagtagctgggactacaggtgtgtggcactatgcccagctaatttttaaaaattatttgtagagacgaggtctcaacatgttacccaggctggtctcaaacttttggactcaagcagtactcctgccttggcctcccaaagtgctgggattacagatgtgagccacctcgcctggtgggacgcacgtcttaaataattctgaaactgtacctttattaatagtagtacagtacttagttgttttccctgagttccctggattccttggaagtgtttcaaagaattcagcaaacaaaagtattgtgataaaacctgacacacacgtcttacatttcacactgtaatttgtagggtactgtcaatttattaacctgtgctactatgtaatttatttttctgtaagcttctgatcacagctttacatatacatatttttctttattccccctacattttattataaaaatttcaaacataaaataaattagaaataattttgtagtgaacacttgaatacctactatttagattctgacattttcgttttactgtacttttaggcttttttttttctttttagagacaggttcttgctacattgcctaggctggccttgaactcctaggctcgagtgaacctcctgcctcagtctcctgagtagctgaaattacaggcaaacaccactgtgcccagcttcattttattgtacttaaaaaaaaaatcacagatctatccatgtatccattcctcaacccatcttatttttgatgtatttcaaaaaaagggaagacagcagtacactccctctgaaatactgcagctcacagaatgttatctaagaatcaatatttcttcatggctttttctttcaatgtaaaatgcatgtccaatgaaacagaaatcttaagtgtatatctgctgagttttgaaaaatgcatctatctgtgtagctcaaattcccataaaaatattatgcacatattttcaacttctttcaaatgtgttgtttggaaggaggttctggtcatttttgtagacaatgcagcacctgttgaatagtcttacggtagaagcgagtccctaagaggcacagaggatgcacaccctgctttgcccaaggccacttgagctggggctcacctgcagggcccaagctctcctcacagagcaactgccatgttctcacaggggacaacgtaacccataacccaacgctataaatataacgtttatcagatgtcacatttgtgttaaagaatgtgaagagctgttagagactgttaagaattcaacttggaacaaaatttctttctttgttttttgagacagagtctcactctgttgtcctggctggaatgcagtggcacagtcttggctcactgtagcctcaaactccaaggctccagcaatcctcctgtctcagccacccaagtagctgggactacaggtacacaccaccccacttagctaatttttgggggtatttttttttttgtagacactagagacccaggctggtcttgaactcctgggctcaagcaatcctcccaccttggcctcccaaagtgctggaattacaggcgtgagccactgtgcccagccagaagaaaatttcttatgattctccttttcacatttctacatcatttaacttaaaatgtttcttgtaattacaaggcaaccttaacaaaagaccccatttttgctaccatttgcaacaactcatctgcatatgtcaggatgttcccacacgcccctccctagcaggaataagctggatgttgagtccagcgaaaaactcaaccgtcatctaagaccactgaattccaattttgttcttatcaatatagccatagagatctttaggtttgtttataataagtaaatgttacaaatgtgaatatgtaaactaaattttactttattaaattttcactttggtttcatatatttattttaataaaataccactttgctttggcattggctataaattgcatttggttctgctggtatgaattttgaaaacgggcactagtttttaaaccgcaccccggggagcctcacatttggaggcaacagaggggccacacagcagcaggcagaagcgaatacaagggctccggctcctcaccaggggacttgtcttctccctctttgctagtggcattccatacagttccgtgtgacgaagcgttccatttctaagaaatactgaaaaatccagctctaaggcatcaaaaatgtgatttttgttttatagtttgaaggtcctgattttcacgccatgattggagattcctgtgatgtatgtgctgggcagagaggccaggccctgaaggccatcctgttccaggcatcctttctgtataggaagtctgagggttacgttagataaggaatgggaagccactgcagttctccacccaagtaagtagattttctgagatattttaaaaacaggttttacacacaaaaacatttgtggtaatcccactaaaaattttcttctggatgtctcagggcaagggtttctagaggagaataaaagaaacatgtaacaggggctgatggccacacacagagacatctggtctacctacctagtccctgctgctacatttatttttcatagctaaagtaaatgttattgtagtgctcataaacaggaacatttccaattttgcagctctagaaaacaaatctgagaggcggggcacagtggttcatgcctgtaatcccagcactttgggagccaaggtggggagaacacttgggtcaggagttcgagaccagcctggccaatattgtgaaacctcatctctactaaaaatacaaaaattagccaggagtggtggcgggcccctgtaattccagctactagggaggctgaggtgggagaat

SEQ ID NO: 2579 - DNA, 868 bp, Homo sapiens
cacttatggtcttgtgtcctatacttcatgtgtgatgccaccagaaatgttatggattccgtattgaacacactgagagtggtatgagccctcaggactgcaccacagagtaaacacaaccttgatatggtggcgaatatgtgtgtctttcttgtttcatttgtggttggggacaaaatcgatgtatttgtctaaatagtcgatattcatcttaacatggttggttgtgtaatcaccagctatattgtgaactgtgcaataaaacagaagcgtttgtgtatataattacctttggatacctgaaattcccaagcttggttacaatgtaatgctcagtataaggctgtgcaaacatgtaagggaataatggtggtcgatgggatatatgaaatgggatctagagggcttcgagtgaagccaatcatgttgaacgaacactggttcagtgtagatgaagtagagtgaggcgtatgcagtcataaaatgaagggtggacaggagattacatttgaagaaaggataagcactcagacttggtctcttttaaattaaaatatttcttttctcatgtgcaaatgtatatcaaagacttgaacaggtattctcttgaaatttgaggatttttagtttttaatgctgtctttgcttaatattaaatatgtgttgcctattggctcccaaattgtgtgggagtctctaaatgtttcctcttgaaggttcattattgaaagtggttaagtgcacaatgctatttttgtttgatagtttgagttttatgaccctatgagtttaaatgaaatctgttaaatgtttcagagttaacactttttttttgataatttggaataaagtttgttttttaagccca

SEQ ID NO: 2580 - DNA, 2726 bp, Homo sapiens
agttgaaaaacaactgccaactacattacataaaagttgaaatggacgtggagtgtggtggctcacacctgtaatcccagcactttgggaagctgaggcaggcagatcacgaggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgaaaatggaagtaaagatgccctcttgggggcccagagatgacagatgtggctccccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataatagtagaaataaagtgcacaataaatgcaatgcacttgaatcgtcctgaaaccatccctccccgaccccaatccatggaaaaattgtgttccgcgaaaccggtctctggtgccaaaaaggttggggaccgcttctggaaaagctggaaaaggcaagaaaacgcattctctccctcagcctctggaaggaaccagcactgtgggactaatttacatactgtagggtaataaatttgtgttgcttcgaacc

SEQ ID NO: 2581 - DNA, 583 bp, Homo sapiens
cacaactttagtcctatctttcccaatcccaggcatgttaacaatccttgaaaaatcatgctacattactttggaggaaaatacttccagatgaacatgtttcaagacatactagaaaattattcctatcaaaacatcctttttctgtgtcagctacctcatttctaatgcagtgcacatcaatctaatgtcagtatgaatacacatcaaccaggtgctggctttctaaagtgattcctttgcagatatgaggagcaggtatgactgcttcacagacacctcccaaagacatgccatgggcagtgggttggtgcatgggaaactggatccgatctgtctcataccaagctaaggaaacaaggataacaaggagttttcctgtaccttgattttttcaatatgtgggtttagagttggatgaaagccagcttttaagtgaacctggtaagatttgtaatgacaatatttaaaatgaaagaaggaaagaataagcttgcctgaaacagaatacactatcatgggcaggagagttatagcactaaggtgtgactctttcacccagaaaatgcattcctacttttct

SEQ ID NO: 2582 - DNA, 8829 bp, Homo sapiens
gagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaa

SEQ ID NO: 2583 - DNA, 8826 bp, Homo sapiens
aagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcactgaaa

SEQ ID NO: 2584 - DNA, 1876 bp, Homo sapiens
gctgtctgggactccggccctgaagcgggcaatgaggtttgcacatacaagtccacgaagaaggaaaggcaaaaatactctctctactctccagccctcatcctcaaggctagtataaaacaagaaaaggtcagttaaatgtattttcatccttcttttatttgttaaaaataatatgcctaaaagtctgcagatgagctaatatgtccttgaaagggggcatgttacatacaggtctctttagcatttctaattctgtgaaagccaccttaaatcttttgggagacaaaacagtttgttggaagaaaacagcctctgatgtagctataaatcgctattctattttcttatgtatttataaaatcataccagaaataatgagttgttttgtcaataatagaacactgacatgaacttgacctaacaactagcataaactgtcaattcatcttgcattaacaagaaaatgaaacaagaaataactattagaaagaaatgacaaaattcaaattgactttgaaaaaatctgattttattttctcaatcaaaatgaagtatttcatgttaatttagactgtttagctttccactgatatctcaagatactttccagatattaacagtactcagaactgtgtaaaagttaaccaccaaaaccatgttttaaagaaaaaagtttaaatgtaagactaatgtcttggggactttactaaatgtatttctaaaaaaacccttctcaaatgtagaagtattggcaattctaatttaaaaattttaaatttttaattattggaaatttaagtagcaatagtttcaagagctaagaatcagattgctttttaaaacagaattttttttttttcctgagggactcatacttgacaactccagttaaacataatactccacccaaatcccaaatttaaatgcattatgtcaccctggaatagtaaaattataaaatggtatttctaaattataatatatatacataatgcaccattttaactgtcacatttaccagcagaattatgaaatcaaaaacaaattctacattcaagggacaaacgataaatgctctttcattgttttaagagtccattccattctttgttgttttctactcccatattttaaaattatgaccaaaggagcctgaaggccaagtcaatcccatttccctgaacccaactgccagtaggtacgggccctacatacgcgtcctttaacaagccccgttctcaaaaggctgggggtatttatataagaacttattccaaagtgactctaagatccatgttcccaagatctagtacgggctattcagggttctgaggcatgtccagcatgcaggcaaacttatctgttcaaattgaggtaaaacagacaaaaaacacttaatattaacagaagctacataattaaaactaaccttctgctgcttatttaagctaatgatgtattcttaccaaacagagaccctcaagtcaatcatttcttttgattttagttaccacccccaaattaagcctcttctttcaaagctattattagttaaaaaaaagttttaaaatgaagaaaaatattttttccagaacttgtattttgtaattagtgtgatgcaatttctttttatttttcaaacttagaaataactcatgtatggtactatttggtatttttttcagataccaaggaataccgacaggattcataaataggattttctgacactggcaggaaagtctgctaacgtttacaaaataccaaagactcttctttcaagcttcaaagatggctgagaattaacagttatgattagtttttcagtacaaataaaaaaattaaatcttgatttttttggccaacattttaa

SEQ ID NO: 2585 - DNA, 5289 bp, Homo sapiens
agagatcgcggagagacgcagaacgcagcccgctcctccagggccctccaggccctccggccccgggccggcgggtgaactggggggccccgggacaggccgagccctctgccctgcagataacggaggcctctgctgtggctgcccactggctgtgcccgcccactggctgtgcccagaccttgaagccgcagcgaacctctctttcccaccccacctcggtgactaatggcggccgtggcgtctcccagcccggaccccgccggcacccgggtctcccgacccaagcctcgacgaaacccccgcagagccgccgggacgcagcgcctttgggcggcgctgggcgtggtgggccgggaagtatggcggcagctcgaacgccgcgcggcggaggccattaaggcgtggacggcccgggaaggcggcctagggacgcaagcaggctcggccgcctctttaggccacggagccgcgcagatccggttcccgggtgaccactctgtcgccattgggcgagacctacctagtcctgacgacaacggacaaaggccttaaggggcctggaaggtgagcgaagtcccgaacgacgacgggtggaacggttagcggccatcgggcggttggtcttcattctaccagactttgctgtcggaagagagaaatggtagaatgacaggccacgtttggcccgttggaaatgcccaccaccctctgggaagatttactggccgtttatggaaggcctgtgtatataatatgaaaaagctgctctcaactccaccccaaccttttaatagaaaacatttgtcacatctagcccttctagatggaaagaggttgccgacgtatgataaaatagagttagaaagttacacatcttgtaaattctcatttgtttaaaagaaatcatagaaaatacatgtcttctggagatgacttttggaaatggagttgttaagacggcctctggaagcgatacgtccacgtttgttaagtgggttagatgacatggagctggaagacctgagaaggaagagaagaaggttctatgctagactggtcatatttagaagacattttcatattctatccattgttttgtgtgcattttattcctcactactgtgtatatagttgacaatgctaagcttttttgaaatgtctcttctttttagatgttctgaagtgcctgatatgttaaaattagaggtagcaaaatcacattttgtaaatacctttttgttacaattcataggaaatatttttgggggggaatggccaaatcacctgttgagtaatactcattgtgtttgtgcagtggttcaggggaggagagaggagggggaggtgcagagagctctatgccatcctgtttacagcgaggcaagatgaatcattatgtctgtgcattttgttttacttatctgtgtatatagtgtacataaaggacagacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgatggagatgggaagggttctaggccagaatgttcacatttggaagactctttcaaattataactgttgttacatgtttgcagtttattcaagactgctgtatacatagtagacaaattaactccttacttgaaacatctagtctatctagatgtttagaagtgcccgatgtatgttaaatgtataggtagtaaaataccactttgtaaatatctttttgctaaaattcataggaaatgcttttggaaattgaattgtgaagccacctttgtgaacagtatagtaatgtctatacttgttcaatagtttagaggaggtaggagggaagaaattgcaaaaggtaatattactagtgtgttcatacttggacattttcagacaccatttttctatatgttttgtgcattttgttttgctctgtatatagtatatataatggacaaatagtcctaatttttcaacatctagtctctagatgttaaagaggttgccagtgtatgacaaaggagtaaaattagcatattttgtacactttgtgttgaaattcgtaggaaaacttgtcttctgtaaagacttttgcataggaatttgtttgaccatctctaagcattacacgtgcctgtacttgtccactggattgaaggcagagaaggaagggaggagggaatgattcaaggccaaaatggccacatttagaagatacctcagatgataaccattgttatgtgtgtgcaattttatttaacagtgctgtgtatgtggtggacaagttatatgaaatatctagtctttctagatatttggaagtgcttgatgtatttaaaagtggtagtagaataacactttgtaaatagcttttaaaaactgatgggaaatgctgtttggaagtggaattgttgaaccacctgggaggtgggagggaagaaattgcaaatggtgttttgccattgtttattagaaaatttcagcttaatccattgtgtatatgttacatgcatttcatttaactttgctatactgtatatattgtatatataacggacaaattagtcccgattttataatatctagtctctagatattaaagaggttgccaatgtatgacagaagtagagttagtaaactaacacattttgtacactttgttaaaatttgtagaaaggctgtcttctgaaaaggacttttggaagtgagataacatcagctctaagtgacacgtgcctatatccatcaggttggtggtggagaggagttggaaggaatgaagggttctagaccagaatgttcgtatttagaagacactatcagatataaccattgttacatgtgtgtagtttattcaaccctactgtgtatatagcggacaaacttaagtccttatttgaaacatctagtctttctagatgtttagaagtgcacaaagtatgttaaaagtagaggtagtaaataacacattttgtagctatccttttgatatgaaatattgtcttggaaattgatcaattctctgagcagtacccattttgatatttgtgctggttcagggggaaggaggagcacaaagtgcaaagggctttctaccagtgtccagtgtgtttatgaggaggcacattgaccattgtcccttatgtctgcattttcatttactgtgctgtgtatatagtgtatataagcggacataggagtcctaatttacgtctagtcgatgttaaaaaggttgccagtatatgacaaaagtagaattagtaaactactacattgagtacactttgtgttaaaattcatagggaagacttcttaaaaacaagtgaaattgttaaaaccccccctaagcattacagatggcttatagctgtccacggggttggtagaggtgggaaagggaagggttctaggccagaatgttcctatttagaagacactcaaattacagtctgtgttatgtatgtataccatttattcaatgctactgtgtatataatggaaaacttaagtccagtttgaaacatctagtctttctaggtgtttaaaagtgtacaacggcctgtcgcagtggcgcatgcctgtaatcccagcactttgggaggccgaggcaggcggatcacgaggtcaagagatcaggaccatcttggccaacatggtgaaaccccatctttactaaaaatacaaaaattagctggtcgtggtggtgcccacctgtagccccagttactcgagaggctgaggcaggagaatcgcttgaacttgggaggcggaagttgcagtgagccaagatcgcaccactgcactccagcctggcgacagagcgaggctccgtttcaaaaaaaaaagtgcacaatgtaggttaacagtagagggcttaagtaacacccctctaagcatttgttttcagtacttcctaggagtgattagttcagatggtctaaccattgttctatatgtgcattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcagaaggaattatacaggtagagatgtatgcagatgtgtccatatatgtccatatttacattttgatagccattgatgtatgcatctcttggctgtactataagaacacattaattcaatggaaatacactttgctaatattttaatggtatagatctgctaatgaattctcttaaaaacatactgtattctgttgctgtgtgtttcattttaaattgagcattaagggaatgcagcatttaaatcagaactctgccaatgcttttatctagaggcgtgttgccatttttgtcttatatgaaatttctgtcccaagaaaggcaggattacatctttttttttttttttagcagtttgagttggtgtagtgtattcttggttatcagaatactcatatagctttgggattttgaattggtaaatattcatgatgtgtgaaaaatcatgatacatactgtacagtctcagtcccataaaattggatgttgtgcctacacacaggatctagaagaatatgtcaaactataaactgcttgtgattgtgaatgactttgttctttgcttgtgtttttcaatttcctataatgcacatactaacttttaaaaaataaaggttattttaaaagcctgtattaagccctcgttgcttgtagaatagagttagtatacgctacagaagcacaggttcatgctccttcatgcttgggctctgaggtatctggaatttct

SEQ ID NO: 2586 - DNA, 2632 bp, Homo sapiens
attctcctgcctcagcctcacaagtaactgggattacaggcatgcaccaccatgcttggctaattttggtatttttagtagagacgagatttcaccatgttggtcaggctggtcttgaactcctcacctcaggtgatctgccctcctcggcctcccaaagtgatgggattacaggcgtgagccatcctggataagttacatctctggcctttggggtcctactctataaaatgagaaaactgaaatcgttgatccctatgatttctaattttctttcattctaattatcggcagaattggaagcaacttacattctggtttcaggaatacatgagttcaaatattgctctacctaaagttcagagcattgtttaacctctttaaatttggaaaacagggatattaaaacatgcctaacagtgctattgtgtggattaaatgatggcttcattttttttcttgccttaggagtaggcttaaggtaagatttgtttagtgatttgtctcatggacatctccgttaagtaagtagaagtatttcgtatatgtggtatccacaatactggcttgattttttcttttaagttaaacctaagaaggccgaagaaattttgggggaatcactataaaatgaaaatcattataaaatgaaaatggacgcaacttcttccccacttcccaacgttactgtttgcggaacatactcaagaaccattccatgcaaagttttacatgatcggaaggaagcaggtcgtgctcttcacttgccaattccatggtgcggaataaaaacaaaacaaaacaaaatatttagtgtccagcactccacgtgggcaagtatttacaactaacatttcaagttttaacatttcatcactttaaatttaaaaacaaaatcactgaagcaaatatccccagataaaaacctacccaatttgcattcttttatttttaatttgcctgaggccaataattaccttcgtctaggagaagaatgggtcaaatattcactctgccaggtcctggcgtcccggagtacctttgcaacaaacgcgtcctaaacgctccagaccctccacatctcccttcccgctaggggggcctgtggggcccgaccatctgccaacccttttgtgtcttccggctcttatttcctcccccgcggagatctcacctgcacgccctgctgctggaggctctgcgtgatgtaatctagacggcgacaaacgctctttttggcctcggctgccgcctccttggtgctgctcactcgcaccaccacctgcgcccggtcagggcccgcagacacttctgaggtgccgcttacttgcacctcgcgggtagcagtttgggcttgtgttgaggagagggggtggcgtaagcccggtagcgtctctctccctgaggccaggttgttctcccggctccggtcagcccagggaaccagttccacgaacactcgggtcggaggggtcttttgcagagacatagcgatggcagctgggtttccatagtaactaccggccgacggcggccgaaggggccaatgcgcaccagggcttgcctgtgcacggcgcaaagtatgccgggatgggtgtggaggccgcggaacttctggcgggcgcaagctatatgccttgttgatcttgccgcatcttttttactagatgtcggctgagtgagtagctacagtttttaacatgtttaacttacggccttcaaaaattgttagcggactttctctgttgcctcctcagtgagctctgccctttctcgcaactccttgtcgtcccaccgcgcctctgcacctcagaggaaggagaagagtagcgaggccgagcgggtttttagatttctctgtgattacccccagccttgtcttttctgactttaccgtccccgcttggggtactgctttttgaggctccctcggccacatttttgtggttcgtgagaggtttcagttgaggtgaactttttgcccctgtgatcttggacagtttatgattcttcatatctcagtatcatcttctctaaagcagggttgataatattttttatattagtaatatataatatattctaatatatataatatattctaatatataatatattctaatatatataatatattaatattatcaaagcaatgttgataatatttttcacatttgctatgtgcttataaggcgcccattgtatgtagagtgcgttgcatatggaaagcagagtgaacataatggatgtttgtaatgatagctatggctttggcatcatttttgtgtctccccatttttttctaaaatccctggaatggttcgggccttgaattccgacagaagagatttaggtggtagcaaagcacgtccaacatggagtttgctgggcctgcacaacttggagcttctctgtacccttttcttcagagaacttttagaacacaaccctcaacttcccgtcttctggattctcttcctagcactaagcaatgatctttgtaaaaatagccccactgacttatacgtctttactatctgaattttatcaagagaatcgaggggggaaaaaagaattttgaataactagttctagaaggacaagaactgttcttttaaaaggaccctgaaaa

SEQ ID NO: 2587 - DNA, 2289 bp, Homo sapiens
tttttttttttttgagacacaatttcactctgtcgcccaggctggagtgcagtggtgtgatctcagctcactgcaacttctgcctcctgggttcaagcaattctcatgccccagcctcccaagtagctgggaatacagttgtgtgccaccacactggcttattttttgtatttttttagtagagatggggtttcaccatgttggccaggctggtctctaactcttatcctcaagtgatctgcctgccttggcctcccaaagtgctgggattacaggcatgagccaccgcacctggcctacttatcctgttaatgaaaatatttgattggacagaacatcttattccttaactctgttatgtgcttttgtagattgtttttacttactgtagatatctgttgctccagagtcccagaaatcagtatgatgagttcagcacagttactagaaggagacaaaaagatatcttcttaattaggtgatatcagggatagttctggttattgattgctgtgtggaaaacactccaaaactcagtgactttaaacaacaccagtcattgtgttatttctcattatcctaagtactgactgggctcagccagacagttcttattcgggttctcatgcagttatagtcatcatcagattgtggccgcgactggcataatctcaaaggcttccttagtatttctggcagttgatgctaggacctcagctagtgctggggctggaacatgtctacacatagcttccccacagcatggtggctaggtactaggagtgactgtcccaagaggaccaggcagaagcagttacattttatgacctagtctcagaagtctcataacatcacttccactaaagtcccaagcccccccagattcaaatggagggagcatatatcccatctcagtggtaggaatttcaaagaataaattctgtgaaactgtagtagatagtctgttttctcccctgtttaaaacctcctgaggacctcacatgcttctggataaagctcaggctcttcaacatggtttagaaggtccttcctaatctggcccacatttgtccatccagctccaactcttgctactctacgcccctcttcccctcttgtggaatggctaattcctactcatcattcaggtcttggcttagacatcttttcatctgagaaggctttctggtctagtctcacctggttaggtgaactccccatgtgccccatgtacctcatttatcaaagtgcttatcatatgcctgtcactgtctgttttcttcactagactcaggtgccatgtctgtcctttctgctctgtttgctgggtgcctagcatggtaggggatgtatcagaggattagtacttatttaactcaccagctcatttaactatattgtataacaatgttggtggtcatattggtcccccatggacagcttttcgtctctaataccatacactcagtgcagggtctgaatgtccccccaaactcatatgttgaactccaaatccccaaggtgttggtattagatgatgtagcctttgggaaggaattagggtggtgccctcatgaatgggatttgtgtcattataaaacaagcccaaagaaatttggtcaccccttcctttaagcgaggtcatggcaaaaagacgctgtctatgaaccagaaaatgggctctcactagacaccaaatgctggtgtcttgttcttggatttcccagccttcagaactgtgagaaatatatttctgttatttataagccacccagtttttggtattttgttatagcagcctgaagagactaagacagccagtcccaaccttccacatttagacctgactccaagttttgctcagcccactgtgtatcccttcctcctcccaaccaaagtgtccccactctttctctattctgttctgcctattattcaaggtctaacttgtgtcactttttcaatgaggcatttgcaagctctttaaattctcaaggattctccattaattcaccatatctattttgagaatctacaaaggacaaggcactacgaaagactctacatgccacagggaaaagacagacaagatctctgtcccaacacagaaaattttagcctgccatgttgactcccagggatctttttgtttctgtaggaggtgctcattacagagtggccaaattcctactgaagaatggacttggttgtgaaataaaacaatcctgggcaatatttgttgatagttttgttgaggatgattcaggaaataaatacaaacttttaact

SEQ ID NO: 2588 - DNA, 665 bp, Homo sapiens
ggggattgcgagtcaccgagtttcccgcgcggcttgagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttccctgaagccccttcaccacctgcgctgcccactcgaagtattcctggactcgatgttctgaccatcctgcataagagtcgacagaaacttgctagcgtgatgtcaaggaaagcactgccttttccccacttcctggcaagcttggttcaaggccatgagttcctgatggaatgagctgtcctgaaaacttccccttggcccagctattgtatttttactgtatgaaagaagatcaaagag

SEQ ID NO: 2589 - DNA, 1742 bp, Homo sapiens
atcgccgcgccggccgccaacggccactgcaacggtccctaccggggagggccggcttttgccggcttccggagaagggaggaaagagagaggtcggggcttgggggcagagaagggcatgggaaatgaccggggtggggtggggggacttgggggcaagcccctcggaagctccagcgggtccggagataaaggacacccgggcgcagcggccctcttcccctgcagcggctcggtcccgggtggcgctcaccgtgcgcgcgcggaggccgctggaaatcacgagtgggcagctgagggggcaagggtggtggtcccttccgggcagtgtcgcgcgctccgtgggcgcaggccgcttcgccctgtcccgctgcaccgagagccgctcctagtgaggcgagagccgggagcgggagggacttagccagccagcagccctctgggtcgcgaggggcgggagaagcggagagcgggggccttcgcggccgctcgggctgcccggcgcgaacgcctgcccggaagaggccgcccgctagcttctccgccgtcccccggccccggcgctgtggggcgcctcctggacgcaggtttacctaacactgtaaagagaacgttcaatgaaatacaaagaaaaagatgatttttttgctccaagagaattattccagccttggggtggagtgggtgtggacagtgagcagaaaaacaagaaaccaagttctgggaggaaataaaatgaatataatcagtggaaaattcagcaacgcaatattgtgtgacaacagtaaatgaccaatttataatttaaattctatgaaaaagagatttagaagagagttctaccaaacccactgttccctagggaataaaatgagtaacgctgactggcaacagtgcatcctgagggagcctggagaaacaacagcagcctccgacctcaagatatcctggttagctgcaaagtctgttatatattcattcaaatatttattaagcaccttactgtgtgctgggaactcttaagtgctagggattatgaacaaaacatatttacatggagcttacaatctaagtaaggggaagacaagtaaatacatgtcagatagtgaaatggtagagaaaagaaaaaacggtggtcagggaaagccttactgacatttgagctagtactgaaggaagtgaggaagaaggctaagcagctaccttggaggaggaattttccaggtagaggaaacaccaagtactaagatctgagacggagtgtgctttttgggttcaaggaacagcacggaaaccatagtggcaagagcagagagtaggagatgaggtcaaacatattaaagggggctggtcttgtagggcctgaaagaccacggtaaggactttggcttttgctgcattagatggggagtcatagtttcaaaatttagtcacctaaaccatccttagcactacgctgagcaattatgccaggcctagaggctagaaacggagatgataatcctttagctccttgcaactcaaagtttattcagcccaacctctctcactaccactatcactactatcttggactgcatagcagacttaactgaatctacattttaacaagatcttcaggagatttgtgtgtacattaaagtttcagaaatcactgttttgttcctcggaattgaccaatgtctaaagttttattgggagacatccaatccatctatgcacatccattctatgactgcctc

SEQ ID NO: 2590 - DNA, 1578 bp, Homo sapiens
actagatgggaggagtgtagggaatgctttctgtgctaggctcaccgcttcctcacaccttccttccttcctgcctccctctccttccaagctggccccaggcacagccctgacaaaggtcaaaccaactgaggatgctggggaagaggggcaggagttttaaagaggaacaatctgaaaccatggggctgggaaaagctgccagaaaatcaggatggatttggggacagtggccctttctgtccactcagctgtcctgtcggactgatgacttggagcccgcagttcagaagactcctcatgggatgccccaccccacagagtgggggtgtggtgggcggccggatgcgtagtccagggacgtttgtgatttggagtgtgctagactatgtgtataagtcacatgggtgtgtgtcactgtgtgtgctggcgtgccttataggtgtgcgtgtttccctgtcagttttgacacggattatatgaaattaataagggtttttacgttagatatacatcacttctctacacccccagctcctccttccctctggacaagctttccgccaagcccacctcttccccaggtgcagtgagctgggggtgagggcacatggtaccagccgcccgcggaaccgagacagggctgggccgggagaccgccagcggaggcgagtccgaagcctgagcggggagggaggggcgggcgctggcctggccgagccggctgggcgggaagcaggctgcatcctaatccacaggccccggtccgactcccaaactgccgttcagcgtggaacgggctggccggagccacgccgcctccagcacacgctcggcgctcgggacgcaccgaccgagggacggaccccgtgaggcctgacacaaagtggactcgtccggggtccccacactccccgtctggcccccggtgtcccagatcgttgcccctccaagcctagaccccgaaatctgccccttccccgcgacatgtctcctctccgcccctctcaccgcctctggagctgagcgctcagggcgcgggcactcctgagtccccggttcctaagcagcgtccggaacctcctcctcggctcccgccgccgccgccgccgcttctgccgccgccgccgcctcttccgcccgcggagccggagcccgagcccagcgccgctcactccacccggctggccggtgatggcaccctcctccccttttgacctttggatgaccacggtgcctaggacccctgggaggcacagagaaacatttactagggacaacttttgagtgtcagaccctgtggacacaaagaaaaagcttgggttcctgccttcaaggggctcacagttgagtggggaagacagacacgtaaatgaagaacaataacagactgtgctgagtactggaatggaagtgcagcaggaactcagaagaggtcatcactggaggggccacctctgggaaggcttcaccaaggaagtataattggagctctgtcttgatgttcaaataagagctgcagagagggtgctatcgagcagcacataatcacttaattacatattgctttgtattctt

SEQ ID NO: 2591 - DNA, 1021 bp, Homo sapiens
ctgtttattgcattaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgccgccccctcctcggccctagcatgccgcggccgcctcgcggctacccggcttgccggtcccgagcggcagccccggggtggcgatggggtcgcgccgaggcagcggaggttctgcgggcgactggaggttggcagtgggcgggagaaagaggaaggcaggcgcggctgggcctcggcctctggcgccgcggtaccctttgtctcggcagcctgacggccccgccgggctctccggagaggggaacgggcggcgagggtggcgggtcctgggcgccctgtgctgcggggccgagaggcgctcgggtcgcggcgggatcggccggaccagacagggttaatggaagagcctggccagtcccgcgcggggcccccgcagcgacagccttggccgcggggactggagtcctgagggggagaagcctgccgttctgaaggctcgggacttctgccccaaagacttcgccgccgagaactgcgggtgcactgcctcagggaagaagttgagaattttgccaggtcatctctgccagggcacagttcatcactgtgtgtttagtgtgtttcggtgaagctctccaagtgtgttgaatcagcgtgcctagcctcaagggtgcatcgtgaaaactgaaaccaaaggaatgatacaggcctgctttgtgtgtgtcttcccactttaagcttgttttcagtacaaatactcttgctttaaacctgattggactgtggcgagcggacatctgttcaaaggaggggccgagaccacagtacttctgaagggggcttgataatgtggaaacattttaagttttctctccggactgttttgctctctcaattcagcacttcccatgtatccaaacagagg

SEQ ID NO: 2592 - DNA, 1967 bp, Homo sapiens
cattatcaatttcagctttagtagaatgaggactcaagacacttgtgaaacaaaatgaaggcaaagtcctatattttgacacttttctctccctcccaaacattcacggttgctttacccacacctaattccacagcatttttttctttaataacacgtcttttatcaggtctttcccaagttttcaactttttttcatagagattactctcttcacactcataattgtttgattttggtaatattgaattaaattacatcgttattaagtacaacttgcaaaaacaagttttggaacaaatacaactgatttttttttttttttttgagatggagtcttgctctgttgcccaggcaggagtgcagcagcacagtcttggcttactgcagcccccgcctcctaggctcaaagaattctcctgcctcagcctcctgagtagctgggaggctgaggcaggaggattgcttgagcccaggaggttgagggtgcagtgagttgtgttttccagcctgggtaacagagccagcccctgtcttcaaataaaaataaataaataaaactctccaagagcacccatttgctagacactatggggggactatcctgtctactggtgccctcttgtgttaaaacagcaggtctacatgagaattatgaagctttaaggtgcatgtgtctgagagatcttcattcaccttggattgcacattaaaaattagccccaaaatgattcaaatggtggtgcttgaggtggggccatggaatcagaagtgttttctccccacctcctaaactgtgtaaaatgaaattattaatgtattacttttaccagtaaaacacacacacactaaaaaaacagaacaaaacaccaccacaaattaccactacagttaattagttataacaagcagacccagactgggcacaatggctcacacctgtaatcccagctcactcagtttctgagaatcaggaatctgcatgtggcttagctgatgctggggctgcagtattcatttccaagatggcacactaacatggttgttgcccgaaggcctcagttcatcatcacatgagcctctctacaaggctacctgggtgttctcttgacatggcagttggctttttccagaatatgagtgatcccagagaggatcactcagttgaagaatttaaagagaggcaaagcgtttaggaaaggtgaatccacatctgttttctccatttgtatttaggaagcccactgaattatagaatatctatcttaaaaggtttagtcttccaataaagcaacagagaatatgcttaagatcatgaactctggagccaaaatgccacttactagctgagtggacctctggcaattacttaacctctttgtgcctcaatttctgcaaaataaggatagtaatatcacctacctgattaagacaattaaaggaaataatgtgcaattaacaagttacacgtaaactgcttttaacagtgcttggcatgtagtcagctctatgcaagcttaataaatgcgatttttaaaaaagtcagacttgacaaagtatattagggttaaaatagttcttctattatttctcccgcttagtattcttatctctcaaggtttttgctaataataatttctgttacgcctcaacttaaactgatgcttaatggaatttgttatatttaagggaaagtaatctaaattgctaagaagatagatgtggcaaaataaaaaatatttggtctttgtccctggtccctggcacagagcttctcagacccttggaaattactgggtttttttttttttttttcttgagacggagtcttgctctcagggggagtgcagtggtgccatcttggctcactgcaacctctgcctcccgagttcaaacaattctgcctcagcctcccaagtagttgggattacaggtgcccaccaccatgcctggctaatttttgtatt

SEQ ID NO: 2593 - DNA, 1071 bp, Homo sapiens
gaggttgactgtacatacaaatattgagcatttcctcctggcctccgtgataaacagaagttttgatattgttaggcgagatggaaagaaagtatcaaggagtgagctgaagccactgcccttgagaaccctctcgaggagtctggcctcatgaagatgccagaataaatggcagtaagaagaaaaagagcaaagataagaagagaaaaagagaagaagatgaagaaaccagcttgatatgttggaacgcagctgctcaccagcaacggaacaaagctggacggagaatgactttgaagagctgagagaagaaggcttcagatgatcaaattactctgagctacgggaggacattcaaaccaaaggcaaagaagttgaaaactttgaaaaaaataaatatacatttcttaacgtggaatctggtgaacagtaacaaactttggtgaaatttcaggaaccctagccattgaaatggatgagggaacctatatacatgcactcgacaatggtctttttaccctgggagctccacacaaagaagaatcaccctgaaaccgggctgtggaaaatatcttggtataaattcagatgaacttgttgttggcgttcagatgcaattggaccaagagaacaatgggaaccagtctttcaaaatgggaaaatggctttgttggcctcaaatagatgctttattagatacaatgaagcaggggacatagaagcaaaaagtaaaacagcagaagaagaaatgatcaagattagatcctgtgctgaaagagaaaccaagaaaaaagatgacattccagaagaagacaaaggaaatgtaaaacaatgtgaaatcaattatgtaaagaaatttcagagcttccaagaccacaaacttaaaataagtaaagaagcagtaaaattcttaaaaagatgcagaaagatggatttttgcatgagatgcttctggacagagaaccaaattgaaagccgacagatactgcaaatgactgggatttttgtttctgccttatctttttgtgtttttttctgaataaaatattcagaggaaatgcttttacggag

SEQ ID NO: 2594 - DNA, 2540 bp, Homo sapiens
agcttccaaacccagggcttgcgcttgcctttgcctcttccacgtaagtacctttcaaaggtctgccttttatgcagaggaatgagtttgtgcaggaactagaccaaaatgctatcgttaccgtatttgctcatctgttggaaaacggtagaggtgaaagggagaataggaatgacaagcttacccccaagcagaagctaggaaatgctgctgggtgtaagacatcagtcccttacaaacaaaactgcatggggtcgaggggaatttggaggaaggggagttggtgttggtcttttggccaagcaggtgagatgtttttcttactcgcttctattttggaaagataactttgaaaccagcatttgtcagatgcctatgattttctcatttagaagcagattattgttattctacatcccagacttttatctaaaatcagacataatatcgttttaaaatatgttttgtgtttgacaaggggaagtgagggagctgtctctggatggagaagtggcttgattttgaatttgcagtttattgttacttctggttctcataatacttatttataacaacaaaaacagtgattttttttttttgagatgaaaaggaatcccaggctctggggtttagagaaagtataggtttgtgatatgtgagtggcatccaagtattcagggtaaactgttaagtaaagtggaataagaatcattgaataaaaaggtacaatctatcacatagttcagataagaagctcttaaagagaaaaggaatgcaaacagttcccatgaagtggcactgctactggacagggccctgtagtgtgtttagttaagtaaggttaagtataaccagggcaggcagagaacaaaacgaaggtgctggggaggtgggaagggaggagaagggaggagcagatagtaaaggatttataattaaacaacagattcatgaaaagcagataggaatagagcagggcattaattccatagtctatccctttgtatcaagaatctggtgaaagccaaggacctttctcaggtattcattcctcgcttcctgagcctccccttccaccccacaccccaacccacaccttgactctcactttctggactcctagaagtccacggacctaaatgaagctcatatgcttattattatttttttttaactgggctgaagctgccgactgaggaacctctccagaagtggtggcgagttaaaaaccttcaacgtggcaggcacttcttagccaccaaactgaagcttggttttaagttcatgaaggtcttatgtcaatcaagcaaataatgattaagggctatatctgagaaaagataagttgaaggccaagaggaagagaaaagaaaaaatggatcttgttctcaaagagcttgaaatctaaagtccagggagataattagatgttatgtccatgcacaaaataggatgtgttgagtgattacatttgtataaaatgatagaaaatgcaaactaatctatagcaaaaagaaagtggctgggtgcggtggcccacgcctgtaatcccagcactttgggaggccgaggtgagcggatcacttgaggtcaggagtttgagaccagcctggccaatatagtgaaaccccgtctctactaaaaatacaaaaattaggcgggcttggtggtgggcacctgtaatcccagctactcgggaggctgagacaggataattgcttgaacccgggaggcggaggttgcagtgagctgagattgtaccactgcgctccagcctgggcgacagagcaagattctgtcttaagaaaaaaaaaaaaaagaaagaaagaagatccatggttacttgggaaggtaggggcaggagaaaaaatgtttggggggactcccaaggtacacaggaaacttttgagggtgatggatatgttcattattgtgactgtgaccatttcttatatgggaagatttatcaaattgtgtactttaaacattcagtattatagctgattactcccaacaaacaatactttaaccacattatttttatttttatttttttgagataggatctcactctgtcacccaggctggagtgcagtagcacgatctcggctcactgcagcctctgcctcccaggctcaagcaatcctcccacctcagcctcccaagtagctgggaacacagacttgtgccaccacacccagctgtagagatggggttttgctatgttgcccaggctagtcccaaactcctgagctcaagcgatctgcctgccttggcctcccaaagtgctgggattacaggtgtgagccactgtgcctaaccaacaatataatttttaaataagtaaaagcatttctaaaaatcagcctatgtaacatgctgaacataaaagatgagtatttatggagaaaaaaataaattcagtaaagcacagagaccagacagtaaggatcatagacttttatagaactgggagggtccctggagataatctaacctagtggttgtggggcctggagaacttaaaaaagaaaaaaaaa

SEQ ID NO: 2595 - DNA, 1950 bp, Homo sapiens
cacaaagctcagcgagaggttccaacaggaacccgtcgttcaaggagaaaacccaaagcaaccaagcatgccgaaggagcccccaagggatcccggaacccaggcaagtcgcgggaaaaggggccgttaggaggtcgccgtggccggggcggggcggggggtggcggcctgggcttctccaggactcggacagcgacttccaagcccactccccacacaggccccgcgccggtcccaggtgccaccaatccccgagtggccacgcgaccaagcctcagctgcgggcagctagcccgcacctccacgtcgatgtccaggaagccgccctccgccacctcgaagatgaggcccatcttggtgcccgaggtgacccgctcaaagaagcactcttcagcatgggcgtcgatgctaacgaaatagcccgagaccgtggccaggagagcggccagaagcaccagcagttcagcaagcgtcaccatggtggggctgaggccgaagccaggacccggactgcggcctccacagccgccgccgccgccgccgccgccgccccgctgccttctcagccaccgccgcctaagctccgccccttccgcctgcgccaccagtgggggctgatgcgggcgcagtggattggcgggctcccgcagctgccacgtaaagggaggcacggcagccgccgagggacaagcgactctgcgcggcccgagcctggacggcggctccgaaggaccaaaaatttttccctagtcctttctcgtccaagctaaagttcctgtggacttcccaggaaaacgacagtgtccggaagcctctgcaatgccctcttaggattgtccaagaagatggcgaaacatttgcaggcagcgataggagttgagggaatgtgcgggctgaaactaagtagagacggggtttcgccatgttggccagtctggtctggaactcctgacctcaagtgatccgccctcctcggcctcccaaagtgctgagattacagaagctggagcgcaatagtgcaatctcagctcactgcaacctccacctccgggtttcaagctattcttctcccttagcctcccaagtagctgggattacgggcgcctgccaccacacccaggtaatttttgtatttttagtagagacgggttttcaccatgttggtcaggctggtctcgaactcctgaccttcagatgatccacccgcctctgccttccaaagtactgggattaacaggcgtgagcctccacacccagcaactattgcattttattttactgtatgtatgtaataccttaaccacacacaaaaaattaccttgttcaaattttccagaattagaattctaccagttccccaaagtcttgctgtttctccatgccccttagcccttaccagctgctagagctgtcttttcatcctttgcaccctggcacactcctactcatccctcagaacccaaatgtcacctcttatctctaaaatgttccttgacatccttctgccaaatactagccccttcctctctgtttacaatgcagattcggtcctagtgaattactgttattttctactctgcctcactcatgaaggcacaagacttgatttacatacgctgtcctcttcaggccctgccacagggccacagaaggacctcacacatttcatgtcaattgaggtcactggactgacctgggaatgaggagcctgggttgttactccacttttgcacatagatgtgtgaccttgattattttccaccacgtcctggcctcggtttccttatctgttaaaagggaatgacaccacaggccttgcaaaattgaagggattatttctttgaagaccaacaggcgatagggggcagtagtgtcccaggatccagtttcccgcttcaggtttcaagaaacaggagcagctgcagtgatgaagttttcccgactatgaca

SEQ ID NO: 2596 - DNA, 3372 bp, Homo sapiens
ggagggggcgccaggcagggcctgtcccgcctggggagactgcgcccgggataataggagcgcttggcctctgagactacccggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacattttttttatacaggcagagaaataatagtgattctgctcacctaaaggaagatagacccaattcaaagtgcctaagtcctgaatgacaacaaaagactgaagaactgacaacgattagaggacactaaggagacttaacaactaaatgcaaaatgggaccctgaatctgatcctggaacacaaaaactaaattagtagaaaagtggtaaaataggtggtcgcgcgcccgaccgccgcagtcccagtcgagccgcgacccttccggctgcccccaccccacctcgccgccatgtgcctccgccgcccagcgctgttcccgggcgtggcgctgcttctcgccgcggcccgcctcgcggctgcctccgacgtgctaggactcagggacgacaacttggagagtcgcatctccgacacgggctctgcgggcctcatgctcgtcgagttcttcgccccctggtgtggacactgcaagagacttgctcctgagtatgaagctgcagctaccagattaaaaggaatagtcccattagcaaaggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattattggtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactatttttgtaacttttgtggaggactgcaatcatttctaaataaatagtcttaaaaataactaaagtaataaaaataat

SEQ ID NO: 2597 - DNA, 445 bp, Homo sapiens
atggcactaagacagattaataaggaacttagtgatttggcccatgaccctccagcacaatgttctgcaggtccagttgaggatggtatgtttcattggcaagccacaattatgggacctaatgacagcccatatcaaagcggtgtattctttttggcaattcattttcctacagactgctccttcaaaccacctaaggttgcatgtacaacaaggatttgtcatccaaatattaacagtaatggcagcatttgtctcgatattctaagatcacagtggttgcctgctttaaaactatttctaaagttcttttatccatttgttcactgctatgtgatccaaacccagatgaccccctagtgccagagagcacacggatccataaaatagacagacgtaaaagtacaacagaatatctcgggaatggactcagaagaatgccata

SEQ ID NO: 2598 - DNA, 1103 bp, Homo sapiens
ttcggcggtcaacgcgctttattccgaggggcttcagatacagatgaccccagccctgcatccgcccggaaggcgtccccttactcccatggggcacctcgataccagctgccctgccctgactcacttctcagcacccatcttacggcagtcggccctggcctcagacccttgggttcagatcccaggccctcctcctactcactgtgagaccctaggcgagtcccttagctcgggagcctaattccgcttcattaacatgggggtaatttaactacctagctagacggttgcaaagggatcagttcactaattctcaatgttggcagtgcatcacattgcaaactccctgcctctgctccagagctgatcagaatcaataagggtggggcctgaaaatactacatccaaatttccgagaagcacagtgtctagcatacccctatctctccatctggggttactgtcactctcaggaagaaataatcacccattattccttcaaccaggaaaagagatgtccagggcacagcttggggccccagaaagtaaccacggaggtcaagatcacaaacccgtcagtgtccagggcatggcctcgcacacatccgaggttttcaaggaccatgaagtgccatggcaagcatcctggcctgagggttaggagagctggatctcaggctcaactttagcctgaattcggtgcgtcatcttagacaaatctggtgagctctgagggctggggtaaggttgagaaactgtgggctcctcagggtggggggtgcttagagaagatggggcctctgagtcctcagactgggggtcttcatcgggttcagcatcctccccaggcccaagccctgccagcctcttgctggcctcccatagccgatgggctgcccggtcgtctcgggcagctggaggcacctcttccacatggcagttggcaaaatatctcccactgaggggctcgatgccctcttgtagagcacaatacaggggtgtctgggcaccccctcttggtgcccggagcaccagccaagccaatgggcgcaaaagtgggcgcagccatccaggaacatggcgcaggaacagctccgagt

SEQ ID NO: 2599 - DNA, 1108 bp, Homo sapiens
gcagcttcggcggtcaacgcgctttattccgaggggcttcagatacagatgaccccagccctgcatccgcccggaaggcgtccccttactcccatggggcacctcgataccagctgccctgccctgactcacttctcagcacccatcttacggcagtcggccctggcctcagacccttgggttcagatcccaggccctcctcctactcactgtgagaccctaggcgagtcccttagctcgggagcctaattccgcttcattaacatgggggtaatttaactacctagctagacggttgcaaagggatcagttcactaattctcaatgttggcagtgcatcacattgcaaactccctgcctctgctccagagctgatcagaatcaataagggtggggcctgaaaatactacatccaaatttccgagaagcacagtgtctagcatacccctatctctccatctggggttactgtcactctcaggaagaaataatcacccattattccttcaaccaggaaaagagatgtccagggcacagcttggggccccagaaagtaaccacggaggtcaagatcacaaacccgtcagtgtccagggcatggcctcgcacacatccgaggttttcaaggaccatgaagtgccatggcaagcatcctggcctgagggttaggagagctggatctcaggctcaactttagcctgaattcggtgcgtcatcttagacaaatctggtgagctctgagggctggggtaaggttgagaaactgtgggctcctcagggtggggggtgcttagagaagatggggcctctgagtcctcagactgggggtcttcatcgggttcagcatcctccccaggcccaagccctgccagcctcttgctggcctcccatagccgatgggctgcccggtcgtctcgggcagctggaggcacctcttccacatggcagttggcaaaatatctcccactgaggggctcgatgccctcttgtagagcacaatacaggggtgtctgggcaccccctcttggtgcccggagcaccagccaagccaatgggcgcaaaagtgggcgcagccatccaggaacatggcgcaggaacagctccgagt

SEQ ID NO: 2600 - DNA, 496 bp, Homo sapiens
gtgatagggaagatgtttataaattcttctgtgggatcagagggcaagcctattataaccagaaaactccaagtatagcagcaaggatggataaacaggctctattagggctaaatccaaatgctgattcagactttagactaagggccctggcctattttgagcagttaaagatttccccagatgcctggcaggtgtgtgcagaagctctagcccagaggacatatagtgatgatcatgtaaagtttttctgctttcaagtactggaacatcaagttaaatacaaatattcagaactaaccactgttcaacaacaactaattagggagacgctcatatcatggctgcaagctcagatgctgaatccccaaccagagaagacctttataccaaataaagccgcccaagtcctcgccttgctttttgttgcagaatatctcactaagtggcccaagttttttttttgacattctctcagtagtggacctaaatccaa

SEQ ID NO: 2601 - DNA, 1819 bp, Homo sapiens
taaagaatcagaagaattctagcacatccaaaaattgctacaccaatgaaaatgacttatgttatttaaactgttgaaatcctagccactcaactgtttcttcaaatgaaatcttatggaggaagtcaaatgtaagagaagcttcactgactgcagtgggatggggctggcagcaactccattcacaggcattctgtttcccaccacggcccctcattagatccctggcctctcaaaagagtgttaaggctctaaaactataccaggaagtatatttttgcaaaaccaaatgggctctaagtaattagttttcaaaattctccagtgtattgttttggacttatgtttcagactggtgataaaatttcagcacctcacaacaccatgacacggcagggcagaaggaaaccctctgccgggaagcagatgacctggacgtcagccccagctttgccattaactggctcctcaagccagggcaagtcagtttcttctgacacaaaatgaggggtttagatgaaatggtccataaagtctctgcctattttaaaatactgtaattaatcaacatttgaacatgtatacctgtcatttacaaatgtccatgccatttgaaccaacttttgaattttgtttttatcacctagaaatggggacaaaaaggtaaattaatagcaatagaaaaattcacaggcagcatcaagtatttattaaaaacctaccacgtgttcagcaccactcaaatacacagcaaagagcttttgcgtgggaaacaaggatgaatgatgtgggtccacatcctaccccttcttcctcctcatgacctacgctgaaccaccatgtatggaaaacctggctccaaggctaagtttattagtccatttaaaaaattctgcctcattttcctgcctctcccatcacttggcaactggatgacagagcctgtttatacataaaaggaaacagcattagcagctgcaatgctgaattgactgagcaagccatgcccttggtatttcacacatcaaactttgttttccgcttttgagaagcgtaatttgagtgtcatcaaattataaagacttgatttcagaatgaaaaaattcttctgaaaactttcttcttacctttgagttgctttgcatattttagtaggaactggtatggatgttctacctgtaaatcaaacttgatggtctgcagtaagattctctccagaaccattacttcctcctaaaaatcaatcacaaatgttaggacagtaattacaattgcaggtctcaagcagcattacaaaagtgagctttcctgtctatttattctctcttcaagttatattttagcaactgcctttccttcctttctctcccactcagacttttaacatgctcagagacactgataaattctgaaaagatctcaaacaggaagacaaagcagaggtgtaatgtaaaaaaaaatactgaaaacaaaagatccttaaaaatattattattttcaatacatacatgagtctccctttacaaaacagatctttacgttattgataatttgactaaattgtaatttctttcaagacctcaaattttaaaaatgcaatcttttaggaattttcattgaaaacattttaagcaagaaagagtttatgatagccagcctcatgaaaactcagagataaattgtaccagtgtgtgtgtatgtgtgtgtatatatactcatgtacacatatagtgtattacgtgcaaatgggggcaaatcaattttgtgtttaaatctttcatttatttgaaataaatcatcccaacaacacttactgaat

SEQ ID NO: 2602 - DNA, 935 bp, Homo sapiens
agcagagccaggtttgctgttagcaaagctagagacggtggtagaagatttggctaggccgtttgcatgatgcaccgaagccacagaagagattaatatactcttatttttaagttgctgctgctgagatgttgcagcagttggtgaagatgaggaggaggaggaggaggattcctcagccatcttcgcatcaaaccctacaaactccagggtgtcttcaaaacgcagcttcttctgtatcggtacgtggctggaagcagccactgaaacccccaggcagaaggacgaggttgaaggggatgccgaatccctgggttgtaaaggaggagtggaagaggaggaagaggtggaatcaaagtcttctctctcgttactactgttactgctgctactgctgctgctgtttaactttctcttcttggcagaggtgggcggagtggtgctggtattaccatcagtggcagatctgacctcctgagcagcagcagcagctgagggactgggggaagaaaaacctgttggaaacatgaaaatagcggggtcaacaggcagaggagcatcaaaaacctacgtttatatgcctgcgtgcgtgtaggagagaaggtagcaatgctagagggggaagggaagaaagaagagaggagaaacacagaggacgagaaggaaagtgaaggggggggctacaccgggggaatgggagggtttgggaaggcggataggctgacaccaggagtgagcagaacgaggggggagagcgaatgaggaggcagacaggctcccagggtgatttgagagttgccaggagaggaaggccatttggcaagaatcctgacagacaaaagctggaggagggtagagcaagatggcagaatagaaagcgccaccgatcatactccgcccccacaaggacaccaagttaactacctacacagaag

SEQ ID NO: 2603 - DNA, 1387 bp, Homo sapiens
aaaaccacaatgagatataatttcacctcagttaggatggctattaccaaagataaaaaataaaaaatgctgctgagaacatggaaaagggggaactcttatatatggctggtaggaatgctaattagtatagccatatggaaaacagtatgaatgttcctcaaaaatctaaaactatagccaggcacggtggtgtgtgcctgtagtcccagctactcaggaggctgaggtgcaggactgcttgagcccaggagtctgagaccagcctgaataacacagcaagaccccattttaaaaaatgaaaaataaacaaaagttaaaaatacaactaccatatgatccactggtaatgatctataccactactgggcatatatgcaaaaacaaatatatctatacgtcaaagagagatctacactcctatgtttattgaagcactattcataatagctaagaaatcagtctaagtgtccattatcagatgaatgaagaaagaaaacatggcatatatacacaatggaatactactcagccatgaaaaataaacctgtcattcacagcaacatgaatgagcttgaaagacattaagtgaaataagctagacacagaaagagaaatactccatgtttctactcatatgcaagcataaaaggttgagaatggtggtaaccagaggctgggaaggacagcagagaggcagatagagattggttaacaaatacaaaattacagcaagtaagattccatttgaataagttgtagtgttctgtggcactgcagaatgagtacaattggcaataatacattttatattttcaaatagctagaaaagcagactgtgaatgtttctaaacacaaagaaatgataaatgattgagatggatatgctaattaccctgatttgatcattactcttagcacacatgtattgaaatatcacaccaaaccccataaacattgtcaattaaaaacaataaaagaaacaaaaagaataccaaaagagaaattccaaaatattctgattaaacatattaattactacgactggactcaatccatggtgacaactacctgcatatacatatgcaggttcacctgttaaaattccagtcactttatgtatagtcagccttcacacaatcttctgtaagactgaaaaatgagattccttctctgtgtttattttctgagtttatcataatcttttaacttactttagctacatgtcttatttcatttttggttccaaattgacctctagaaaattgttgaggtgaattttgaactatttactctctctaaagagcagtaaaaaagctgagaaaccacaatcagagggaagaattaggactccctggattacattatgtacaaacagctacaatat

SEQ ID NO: 2604 - DNA, 530 bp, Homo sapiens
tcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagcaaggaagtaacacaggagtcagttgcttcaaaccaaagcccagttatcagccgttcggtctctaggccactgaggagcagaggggatgccttgagacgtgcaaaagacttggggccaggtggcctgtgttcacatcccagctccaccaattatgtgcaagagaatgggatgtcacactggatccttggcctccagggtccattaaggtgagaataagatctctgggctggctggaactagcctaagactgaa

SEQ ID NO: 2605 - DNA, 345 bp, Homo sapiens
tcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattg

SEQ ID NO: 2606 - DNA, 5608 bp, Homo sapiens
ccttccctaagttctcccagggcgctgccagagccctgccggctaagggatggggaaacaaacagtcatccagagtaaagtcatagggctcaaagtctttccggaagcggcgagccagggtctcctcgtcttccttgctgatctgacactgcctccagtcagacttatcaggaacattaaggatggcttcactggccaggacctccctgcagaaatagcacaaagaagtcaaaatggaaactatcagcctgagctctcctcaacatcacccaaaggaggtatgcaaatttctctgactttgctctcctgccctgagtgccatctctgccatactattgatcaaaatcatacccgttttaaatgaccagctcaggtactatatatttcctgatccttcaaaccccacttgcttctccctctcttaaaaaacttggaactatattattggtacttagagaagcaacaccacatagaaaaagggcaggccctggtgtgagaaagatcagagactggatcccatttccagctttgccacttgctatctatgatctagacagatgatttcatctctgagtcttgatttcctcacctatgaaatgcaaataagaacacccaccatacagggtttttgtgaggtacagagataacacagtcaaagtgccatattagctgtgattacaacctgccttaaactgtagttttgtcacctcaactagacatgagtttgcagagtcaggagcctagtcatacccactctgatttaaaattcctctgcctctccttctaggggactcaggcccacgtaacagcagcacaagcccaatgtcaacaaaacaactatcttggctcttaggactaaagaataactacatacagacacactcacacacaagctgccttctaatcgccattgctttatatttttatttttacttattttgatatattagaaataattctattacacatttatatggttcattttccactttgaagttacagtaaatagaagagttagaaacaaatcatgaattctctataagtcaaagaacctaagctccctgggcaaactttgagcctatttcaaatataaaaggaaaatagaactacctttcttgtacagctgaaaaaaatatgccatttcaaatattttgttaactataaaatgctatataactataaattagtatcttgataattactcaatattgaaaatacatcataagcacaaaaccattcagagaatcttctttttgtgtgctttatacgcctatgtgtatctgcaatcgtgtgcttatgttgtcaatgttcataaccgcatctgttgctgaggcaacaacgaaaacatcacgtcagatgtctgaatctcgtagcacacttgttcccatttatctttttgaaaaatgtagacaactacatttactggacttatctaagggggcaatctcttggaggctttctgaattagtccaagacaggttcaaggctcactcaaagcccatttttaactaggggagaaaaaacagctgcaaatcacagacaccagcatcagatactctgttctacacattttccactccccttcaaactgtatcttcttgccagcaacttcccatcttcaatctttgcttaagttatgttactccctctatggttttgcagtcatgttttgcctgatacgaggaacagaactgaagcctcctctaggcctttaccatactgtagaacactgaggttaagacctcaagttttgaggtccaacaggcctgggtttgaacctaccactgtgtgactaggacaagctacctaagctctctacagcctgctatccagtggggtaaccattagccaggtatggctatttaaatttaaattctaattaattaaataaaatcaaaaatttagttcctcagtcacattagccacatttcagcactcagtggccacaagtggctagtcacaactgtattggacagtgcagatatttgagcatttccatcgttgtgaaaagtctaccgggcactgctctagagcctcattttccacactggtaaatcgggatgacagtacctaccttacagagttatgaagattaaatgagtcatgtatgtgtaaagttcttggtacagttcttggcacagagtatgtgctcaattaaagttccctagcacttctggctagaatgccctcacctcaatctttgccctctaaatatgcctctcaggttcaactttgccactttcatgaaggctttcaccaactagaaatgagctgtcccttttctgaatttctacagcacattgttctccaaaactctgtcatggtactcttcacattctacattacattactgtcatatatgtaaacatctgccctaagaccatgggtcctctggggcaaggactgtttacaatttagctttttatcaattgtcccatgtagcccaccactctgttcatagcaggtctagtgaaaatacattgaaaagaagaaaaacataccttccaaactgcaaaggaaaattctttttaattctgtggaaaagcttttctcctgtgtcaagttcaacataaaaatatgctgctcctggctgtgcaatctaaagtaaacagagttgtatgaggatgtccaataatgctttaaaaatctataatctgagttcatctctaggcaaataattcagtctaaatgcacaagaaaaaaagatatgtatgttgctatagatcccaagccacttagtggaactagggcttaaaaagtctaactggaagatactaacaatatcctcccagtggcgtctatccttctaagttcctaccttaggaaattctaatttcttgctcttcccaggaaagcactaaactttggagtaatgccctgttcatctccagtctagtcaatacccagtgctctagttccaaattgtccactgcctcttttttttttttttttttttagagacagggtcttgcgatgttgcccaggctgaagtacagtggtgcaatcatacctcactgcatcctcaaactcctaggcttaagtgatcctcctgactctcagcctcctgagtagctaagactacaggcacatgccaccatgccaagcttatttttttattttttgtagagacaaggtgtctcactttgttgcccaggctggtatcaaactcctggcttcaagtgctcctcccgcctcagcctcccaaagtgttggattacaggtgtgagctaccatgcccaacccattgcctatttaataacatttttggaatgccttgatagctcaacatgtcaaaaaccttaggctcaacatgtcaaaaaccagatcttgccaggcgtgggtggctcatgcctgtaataccttcgggaggccaaggcaggcagatcacaaggtcaggagttcgagaccagcctggccaatatggtgaaaccccgtctcgactaaaaatacaaaaagtagccaggtatggtggcgcatgcctgtagtcccagctactggggaggctgaggcaggagaatcacttgaacccggaaggcggaggttgcagtgagccaagatcatgccactgcactccaacctaggcaacagagcaagactctgtctcaaacaaacaaacaaacaacaaacaacaacaaaaaaaacagatatttactcttccctgaatatcaccatcccctgtttcacctgcttgatgtcagagtgctctgggatttccaacagctctatctgctgctcctgtgcctgggtaatgaaggcatctttaatgtcatcagtagtagagcagctgattgggacaggaatgacctgggggttggggagacaggagaaattccttgtgcaggtcccagagaagttgtgcctgcacagtctctgagaagtagcaaatccatcacaggggtggagaaacacccctcagcacagaatatcctcaggccagacaagcctgtgtcagcctgtctgtaaggacttaaacttatgagatagcctgacacatgtgggagccattctctgatgcaggaaaggcttaagagagatatctccgtcacaagcctttgccatctccgatattatatatgtggcagagttaggcccatttgaaaacttaacaaatgtgccaaaaagaaaaccaccacaactacaaatgatttacaatctgattttctgagctgctagccccatgcaggctttgagactatttcctaccactaagctttccctcatgctgggcctccacacaaaatactcactttcttccaaattcttatccagcaagccccacatcttccttggaacttcctcaactacccattccttttctaaacaaggaacttactatctatgctgtttacatgtactgaccacacacttccctgtgaagtctctggggttaccaccagatactctttaaaaactttttaaatgaatgttatttaaatattaatataaaaatattaaatattttacatattaaagctaaactttatataattttttttttaaagatggagtctcgctctgttgcccaggctggagtgcagtggcacaatctcggctcactgcaacctctgcctcccaggttcaagctattctcctgtctcagcctcccgagtagctgggattacaggcatgcaccaccacgcccagctaatttttttgtacttttagtagagacagggtttcaccgtgttgcccaggctggtcttgaactcctgagctcaggcaatccaaccgcttcggcctcccaaagtgctaggattacaggcgtgagccacctcgcccagcctatttaaatacttatttaccaatatcaaagtccccatagcgcccttccaagtttctatgaacagaccacctacctgtagctggaggtgatggctcttataatttctctcaaatacaacacaccatttccctcgactcttaaagaaccgtctcagagtggccttatacttctccacctcttctaccacctctgctgaaagctccaccactgactggtagtgtccaataggcaggatgaggacatggtcatcagataagcctcctttggccagggcaaggtagcactgaagaagcagcacacagaattgagacatcaatacagcatgtaggattctccagggagaaaaacctatacaaaaagtgagcctgagggtgtaggcgaaaagtacttgaggttattaataaaaattctttcttgaaaaaatctgattttagagattgtagcaacaatgttctcaggtatccgctgaagagtgagattcggcatgaaaatttctatgcaagtagcaaatgaactaggagcaaatgaattgggagaggcacacaagcaggcttttggcttcaaacacactgagctgagggagaccagaacaaatcgctgggttttccctcccatgctccaaacttgaaaacagtttttcagtttttatcaccctcaaccacaaaaagatacaacttctgatttcaaaatgaccactttcggctgggatagtggctcacgcttgtaatcccaaaactttgagaggccgaggcaggtggaccgcctgaggtcagaagttccagactaggctgaccaatatggtgaaacctcatttctactaaaaat

SEQ ID NO: 2607 - DNA, 5678 bp, Homo sapiens
ctcttttgttctggaacgggccgagccccaggaagtggagctgcggagctgaggcctcaccgtgtcttggcccaccctgctcagctgataggaaggtgtgtcacctctttcctaatcggggaaagaaaggtattgtcacttctcagaattggagagcgcggcaaggagtgcacagggccaggtgtcttctcgctcccacagccaagcagcagatgcagagtcccacgcgctgcctgtggccatcaagtcgatatagagcctcgtggcggcttggcccttgtgaatcttccacgtatcgatggcgcacctaccttgtgccaggcgcagcggatcccacaatgtaaaagaagaggaaatacactgcgacatgtgatatggagagacatgaaacaaatcagcagaggcaagatcatggagtcactgaaggctttcaagcaagggattattagcagcccaatttgctgggttttagaaagacaccggctgcactgtggccgacagaggaaaagccagagacagggagatccgccccctaaatgggagagggtggcctgaactagagtaaccgcagggagggtggagcgctgatcatttcaaggatcttcaggaactgaaatgatcagaacttgggaatgactgcatgtgcgaataagggggaaaagtcaaggaaatgcccaggtttggggcccaaggaacaggtttgggaggccgaggtgaggagttcagctttggacataatgagtttgagatgcccacaggacatccaaatacaaatgttaaaggggtaactgaatatatgtgactggagtttgcgaaatcaaggctggtgatagagattctggaatcttctgaaagcagatggcaattgaagctatggaaatggatgagagagtgtgtaaagagcacgagggcccaggttagaacagcaagggcaggtagagaagtcaccaaaggacactgaccagtgctactaccaaagcagtcaggaagttgaagataaggcagacaactggattgattcagttaagaattgaggcacaaaagctgaaccagcattatatagcagtcatttgtagaatctgctttgggtgaagtcacgtcagcctcaattagaggtttggcagttgtcatggaaataaaggggacgtctgtgaaggtgagttacgatggcatctggctagatgggtgaggagagctaagaggtgctctgctgtgaaccattcagcctttcccacacgtgactcaggagtaggggatatgaggacttcattgcaccagtggggaggagaaaagccatccgccccatgtgccaccaaactgtgcacctgacttgttgctcctgcccacatccctgcctcctgaagggagagagaggcagagtgggaagacatattgcctaatggtgagggaaaacacagggactgattcaaatggcaggaaaccccttgtaaatgtttgtggtggttcacattttattgagacaggatctcgccatgttgctcaggctggtctcaagctcttggattcaagcaatgctcctgcctcagcttcctcagtagctgcgcaactacaggcctcattttatcttgttttaaatagagtcccacttaaaaactcgcaatggagaaacaggaaaagggatttttaaaagcatataaactaggtgtatgtgaataaatacacagtgtagctctggggctggttgttggggctgggattgcgatggtaccatccttcttgtgaaggatgtgttttttctaattgggggataattccaggtctcgaatctggatgactagaacaggaagtagaaagtggtttgaagaagcactaaaaagtgggacaatgtttcaaacacattgcgcatatcacattgaagaccttgctctctttaatgtcttacaagtttattcccaggttaaaaataatttaaaaaaaaaactagttactactatcaatactctgataatgcaagtaatctcgatttgttgggtagatactggaatatcacactttcttaaaatagtatattttacagtaaatatagattagtcaagtatctttctgggtctcaatgcaaagtttgagaatagtgacatgttatttttggacccagcaaaatattttctcaactctgtaaatgggtttaaattccacctcccaccacttaataaactttttttttcctgccccgacaggatcttgctttatcgcccaggctggagtacagtggtgcaatcataactcactgtaatcttggacccctgggctcaagcaatcctcccctcaacctcccaagcagctacaactataggcacgtgccaccacaacccagctaattttcttatttttcagagacagggtctatgttgcccaggctggtcttgaactcctggcctcaagtgatccttctgtctcagcctctcaaagtgctgggattacaggtgtgagccaccgtgcccagcctagctgaccttttaatttctttgcctgtgaaatgggtacttccctcatactgatgctgtgagaaacaagtaagaatgtagtaaagtactcattgcagagcctagtagtcacttgggtagttattaataaacagctgtaagatgatagtcacactcttaacagtaaataagattatttattggattctcccacattcaacctccacctcctgattagaacaggagaaaaacctgaggccacaagaaatgatcaagaaacaaaaggctgcggcagttatcactgcagttcctatgaactggtttaaatcagcaatgaggtatttgtattttgtattgcattactcccattaagttaaacctcaattaactagaacctttgttccaaaatggtgttgacagccaggcgtggtggctcacgcctgtaatcaatcccagcactctgggaggccaaggcagctgaggtcaggagttcgagaccagcctggccaacatagtgaaaccccatctctactaaaaatacaaaaattagctgggcgtggtggtgggcacctgtaatcccagctactctggaggctgaggccgcataatagcttgaatccaggaggtggaggatgcagtgagccgagattgcaccactgccctccagccttggcaacagagcgaggcttcatctcaaaaaacaaacaaaaaacaaatcaaaattctgtttatattcacttttagaagaaaaaggcaaatgacataaaagagttttttttatatatatatatatttatttatttttaaaaactccaggggatgtcccaaagttagtaaacagttctgtttcttgtcccttttatggctgcatgcagtttcaattgttcagtacaacagatgaggcatttaaaaggtctccaacgtcaagaaacactaactcatctctggcatatcatattttttaaggcagaagtattttctgtaatggttactacagagtgtttactggttaatttttagttaaccagaaccacacatcccatagataattccatttaactgaggtttatatccgtaagagcattaccatagaaaaatttccctttagcaatttcaagagacctcagccaccaatatacctaccttctttacaatataaagtgaaatattactttagatgaaaattttttgtatcttacttagaaaaaattaagttgatatttaaaagaattttgatttttaatcaccttccacaacgatttgatataccttaaactccactttcattttttataagagaatcactttcaagggaaaaaaatggatgttactatattttaaaatctgctttataaaaaagtgtataaatatcaatctgccagatatacttcctatccccaacacagctgtaacactgactaatggggtcatgaccatgaagcaaattttacttcctaaatagaaatgtgtaggtggcagaaagcgtatttttcagcaggagtgattctgttggatctctttacaatgtcagagcagttgttagaaatgttagtattttattcggtttcttgctgtgaaggattatcacaatgttgaagtgatggctgttcacccagtcgtcatcaccgtcatcatctcaatcttgggaatcatcagcagtgtcccccacacagagagacaggtatagtggtgcagtttagtgacagggaatccagtcttagatcctgtttatatcacatttttgtgaatttacacaaaattccatttatagctttaaaactgtactacataacacattactatactactacaaaatatccttctctataaatgcactgaatattttcttgggcattttattaggccttttttagcattattacaaatgctaacaacaagatacttcaaaccaccaaatataaagtcagcttcttaattttctgaaatttagttatttgagttaataagaattctgtaggaatactgacccatctcttttcatccaaccttcaaaatagttaagcctatttgcccatctcacctaaccttcaaaatagttaaaacaaaaacaaacccaaactagctatatataacaagaatctttcaattcccaaactattgaaagaccctaagtcagccaatctatgaaattatacaagatgaaggtgaaaaagctgtgcttttttttaaaccattaaacccagttcttttctcttaaagttgtaagaaaatggaaaatctgtttttaaatcatgcaaagatttaaataagcatttttctatctgctctaagaaactgtttcttatcttacaattttaaatattcataacactcaaactacttttttgtggccatttatgtttttgacactagattgtatggtattatttagccaagatgtattataatgctaaattatgtataaaatatgatttctggaatttgtccatcttctattgaagtgccattattattgccaggggaactaaaaaagaaaaaaacagtcttgcttgcagcaggtgtctcatgcactactttcttcaatccttttgtgccatagtgggaatctggaccctaaatgagaacaaaaggttccttagtaattttcatttaataagcactcagtttaatgtggtgttttaattagattaatgttccattatatttcactatcattcctatataaaattttatgctgtcatttagagaaaaatgaagtttttaccaaaaaactaattaatgaataaaaatactgaatgtacagcccagctattagagaatagtgaaaagattttacaaaaataacttttattttctgccaaacattcaactgcttactgaaacaaagggctacttcttaagaagagctatttctttcagaacagagctgtggggagaagtacttcttttcggaaggcagtggaatattttagctcccagcttcttttcccccctctttataaatggctcagctgtcagtgactctcagcttctaaaacacacattctgcaacattcaagaggaaaccatctggaacatagtgcatgactcttactttgagtgttgcacatgctgtgtagcacacattgggcaggatctctatgggttccttgaacatgaccctgaatgtgttagctgtcccatcacaactaaagccggtatcattctgtcccagggtttgctttttctcatattcaatgatctgtaatttttaagagacaagttacatttaag

SEQ ID NO: 2608 - DNA, 10443 bp, Homo sapiens
gctttagacccttcactttccctttgctctatgttgtcatttaataacttccctgtttttcaaatcatatgagagtctgtagcctttttgatagcaatcctgtacccacataaaagctgcattttcaataggaaataaaaatgtatttcacaaaaagatttttgtgcccgctagcgtagctgcagcaatggcttcacaaatttccttttctttttaacaatggtcctgatgctggattcatttatcttgaaatggtgggcaactacagatgcagacctcagtctatggtacacatcaagcaattcatatttttcttgtaatgtcatgacttttctctgcttcttggaagaaattccaacatcactagtagcactttatatggttcctacctatggtgttattcaaggtttacaatattgcactaaagacgaagaacatgcgataaccataagagatcacttgcaggtttgttacgtaggtatacacgttccatgacggtttgctgccgccatcaacttgtcgtctacattaggtattcctcctaatactatccctcccctaggcccccaccccccaacaggccccagtgtgtgatgttcccctccctgtgtccatgtgttctcattgttcaactcccacttaggagtgagaacatgtgatgtttggttttctgttcctgtgttagtttgctgagaatgatggtttcctgcttcatccctgtccctgcaaaggacatgaactcatccttttttatggctacatagtattccatggtgtacatatgccacattttctttatctagtctatcactgatgggcatttgggttggttccaagtctttgctattgtgagcagtgctgcagtaaacatacatgtgtctttatagtagaatgatttataatcctttggatatatacccagtaatgggattgctgggttaaatggtatttctagttctagatccttgaggaattgccacactgtcttccacaatggttgaactaatttacaatcccaccaacagtgaaaagtgttcctgtttctccacatcccctccagcatctgttgtttcctgactttttaatgatcgccattctaactggtaactcattgtggttttgatttgcatttctctaataaccagtgatgatgagcttttttcatgtttgttggccgcataaatgtcttcttttgagaagtgtctgttcgtatccttcgcccactttttgatggggttgtttttttctcgtaaatttgtttaagttctttgtagattatggatattagctctttgtcagatggatacattgcaaaaactttctcccattctataggttgctggttcactctgatgatagtttattttgctgtgcagaagctctttagtttaattagatcccatttgtctattttagcttttgttgacattgcttttggtgtttagtcatgaagtctctgccaatgtctgtgtcctaaatggtattgcctaggttttcttctagggtttttatggttttagatcttacatttaagtctttaatccatcgtgagttaatttttgtataaggtgtaagaaaggggtccagtttcagttttctgcatatggctagccagtttacccaacaccatttattaaatagggaatcttttctccattgcttgtttttgtcaagtttttcaaagatcagatggttgtagatgtgtggtattatttctgaggcctctgttctgttctgttggcctgtatatctcttttggtgccagtactgtgctgttttggttactatagccttgtagtatagtttgaagtcaggtagcgtgattcctccagctttgttctttttgcttaggattgtcttggctatatgggctctttttgggtttcatatgaaatttaaagtagttttttctaattctgtgaagaaagtcaatggtagcttgatggggatagcattgaatctataaattactttaggcagtatggccattttcacgatattgattcttcctatccatgagcatggaatgtttttccatttgtttgtgtcctctctgatttctttgagcaagttctccttgaagaggtccttcacatccctagtaagttggattcctaggtattttattatctttgtagcaattgtgaatggtagttcactcatgatttggctctctgttattggtatataggaatgcttgtgattttttgcacattgattttgtatcctgagacttttgctgaaattgcttatcagcttaaggagtttttgggctaagatgatggggttttctaaatatcatgtcatctgcaaacagggacaatttgacttcctctcttcctatttttataccctttatttctttctcttgcctgcttgccctgaccagaacttccaatactatgttgaataggagtggtgagagagggcatccttgttttgtgctggttttcaaagggaatgcttccagcttttgcccgttcagtatgatattggctgtgggtttgtcataaaaagctcctattgttttgaaatatgttccatcagtacctagtttattgagagtttttagcatgaaggggtgttgaattttatcaaaggccttttctgtatctattgaaataatcatgtgctttttgtcattggttctgtttatgtgatggattatgtttattgatttgtgtatgttgaaccagccttgcatcccagggatgaagctgacttgattgtggtggataagctttttgatgtgctgctggattcagtttgctggtattttattgaggatttttgcattgatgttcatcagggatattggcttgaaattttctttttttgttgtgtctttgccaggttttggtatcacgatgatgctggtgtcataaaatgaattagggaggagtccctctttttctattgttgggaatagtttcagaaggaatggtaccagctcctttttgtatctctgatagaattctgctgtgaatccttcaggtcctgggctttttttggttagtagtctattagttactgcctcaatttcagaacttgttattggtctattcagggattcaacgttttcctggtttaatcttgggagagtgtatgtgtccaggaatttatccatttcttctagattttctagaggtgtttatagttatttgtatagagttgtttatagtattctctgatggtggtttgtatttctgtgggatcagtgatgatatcccctttatcattttttattgtgtctgtttgattcttctctcttttcttctttattaattgggcttgtggtctatctattttgttaatcttctcaaaaaaccagctcctggattcgtggattttttgaagggttttttgtgtctctatctccttcagttctgctctgatcttagttatttcttgtcttctgctagcttttgaatttgcttgctctcgcttctctggttcttttaattgtgatgttagagtatcgattttagatctttcccgctttctcctgtgggcatttagtgctataaatttccctctaaacactgctttagctgtgtcccagagattctggtatgttgtgtctttgttctcattggtttcaaataatttatttatttctgcctaaacttcgttatttacccagtagtcattcaggagcaggttgttcagtttccacatagttgtgcattttttagtgaatttcttaatcctgagttttaatttgattgcactgtggtctgagagaccatttgttatgatttccgttcttttgcatttagctgaggagtgttttacttcaattatgtggtcaattttagaaaaagtgtgatgtggtgctgagaagaatgtatattctgttgatttggagtggagagttctgtagatgtctattaagcacacttggtccagagctgagttcaagtcctgaatagccttgttaattttctgtcttgttgatctatctaatactgacagtggggtgttaaagtctcccactattattgtgtgggagtctaagtctctttgtaggtctctaagaacttgctttgtgaatctgtgtgctcctgtattgggtgcatatatatttaggatagttagctcttcttgttgggttgatccctttaccattatgtaatgcccttctttgtcttttttgatctttgttggtttaaagtctgttttatcggagaccaggattgcaacccctgctttttttttgctttccatttgcttggtaaatattcctccatccctttattttgagcctatgtgtgtctttgcacatgagatgggtctcctgaatacagcacactgatgggtcttgactctttatccagtttgactgatggatcttgactctttatcctgtgtcttttaattggggcatttagtccatttacatttaaggttaatattgttatgtgcgaatttgatcctgtcattatgatggttatttttcccattaattgatgcagtttcttcatagtgttgatggtccttacaatttggtatgtttttgcagtggctagtgccagtttttcctttccatatttagtgctgccttcaggagctcttgtaaggcaggcctggtggtgacaaaatctctcagcatttgcttgtctgtaaaggattttatttctcgttcgcttatgaagcttagtttggctggatatgaaattctgggttgaaaattcttctttttaagaatgttgaatattggcccccactctcttctggcttgtagggtttcttcagagagatccactgttagtctgatgggcttccctttttgggtaattcaacctttctctctggctgcccttaacattttttccttcatttcaaccttggtgaatctgatgattatgtgtcttggggttgctcttctcgaggaatatcttcatggtgttctctgtatttcctgaatttgaatgttggcctgtcttgctaggttggggaagttctcgtggataatatcctgaagagtgttttccaacttggttccattctccctgtcactttcaggtacaccaatcaaacgtaggctaggtcttttcacatagtctcatatttcttggacgctttgttccttttcattcttttttctctaatctgtcttcacgctttatttcattaagttgatcttcaatctctgatatcctttctcccacttgatcgattaggccattgatacttgtgtatgcttcacgaagttcttgggctgtgtttttcagctccatcaggtcatttatgttcttctctcaactggttattctagttagcaatttctctaatcttttttcaaggttcttagcttccttgcattgggttagaacatgctcctttagctcggaggaatttgttattatctgccttctgaagcctacttctgtcaattcgtcaaacttattctctgtccagttttgtttccttgctggtgaggagttgtgatcctttggaggagaagaggtgttctggtttttggaattttcagcctttttgcgctgggttttcctcatcttcctggatttacctacctttgctcttttatgttggtaacctttgggtggggtttctgtgtggacgtcctttttgttgatgtagatgctattcctttctgttagttttccttctctaacaggcccctctgctgcaggtctgctggagtttgctggaggtccactccagaccctgtttacctgggtatcaccagcagaggctgcagaacagcaaaaattgctgcctgttccttcctctggaagcttcctcccagagggtcacccgctagatgccagctggagatctcctgtgtgaggtttctgtcaacctctgctgggaggtgtctcccagtcagtaggcataggggtcaaggacccacttgaggaggcagtctgtcccttagcagagcttgagcactgtgctgggagatctgctctcttcagagctggcaggcaggaatgtttaagtctgctgaagctgcgcccacagccacccgatcccccaggtgttctgtcccagggagataggacttttatctataatccccttgactgggactgctgcctttctttcagagatgccctgccagagaggaatctagagaggcagtctaggcacagctgctttgccgcactgtggtgggctctgcccaatttgaatttccctgtggctttatttacactgtgaggagaaaactgcctactcaagcctcagtcgtggtggacaccccttttcccaccaagctcaagtgtcccacgttgacttcagactgctgtgctggcagtgagaatttcaagccagtggatcttagcttgctgggctctgtgggggtgggatttgctaagcttgaccacttggctttctatcttcagccccctttccaggggagtgaacggttctgtctcgctggtgttccaggcaccactggggtatgaagaaaaactcctgcagctagctcggtgtttgcccaaacagccacccagctttgagcttgaaacccagggccctggtggtgtaggcacccgagggaatctcctggtctgcgggttgtgaagaccgtgggaaaagcatagtatctgggccggagtgcaccgttcctcacggcacagtatctcatggcttcccttggctaggggagggagttccctggcttcccttggcttccctgggctaggggagggagttccctaacgctttgtgcttcccaggtgaggcaacaccccacccttcttctgctccccatccatgggctgtacccactgtctaaccagtcccaatgaggtgagctgggtacctcagttggaaatgcagaaatcgcttgccttctgcgttgatctcgctgggagctgcagaccggagttgttcctatttggccatcttgccagccagccgagagatcactttttactgtgataggcaatttactgcagagaggaactgttcacacagagatgattagtgtcacatggtatcgtgagtagatacttgcaacacgagctcatcgcaatagcaacaggaggtgaccacaaagttattacagtactagagttaattttatgcagttatgatttaatactgtgtctttgcatttgtttgtatttctttcaactgcaaatggtactaggtaccgtctataagtgtttgtgtgggtaagtgctgataaattctaactttttataatagatttatatattttttatggtagaaatgatgagatagactggtatctacatatatttaatgcatttttgacgtacctaactttttaattttttttaagccatgcagttcatctgtgaattttttcaaattgtcacaaatctccaaaaatgttaaaaatatatttattgaaaataatccatgtataagtggacccacacagttcaaatctgtgttgttcaagtgtcacctgtatttagctattctcaaacatacctatttttattttaagaattcctttctagtttgagttggaaaactgatgcttgtagtgtaatcactgttggtgacagtgcagtcatacaatgcatgcagaatttactggttggaaagatcagtttttagttgatttttttttttttgtaaagcaaaacttcttatctcagctattaaaactgttccacacagttgcccacagcctgaaacctatcaaatgtagaaaatagggacatcacagcaaaatttggagggcatagtacaaagaaaggcgacagctggttttcccttccaaaggtcaaaatgacctcaggctggagttgcctttctgccctattcttggttttattaagtttatttgggatctcatctgccatgagcctgacttttgctcaggaaagaggcctgagaatttaaggactatctgtgagtgggcagagctgatggaactttgtctgctaatgttttcgggttttctttgaattctgttctttccaattcttcacattggcctgagtcttcttgtgattgctgtgaagataattatccaggtcctttctgatctttcttattggaaattggaaccagctctccttgactgtgactcactcgctaaatgtgtaaagaaatgagcagatctgaaacaagattttttcagctggaaagagtacaccagaactgtacacagccgtgatgagttattggcataggtacttatttaaagattttcttccactggatgctatgctaccttgtgtgaacagttgcatttgtctgtttcactacttagcatagtgtgtggtgcacagtaggcatggaataatgataataaatggattaaatggatgcatgaaggtatacaggagactttaagctatcatagacggttccaggcaggagaatatgaagatgtaatttcaagtacagttgttattgtcagttttgctttccatggtttcagctacccatagtcaatcacaatataaaaatattaaatggaacattccagaaataatacataagttttaagttgctgaataatgtgatgaaatcttaggctgtcccacttcgtctcgcctgggatgtgaattgtccttttgtcctgcttatgcacgctgtatatgttacccaccgtttagtcacttagcagccatctggattctcagattgaaaacagtgtgtatagggttctgttctatcaaatgtttcaggcatcctctggggggtcttggaatgtatcccccatggataagactacttgtataatctggtaaaatggatgaattattcataaataatgtcagaaccagctatttcaaacaagattagattctctagcctcatatcatatgcaaagataaattatatatggattaaggatttaaatgtaaaaaaagaaattataagagttccataccgaaatgcaggtttatatttagtaaaatagtcaagaaaggtttttttttttttttttaaaaagcataacatcaaagcctaaaattacaaaggaaaagagtggaaaattcatccccataaatattaaaaactagtgtgttgcaaataaattcaaaagataagggaaatactggggaaaatatctgaaacatgacagagtgtcattaatatatcatgggcttttacattttagaaaaaaatgacggatatctcagtagtgaaaagactataggaaatgaagaagtaattcacagaaaaagggtcaactccatttatcagagaaatgcaaatgaaatcaggattgcattcttcacctgtcaaattggcagatgcaacagtagctggtacttactgagccctttctgtgttagctactagtctaagagttaccaccactcatacatatgtaaaggctaatggagttgtaaatgtaacttttgaggactttattgtatgtatgcgtattagtctgttctcacactgctaataaagacatacccgagactgggtaatttataaaggaaaggaggtttaatggactcacagttccacatggctgaggagacctcacaatcatggtagagggtaaaggggtagaaagtcatgtcttacatggcagcaggcaagagagcttgtgtaggggagctcccctttataaaaccatcagacctggtgagacttattcacatgagaacagcataggaaagacccgccccgatgattcagttacctcccaccaggtccctcctacaacacgtgagaattatgggagctacaattcaagatgagatttgggtggggacacagccaaaacatatcagtatgttatggccttatataaaagttgttttgtttgtaagcagtttgccctacagtgtgtggaaagtgcatcactgttgtgctttggttgtccaactctttgcttaccctgatgcttaggtgtgagttgatggcagtttggcatttggagagcagttgcactcctaaaatgagtgaaatgttctcttcaaacttgtggcgtaccgtctttctatggctctgtgacagttacagatccgaaaattaggtgtaatggcttttgaagcaaaaatctcattctgaataaatctcccatctgttccaataacattttaattgcgcatcaaatatggtacttatttttaaaaactgcctagcaggatagtttgtgttactctgcctgtatccatgaccgtgataagaaatgtaagaaaaggccaggcatggtggctcacacctgtaatcccagcactttgggaggccaaggtgggtggatcacctgaggtcaggaatccagacaagcctggccagcatggagaaaccctgtctctattaaaaatataaaaatgagccagatgcggtggtgcatatctgtaatcccagctacttgggaggctgaggcaggagaatcgcttgaacccaggaggtggaggttggagtgagcgaagatcatgccactgcactccagcctgggtgacagagagacagactgtctcaaaaaaaaaaaaaaaaaaaaaaatgtaagaaaagaggttg

SEQ ID NO: 2609 - DNA, 499 bp, Homo sapiens
agccaggcaggtagggatctgtgactgttaccactccttcttcttctcatccatggagacacccccagggcccagggccaccaccaggagcaagcccccaatcaccgacatggtctggaagaagtcgtatttcaggaagtcatgcatgggcttgtagactggaatggtccagaaggcgttgaaatatacgttgatggcaaagagccacacaacaagagtcaaagcagccagcttggttttaaaaccaatggccactaaaatcatcagagctgtgcccacgatgttctggacaatctgcataggttgaaacgtaagaaattcaaaataaatgtgaggaaaagagatgctttataaacaaaagttccagctgctgcacgtcatgaagtctctatccatcaggctgatgtagctactgctgagacggctgctggtgcaagtagggagataaaagccaaagggaggcaggaggcaataaagcaccagctttgaaatgtggaag

SEQ ID NO: 2610 - DNA, 8056 bp, Homo sapiens
atagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagccgtcttgtttggaatgacgtctgttcagagagccaatcccagtctcgcgactcctgcttgctgggcgcggcttgggcctccaggctgcgcagcgcagccgctatcgggcggactgcagttcttgccgagcaggtggggacaggagcggggtggggctttagtgtttttccctggatcccttgtctgctcagccttcctggaaggagaatttccttgggggttattagtagcaacgctttagactggaagaaagtcaagtaggctgcatttctgatcttagctatgtgaaggcaacctttaaaaagtttgtttagaaactcccagttctcttagagggtaatataagtggtctttttagacatgtgtggcctcatttcccttttttttctttgagacaaggtctcactctcgcccaggctggagtgcaatggcgcgatctcggctcactgcaacctccacctcccagactcaagctattctcctgcctcagcctcctgagtagctgggaccacaagggtgcgccaccacgcccggctaatttttgtattttggtggagacagggtttcaccatgttgcccaggctctctcaaactcctgagctcaagccaagccatctgcctcggcctcctaaagtgctgggattacaggcatgtgccaccgcactggacttatgtggccttatttcattcgtcctgtaaactttgttgaaccctaccgtaatgtgctgggcactgaaggtacagagaaagacatatcttgtcttcaagttgtgtacagtctaatagagtagcggataaataaatgatgtacacttaataggtgttaaagaagcaagcaccgcaagttttaaggaggagtggttatgactgtggtgtttcaacctagtctagggaaggctgcaggaaggttatacctgatggaagaaattgttttgtttggggttatgagaaagtttaatacagtttttctgcttctgttaattcacctaaaaatctcccagacagataacgagtgtttcagtaaaaatataactggaagaaattcatgacaattcctttatgtgttttgtttataattcatccagctactgaaaattaccaaggagaggtaggagataagagatgcctataaaggagctgaaatctaccagggtaagacaaaacagtaaattaaaaccatataggataatcttgtaggtatacaaagtactggtgaagttcaagtataattggtgtaatttagaagtgagcaggaaagggatgaaggcaaaaaaaaaactaggaaatcaagttatagtcttcaacaaagctgatcagtttggttttggctgttaaatttgaggtgcttgtagtacttccaaaatgtgatgcccattaaatagatacatgggtctggagctcagaagagatttgaactaccaaacagatggtaattgaaaccaaggaaatccttgagaccatcagatagagtttgtggagtgaaagtagccagatgatggaaataaaggagccaagaggtgttgtagaacccaaagaatgtgatattactgagaccctggaaacaaaccttgccaggggaagggggatatatgttatgccttgtaaaatgcagtttaataaatgccctacatgttttactcatacatagagcaaagcattatagtacagtgttttacatatattttattaatgagattacatgaccctagcaattagcaagattagctttctgacatctttagtcatctagatagcaagataaaacctagcaataagactatggtgcaccaaaagctgtcaaagggtgtacctactttatttcttcaagaagtagttcttagtcgtatctgcagactcctatgaccaataatatttccgtgggaggtatttccaagacatagtcccactaaaaaaggtgggactttaagaccacaagttttataactttagtatcctgatttttaaaattgaaaatatttgctaatttttagactttgttagaagtaataaactgtgttttgcaccgtggcggtgacctggtaactctcaggtgtcactcagccagccttgcttcttggacaaggactatagtttatatttctaacatctcccccagcacctagaatagtctcttatgcagagtaggcacctcttttaaaagtaaattggattttaacaaattacacagcttattgtcagcaattgttatgcttttaacagccagaaggaacagttaacagaaaagacacaggatgtattaaaaatgaaccagttctgtctacttttgtactttttcacagtaagcattttggtgttggggaaagtatgactacaaagctcaccatcttctaagaggaggaatatattcagctcagtatatttaacgtattttaataagtttttaataatggtaaccatgactcctcggggaaagatatattattcaatgtatctttgaagaaaaaacctacaatacacttttgaaatgttttcatacaaaatggttaacatttaaaagtgtgtatatatcatgggctgggcataatggctcacacctgtaatcccagcactttgggaggctggggcgggcagatctcttgaggtcaggagttcgagactagcctggccaacatggtgaaaccccatgtctacgaaaaatacaaaaattacccaggcatggtggtgtgcgcctgtagtcccagctactcaggaggctgagacacgagagttgcttaaaccagggagacagaggttgcagggagccgagatcaagccactgcattccacactgggcaacagagcaagactgtctcaaaaaaaagaaagaaagaaaagaaaagtgtgtattatgcagttggttatatggaaaattctcctatggaataattcattctccaacagtggtgtttaaatgaagcaccactgtatttaatgacggtattttaccactgctatcatttgagtaagctaaagaactttggtaaagtaagatataaatgttgtatggaaagcagactttaaacatacctaagattaaaaagttttatagtcctatccttataacgtgaactatatgtctacatatgttcatgcttacaattttgaacacttgtttaaattttgatttctcatcaacacttttactttatagtaagttctggtaattttgttctctccttaacattccctgcaaatcctctcctgctagaaacaacagattaaaaccagactggcagttgggaaatggtttctattgcaaccatgtgtgtcagaagaaaggattaggtttccttgtccaagaacatcaaggggaacctccacctctgcagacacacctctattccttagtaatggagagtttatacctagttagatttaaatgggataagggaagagtttaaatccattcttagctcaagcagtataatcagccctcaagtctcaaagtatccaattttctttctctaatttaattctaagtgtcaggttggtattagatgctgatcaaggtaatggagagttgccctacacatttattcacttaaagaagaattttgcagactgcaaagactagatggcaattgtattcaaaacttacttaaagcacaattcattcacccctgacctttcatttatattgagtatgttttttcaaatatagaagagattccataataaaagcaaacaaacctctctcttcataattatggactatagttctctgtacatgttctctgaccatgccatcttatgctggacctattataaggacccaaattaaagtgaggcagatcctgcttttgagtgagataacctccaagagtcataaaagtatatgggaaactgtaataatgattattctttttttacctttggcttaactttagttcttcctcttattttataactaatgaaacttgtccacagatattaagtaccttgaccaaaatcacacaagtaaaagcaacaatgagaagaaccttcggctgggcgcagtggctcacacctgtaatcccagcactttggaaagccgaggtgggcggatcacctgaggtcgggagtttgagaccagcctggccaacatggtgaaaccccatctactaaaaatacaaaaatgagccaggcatggtgctaggcacctgtaatcccagctactcgggaggctgaggcaggagaatcgctcgaaactggaaggcggcagttgcagtgagccaggattgtgccactgcactccagcctgggcaacaagggcgaaactcatctcaaaaaaaaaaaaaaaaagaaatccatctccagatgaatgttctactttgacaccacagtaaagctgaagaggctaaagctagggcgggtccaaatggggaaggttccacataaagccacatccttgtgtcaggtttcaaagtcagaacaagcaaatgtcttatttttaaaggctgatactctcatctccacccctaatgtaaaaagatgttgtctttccctagtagtttttgggagagagcaaattatagcatcttactgtaaggacaataatcagaagctcatcttacctttgggaaggcttaaagggttttatagggagtcatcattgtcactttatttctggaagaaagggcaaaatccaagaagagactaagtgatgtgaatagcaaaatgggatttttctcagagcacttttttcttaagattaagggtcaaggccacactttttatattgccaggttcaacttcttgccttaaggacaattttccaccccacaacagtgaagatattttgatgagagttgagagaaggtggggaaggtgggtagagtcagagcagacacaagtgaataatatgcatgaaaactgactccattacaagtagagtccttagtgttcagaaccaggaggaatactgattacataggaatgttacaggccccaggattcctgttcatatttaatgttttctctccatactcttacaaatggccatttgaacattagagaacaggtctttaaagaaggcagagaattgctcccttgggtatggatctagaatagagaataatttgggagaattgtaagactatttcaatggtccttatccccatttttcatcatcagtcttaggacatgtatcccatagaggaaatacaactttaaaattagcaaaattcaacttttgaaagtgtattttactttgttgtctctctttgcatggtgtatcttttccacttggtatggtcctaaagacaagatccttatgctatctgtacacttactctattttaaaatcaccatcttttgctcccagctactttataacttgggggagcagggtttgccgttcaaagcttatcttttacaaaaggaactttaacaagatctccaaaaagctccctcgagtggcttttagataggctcttttctgtttgtctttgtaatcaaactacattagatcctatccaacaccctgtctatctagtatgatgctatgatcctaggtgtgactactgaaagtaaaacataatgcttagatcttgatatttataaaaacatgattaaaagatatctctgcctctaaaaatagggtcttgacctcactgtctcagtcaaattccatttcagccagtgagatttcactggacttccccagatgcattaacaactgcaatcaactatgtttttctttactttttcccttaataggtagaactgagcatgatcttggagaaaatctgcatacattactgatctctgaaccatttacccttcacgtgcctctttttccgtgtatgtgcctctttctccttgtatgtaaaatgagtgaaagaaagaggagagctagatgataccattgtaactcttgtatttcaagacactcgtttctgccttgtctcagattacaatcatttagagatacagaaataggtattacagtcagaatccacgttttagagtatatctgctgaccccatgtctgtggaagatactgagatgcaggtactgagaatgggcctcaaaatttttctgaagactgtgctccaggaagctatgctcaaccaaatgaaattggccctacttgtcatcctagcatagcaggtttcggtttatgaaagacagagaatatgcagctctctcagacacctaaatatgaagtggctttccacagatctcttttcgaaggtcgcaatgatttgtatgacagctgctagcccaagagagagttccagaagagggctacctaacaggtgctgtggcatttagaagaggaatggagccattgtcaacgcacagcttgcaggggagcaggagagtcagtctaagaaggaaatgtgatgatggaaacagaggttggaagatggaagaggacccagagtcaaggaatgcagatggagtcttgctctgctgcccaggctggagtgcagtggactgatcttggctcactgcagcgtccatcttccgggttcaagcgattctcctgcttcagcctctcaagtagctgggattacaggcgcccaccacacccggctaattttttttttttttaatactttaagttttaggttacatgtgcacaacgtgcaggtttgttacatatgtatacatgtgccatgttggtgtgctgcacccattaactcgtcatttagcattaggtatctctcctaatgctatccctcccccctccccccaccccacaaccgtccccagtgtgtgatgttccccttcctgtgtccatgtgttctcattgttcaattcccacctatgagtgagaacatgcggtgattggttttttctccttgcaatagtttgctgagaatgatggtttccagcttcattcatgtccctacaaaggacatgaactcatcattttttatggctgcatggtattccatggtgtatatgtgccacgttttcttaatccagtctatcattgttgaatatttgggttgtttccaagtctttcctattgtgaataatgccacaataaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccaggacctgttgtttcctgactttttaatgatcaccattctaactggtgtaagatggtatctcattgtggttttgatttgcatttctctgatggccagtgatgatgagcattttttcatgtgttttttggctgcataaatgtcttcttttgagaagtatctgttcatatcctttgcccgtattttgatggggttgtttgtgtttttcttgtaaatttgtttgagttcattgtagattctggatattagccctttgtcagatgagtagattgcaaaagttttctcccattctgtaggttgcctattgactctgatggtagtttcttttgctgtgcagaagctctttagtttaattagatcccatttgtcaattttggcttttgtcgccattgcttttggtgttttagacatgaagtccttgctcatgcctatgtcctgaatggtattgcctagattttcttctagggtttttatggttttaggtctaacatgtaagtctttaatccatcttgaattaatttttgtataaggtgtaagaaagggatccagtttcagctttctacatatggttagccagttttcccagcaccatttatttatttatttatttttatttatttattttttttttttttg

SEQ ID NO: 2611 - DNA, 306 bp, Homo sapiens
ggctctcagccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcc

SEQ ID NO: 2612 - DNA, 819 bp, Homo sapiens
ccctggacaaagaccactccccggtcgatgtagatcacaatgcggccaaaggtgtagagctgcttcccttcgtgtcgcttcccaatgacgggcatgaagacaatgttgtgctcctcagccttggtctcaatgaggtccttaaagttcatgggcacagagctagcggccacgccaatgcccctctgagccatgttctcagcctcccgcctctcctgcatggcctcgtactggaagtccttcctccgctccgtgtgggtgagataggcaatgttctcccgtgctcctggctgcatgtaggcaccaacgttggaggacaccgcccggttcatgatatcaagtgcctcattaaatttgtccttgacagatggatgtgccagcacttggtctgagaacatcgacttccaacccaggtaccacttggtgatctcctcataatttgggctgttactgagccaagagcacagcacctgccaaaaagaaaaattacttgcatccatcgtggcaacaaatgaaggcaagatttctgaagtggccatttgttttgttttgatcctggtcctacaggctagtgacactactttacagggatttatagtagctaaacagtctagcacttatgaatatggattttggagtcagcctggtagctaaagtgcccttgcatgtaaactctctgagcctcagcttccatgtctacacaacagggataccatatcccctaccccatagggttgctgagaggagctgagataaagcaaataaagtgcttggaacagcttctgatacatggcaaatgtccaataaatggtgcccactatg

SEQ ID NO: 2613 - DNA, 567 bp, Homo sapiens
cgagcgcgctggggagcgcagctgcaggcgttggggcggcaggagccgcggagccggcgctgagaggggctgcggccggagcgggcggctgagacaaaggcgacgatagggccagatttgagtgtgtgaatttttgagtgaaacctggaacccaaatgagaagaaatctgcaaggaataactactgacagtgaatctgcggtcatctgtatgcataatatggaatgttcttaacccagaagtagctgaatgtgttactccattgctgaggagtgatagattttaggctgtttcttcaaagtttgcagcaaattacctgtttttgctatagcagaataatgctattttgccattttaattctcgtaacaaaaaagcatcttatatcaatacaagactatctgttatagtccctgggtcaagacaacaatttttataccttcgtcgtggttcagaaaggagtctctgtagaaccagaagcaaagaaaggaaacaatccaaatttttctttattaaatcgactgtgtaagatacttgacttccaggaacaaaaacacggtgaaataataa

SEQ ID NO: 2614 - DNA, 1461 bp, Homo sapiens
ctctgcgtgcgccggaggctgccgtggcgggtgggccgcctgacttctcctcccggccagttctcgagcgcctcaccgggcctcgccctgcagcctcgctctcgctggcgctgcgcggcctaggggactgggctgctggcctccgggtgcggggtgggggcaggctccgacctggggcgtcctggccgcgcgagccgcgggatgggggcccgggccgcggaggaggcgccgctggtgtgtcccttggtggagagggcgctgccggccctgcgcggtttccagccaggaagcttcgggaagcctggacgtctgctcactggagatgacacgtgcgtggggtgttgggaggtgacttcgcctgtgatggacttccagtgtgagcactggccagagtgaccaggctgaccagcaccagccctgatccagatgcagaggccaggatgtgggcccagccctgtgccaggaggctggctggaataaaggtacagatagaggcctcaccccctctgggaccactggcactcagggtgtttgcagcctcagagcccacctgcccccagggccacagctgcatctcctgccctgctgtcattacagggatgggcaggctggcatgggggcagccgctgcccctgcctgggtgttgctgtgtattcctgccggccaggggccactgccaggaccacgcctcccttttcatatcccgattcttaagttctgctattgtggtattctggtggagaaaaaagaaccgcgtggctgtttttgaactgcctggaacctaagaccctgaattcttttcccccccaaggggaaaatctatatggaaaacatttattttaaaatacaggatgaagtgaattaaaagatttaaatgcacatttctttaaggataatatttctgtgttggcaaaatttgagagtaaattggtcttgaatggaatggattgtcttgactcacacattgcggagcagagcccgccctgaagaaaggtgttgctgtggtgggatcttcccacgagggtccttgcctgttctcctaggggatggttgctgggtgccctgggctactggggagagcgtacggggctggagaagatggccattcctgggctgtttcctagggaatgagttgtacatctcatggctggattttgtaaaatcagtttttaaaataccgcatatatctgttttcttactggaacacctttttcttggtctgttgtgcacagcccaggtttggggggtactggtcattgactgtttcagaagccgctgtgtttggggaactgccctggcggcttcagaggtgtgtgtgggttgaagggcaggcagctctgcaatagacctcaccttggactaacacctgagggctgcctcgccaggaaggattcaggggctcaaccccagcctgagtgcctgggctgggtggatccacagcggggcgaagggtcccacaca

SEQ ID NO: 2615 - DNA, 3558 bp, Homo sapiens
ggagaaacatcttgcttgaaaatatctgcgtagatgagtacagaatccaagactagaaccacagatatctaaactctctcattcactgggtttctaaaacattgctctaaggaagaggtggatgggggaaggggaaagcactaaaaaatcctgaaatagagcattaagatacataggaagtaaacagataaaaattgtaatccaggaattataatgttatagaattttagctcattttaaaattattttgataaatatacagtggaagaattaccctacctgtctgtcacctttcttgtagctgagtagtacctagagacaagtggagctaggaggaggccatgagggtgattttaagttgaaaggtgactaccttatataaactattaaaatgcatatgttgcctgatttcaatgataatatttggctgtttgagtttagggaaaaaaaatcttatgtgactgtatttttattaatatgagaaatgttcttgattatatgcacataatacatctctatacatgcagatatccttagttaacacttgaagaaaattggttttgattgaccatacattcttcagactaaagtagggtactcattttccctcctcaggtttgtccctgatagttgcttttctgtgtttagctgatgattttcctacctcccattgttgctgaactggaacagggccatgtttctcattgaaatgttatgtaaaacatctcaatgaggttgcctgcttacagctttatgagttcttcagtttacatacaccctgcactcactttaacgcttatgaaaccaaagcatttttaaaatccatagcgctaaccccttccattcaatacttactttcttggtgttattttccttgtttgtttttgtttttgttttgttttgttttcctgattctacaggtcttagaactccaagatgttccataagtgtttttacttgtgaggaatgagaagccatccatggaaatttgaactgagtgggggcagagaaagagtgcagatccctttgcttgtgaaagaattatcagtgagtgaaaggccatcaccccaggaagccaaatgagggagcagcaacatgtatatgagcttcctatggaattgtccttatgtgaagctttgaaggtgtacagccactctcccgggtcttcaggttcctaccatttccatttctgttaaagtggatctgcatatcttcagcttactaggtgacccggatgctgacatctgctgctgcagaaaggaagacttttcattgtaatttcgcttagacccttttatcagtggagctccagttttcttacctagctgtcacttttttaaatgcctctgggggttatttttgctttccttggcccccaccaatttatacatctccattttctgacctctggactaactggttgctcagcaaggttctgaaggagagtttcttgcattggacaggcccagtcttctcccatcattgccctgctgtgactccaaagaaaggagcttcttgctgacagtgccctgtggagcaaggctgtgtttcctaccccacacggtgctcagtgggtgccagccctcagtgtggctttgtgattgctgccctaaaggagaatgctctttccttcctcactggtactgcctgctgttttctaagcattgctcctgcacagacatggagtcccagccccagcaaggctcttctgttcccatctgttgacaatgtcttgtggagcatttttgctgaggaaaaggtcacttgtaaacagaggagaaagggaaagagtacaaagccctaagtttattgtaagtgaaaactgagggaattcctgtcttctttaggagtaatgattcatagatctagataggtggaaatatcattcaaaatagtcacttgagctcacaaaaaaagcaaggaagaattctcatgtcctttgtcttccttctgtagccattaactgctgaatccatgtgaggaagacaggcttcccttccttccccctccttagtgattttttctttaacagcataagtaaagaggactttctggttcatttttgtttgttttgttttgttttgttttgtttacagatgaggtcttcctgtgttgcccaggctggagtgcggtggctattcacagatgctatcatagcacactacagcctacaactcttgggctcaagcatcacgcctagcagtttctggttcctttaacagcaaaaggaaagagaggttctgattcttacctcagggttttttggttgttcattgtttttgtttttgtttttgttttgacactgcagagcacaaggctaaaggttacagctgagatctttggaaccaaaggcagagcaagcagagcccgttgtctgggccccacaccactgcaggcaggtggatagaagtgcggcccctctcatagtatgcccataagtcagggcatagggcagaactacctgtcatgttgctacaccatcctgtcttctcagcatctccttgcctgttttctttattagtccaaaggaaaacaacagcaacaaaatctgtttttaaaatgtcttatatgaacatatatcaaatatccatgcgctgaaacccacataccatcacttggcaattttttagaataagaccccattattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaactgtcagtatctatagaccaggtctgtgccacctcctctctcctctgtgctcagtgaggaggcagtaaatgaagttacaggctagcacaatacctaactcatgtttcccagtacacctgtagatattactgtacttttatgttctcaagaaataagttgttgcctattcagtgttacagatttctttgtttctttttaattaaaatacaagaagcagctgaggaaagggagacaaggtattttatttctgactgattttagaaaaaacttgtgtacatgtgtttggaactgttgaaatgccaagttttctgtataagtgtttttgtaattaaactttcagattttctttgttttttaagaagttgatgtgcttgtttgacatttgtctcattaaaacttttctacgttgaattca

SEQ ID NO: 2616 - DNA, 2882 bp, Homo sapiens
aaagttagtctaactattagactgtcagactctgaagtgtttcttattttggaaaggtgaagacttgctttagtttgttcatagtttccttggcagctgctgatggttttgatggagattcagatggatttggaactaatgctaacttctgcttggtgaagatgctaaccaagttagatactcttcagtgaattctggtactgtgtacgattaatcctcatccacagtattacgctgtgcaaggctatatatacacaggattaatctttccatgatttccactgccctgaaggaaattagaatgtagtctggctccaagaaaacactagaaactacttcagctggtgatggaaaatagtggaattctatacatcctttgagacaatggaagcagcaaaccagcgttctttggattggggaatatttttggtactaactgaaaaacatcattttaagcctggccctgcttagaggagacttgttttctcttccctctctccctctcttccttttttccctccttcctctttttctttcctcctttccttcttgtctccctcccttctccttccttccttcttcctctttttctttcctccttccctccctccctcccttccttccttttttcctttctcccctccttccttcctttttttcttccttccttcctccctccctcccttcttttcttcctttcttcctttgccctaaaacttgggggaccctgcctgctcattttgtttagaatagaagattactacttttctctgaattgtcatttatttttagagaggtaagaaaaaagggaatagctgccttccatatatacttatgacatggagattatctactcatttaactttgcactgctattggctgtttatttggcttttgaaaaatcaggtgctatttattcattgggcttgtggggaactctagtagccctgaatggcatttgtggcatactcaatgaagtctaattctttatcctggcattaaaggcttaccaagatctggcctcaatcttgcaaatgagcactctcttatatacctgaaggaaaagtgctaatttagccaactaatagagataggtataaataccaatatagacatagatatgaaactttagttgcaaagaaatgtttaatatgcttcaaagtgcatatttccctcttccatgctttattgtctattcttatcagcagaaatgttttcctatttttccttacctgtgatgtacctatccatcctttacagttgagttcagatgctacttctgtcatgaacccattatttatcctccctgtgagaattcatttttccctgtttttggatcttacagcctttgatttgagcccccatttcagtctgctttatactactgtcttgcatgttttcccatgataaataagatggtttttgggaaactgaactttggacttacttgattctcttataacaccaggaaattggccaattctagttgagttatggaaatatgttgtctgctgcataccaggcaagttcaagaataccagcaactcctgctacttagggtaatggtacaagtaggattaagtggatatagttgctatctatctgtagaagacaatgagtgagtgctgtcttaagtttggaaagtagttgattctctgcagaggggtataaactactgatgaaaggagagtgactcattactcctagagattctgaatgggaagaatgccagctttatgttttctgatactgattttttttttaataacttggtgcaaaagtagaacattattctaagatgactgttgtggaagaaaaaaaaggtagaacattagagttgtaaaaatgtttttaactataaagaggaaaaaactgaacttatttataattcatttacctagagagaacattcaacattttggtcaatgtattttttttctttatatctatgtagatatatatttcttcatttatttaacaaattgctactgacaccctatggtttgctggaagtgagctgtgtaggaataaccatgagcctctgctctgatgtaatttttagtgtatgttgtatttgttgacatataattttatattttgcttttttcacttaatgtatcatggaattttttcatatcattaaatattctctttgtgtggcacaatagtatttcagcatgtagatattttgtaatttattgaatgaatcctttttgttgcatattttcaattttgtctgtaattatatagcaatgcagggaatagtcccgtgtagcaggtggaattctaagatgaactccagtgacacttaccttgtataattccctctccctgtgaacatgatgggatattacttccatgattatgttatgttacttgcaagggaattttggagatataattaaggttgctaatcaattgactctgaattaatcaaaagggcaatattctaggtagacctaacctaatcaagtgagcactttaagaacagagagttttctcctgcttgtggcagtagaggaagtcagagagattcaaagtgtgaaagagactctacaggaggaatgttctccattgctgaaatgacaatttcccacagacaaggacctgagggaagcctctagaagctgagagtagtccctgccaacagccaaccaaaaaaactagggaccatagtcctacaacagcaaggaactgaattctgcaaacaatctgattgcgcctggaagcaaattcttccccagagcctccagataagagcccagcttctgaccaacatcttgatttctaccttgtgagaccctaaacagaggacccagttgagcccacctggacttaagatctacagaactgtgagataataaatgggtgttgttttaagg

SEQ ID NO: 2617 - DNA, 1712 bp, Homo sapiens
agagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgt

SEQ ID NO: 2618 - DNA, 4475 bp, Homo sapiens
cactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattccattgacttcatttctaaaattggactttgagcagccaatttctaaggattaaaaagaaactttaatgcattgtagacctctgtacacagaaaaatctttgtaacttttgggcttaattttcattcttaaaaaatctggtaactttttcaaatgcaaccactgtcagtttgctgtgaggctaggcaaacaacacaaggtatagaatttcccatcaccaccaccctgaccccgcgagaagattgccttttaattagagacttgtagaactagtgccttttaagttctacactcatcttttccaaagactattagtaaacttgccatgtaatttgacatggcagttccttgctcagctactctaaataaagttggaaattaggtggtctcttagtttgggtaaagtcagtactattgccagtaatatacatggtaattgaaagcccttaaagtggttcagattatttgccaaatattagactctataaaaatttctgaggttttttttcttttacctttgagtgtacatgtgattgctataatgtaaataccagtcccttaaagactgtttctataagcagaatgatgcagcacaaagtggaaaggttttcctcttattccagcagtattcttgccttcaaagagtagtccatcttgccttgatttttaaggttgttttcttggatggaaagcttaactggatagtaatttccatatgttctttataaccactctgtatattataagcaaagttttttcatattgtatctttttctgttgagcactttatgcattttagtctattgcatttgagaatgtagtttagaaattcactgtttaaagccatgtgaaaactgatagaggataatgaaaatgagtgtacattattttgaatttaacttaactgttttgtggtgggtgtgaacaaaacattagaaatatattatctttttgtgataatactctctgacctcacttaaagtgatctgccatgaggtatccatgatcaagtttatgtttattctaatacctaaggaattcagccaactttgtttctatcatcagataatctcagaaaatagtgtgttttatctatattactgcctcttttcaatatttaagagaataattgtcttctggtttctactgagcctagtaataatcactaaagacctaaaaaaggaattccttctgttaagagtatttggatagcccattcacgataatggtggtgtgaaaatcaatcatcccagcttttctgacatatctaaattttgaataattaatttccacttccaaaaaattcaaatgttttctcaaagcagtcactacttatttgcattattcctgcatattcagtgaatgtgaggtcatatttggtattgtattagaagtagtgttggtcactggtcttgcctctttgaacattatttttatttgtaaaatgagggagttggtttgttatgatgggaaatgagtcagttttcagggtcctgagaaaattgcttcattcatggctgtgtttgagataactaaagtaaattttttttcaggtatttggtgtcatgttttggagttaatatttagtgcttatataattttaagttattacataatttttattggtatatatttgataggtactaggtattggattctcaccaaaccagtagaatggtattctctcttaatatgtgattgcctgtaatggccaggtagatataccttaaagtaatatgaaaggttttatatgtatattaaaatgtttgtacttttaaatctgtaaaggttatctggaatttttactgtgttaacttcagaattatatgggcattatgactttttcattgtacaaaaaattattcataaatgttagaatacagatgttccttgacttacaatagggttatgttccagtagacccattgtaaattgaaaataccgtaagttgaaaatacatttaatacgcctaacctactgaacatcccagcttagcctagcctatcttaaatgtgttctgaacacttaacgttggcctttagctgggcaaaatcatctaatacaaaacctattttataatgaagtgtttaatatctcaaataagagtattgtaccacatatcgttatcccaggataatatcagagtacaaaatttgaagtacagtttttaactgaatgtgtattgcttttgccccattataaagttgaaaaaccataagtcaaaccattgttaagtcggactgtttgtgttacatatatttgggattttttagtggccctttttaaaaagctgtttcttatttctgatcattgtgagtggggatagatgtgggaagaaccatgtctctactaaaaatacaaaaaatagccaggcttgttggcacacacctatagtcccagctactcgggagaccgaggcaggagaatcacttgaaccgggaggcagagggcagatcatgccactgtattccagcctgggcaacagagtaagactctgtctcaaaaatgaatgaatgaatgaatgaacgaatgaatgtactatgagctgatactgggatttcaggtaccgcagtttgtgctgaatgatatgtttggggtaaatcagtttttttcttatagaatttcggcgtttttgctgcaactgccactaattttgcatttaaaagaacaaaagaggaatgtatttttcaaaggagtgaatgaggttaaaatcaagattttgaatggtataaatatgcaactaattcagttgtaggatattattaaattttttattgctaaatatgtttctttcatacgttgcagtgcttacagttccaacagctttccaagaaaacatttccatatttgtgttatttgtaaagtatacataaataatgtaaaataatttgggattatttcaactttacattgtatgtctgaatttcatcgatgttgtacctggctcagtcaatagttgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggtttttattattttttatacactgtgtgcttttactttttatttaaactacagcaaaaaactgattttttaactaaaattgaatggcgtttatcttaatgaccagttattgaccaaagtgtactcagaagatgttattatgtcccaatctaaggaatcctttaatttggggattaattttacttacacatgccatttcagtttcagttgcctcattctattacatcattcttgtcaagtctaagctttatcatgtctgaattcttttaacactgaatctgtgatgtaaaaatgtatgatgtgccataaattttattcataataaactaagttatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggataaccattaagccaacttcagtttctctgcctttttttctgtagtttaaccatttctaattttgttcatattctaaatagatgttagaatcatactttttattttctactttctaaataaattatctaagttgtttacta

SEQ ID NO: 2619 - DNA, 1073 bp, Homo sapiens
caggagttcgagaccaggctggccaacatggtgaaaccccatctctactaaaaatacaaaaattagctgggtgtggtggcgcgcacctgtagtcccagctactcaggaggctgaggtagaagaatagctggaacccaggaggcagagattgcagtcagccgagattgcaccactgcactccagcctgggagacagagcaagactgactcaaaagaaaaaaaatgacagaagcctgattatcagactgcccggaggagacaggctccagcagatagatgccagccaggcccagctgccacgatttgtcccaggtgaccaaaggcacgcagctccagcatgaatcgttctaacccaacagtgacaagaactgctgggccttaaccgtcatggaagactggggccgcttccaagtcacagacaggagacggggacaggaaagaactcattccacccaatcggacacctaataattgagtgtctacagcagcaatcaagtgacaagtgaggccctacctgacccagaaggtgcctgccggctaaacattctgcccccaccagaaactccagggggtccgcccgttatgccgtggcccacccacgcccctttggatcaccagcagtcacagacaacaggcaggcgaaactgaagaccccaactcagccccagcggaccctccagagcaaaagaggcccccggcgaggccacctgtcggcaggcatgccgaggtcaaacagccggggccaccgttcccagctgggccacgacctgcaccgtccacagatgggctttgagatggatttgtatcagggtggggggtgtggtttggccaaaatgcaatggaccccgacccctcctcgtaaaaggatgttgggtttccctctggtgacacatgggatgcgtcataaaccctcccccaaagtcctggtcagcagcccatccttccaacgatgagttttgcggtttttcagaacagaaatgatcactacgattgacgacggtcgtgatgttaagacgtcgtctccatgagctttggggggacttttatgtggaataaagaaactatcactgagaa

SEQ ID NO: 2620 - DNA, 5146 bp, Homo sapiens
gagaaggtcctgggcgcctgtggagtgacctcgtccagaccgccgcagacccgatcggcaagttcttggaggtgcaggaaggttctccaaggagtaggaccagaaagggatgagagcgcgagcgcggttaatgtcgaggctgctaagtgatgctcgttaatttcgcagcagggtgtgactggcccagccttgactctcagtttcctctctcagtaaatgggcataataataccggtccagcctacgctggagaattgtgaggtgaaaatgaaataaggtatgcaaaggtactttgtaagtataaagcccatttgacttggtggctcaagcctgtaatcccagcactttgggaggccgaggtgggcggatcgcttgagctcaggagttcgacaccagcctgggtaacatagtgaaaccccgtctctacaaaaaagacaaaaactaaatgggcatgttggcgcgcgcctgtagtcacaaatgctcggggggctgaggtgggaggatcgcttgaacctggggagttcaagattgcagtgaaccgtgatcgcgccgctgcactccagcctctgcagtgagagcaagacactgtctcaaaaaaatgtatttatctatctacatagataagagtcctagaaatccgggtgcaggtctgactgtagctggtgtaggaaagtcagttatccccgacgctggagcaagctaggggaccgcccttgcagttgttggaggagacaaattgggaaggacttaattccgggcaaaggaagcttcatgagtaaaagtagaaagtgaaaatggtcaggaaaagcaaggcttggggcagggagacccatttttaggccattgcagtactccagacaagtgataagaacattaaacaaggcattggcagtgggaatagaggaggggatagatgttagcgccattaaggtggtagaattcacagcactgagtgcggataaatgagtaggccaggtttctagcatgagtgctgaggtagacagtggtaacatttagcaagatggcaagctacatgagtcttgattatccacaagtgtctaagttactattatagatagtgatggtgacatttcttaggaggatgaccagatatgtggagtatgatgatgagttcaaatatggatatgtttgttagggaaacatttactctccattcacaatgtctttcttccatatggaatgatatccattagtgtaatactctcctggtttctcttatacctgtctgcaactcactcttgcctagaggagtgacttcctgattggtgaacttaaatgggagaaactggacatgtggcatctatcccattctttttctcttaaaagataactatcttcagggaactgtcctggtgttcttttccgtttcttctggagcagggcctgtgggtagggacaagggtgcctagtccagggctacaaagagagtatatgtatttaattccagagtttggcattaggaagctgtctgtccacagataatatttaataccagctttgtcagctgtgttacacagaataatgatcccccccaaccaaaaaaaaaaggatgaccacaccctaatactcagaacccatgaatatgttatattatgtggcaaaagggactttgcagatatgattaaatgatgtatctagggagattatcctggattgtctgactgggctggaggcaggagggtcagagtcagagaaggagatgtgatgatggaagcagaggtcagacagagatttgaagatgctatactgttggctttgaagatggacccaagaaacgcaagcaaattgtagatgcgggagaaggcaaggaaatggattcttctctagcaccctaagaacacagccctgccaacaccttgattttaggacttctgacttctagaactgcgagataagaaacttgtatgttttaaggtaccaagtttgtgctaacttgttacaacagcaataggaaactgatacagtcagtaataaagataatagttggtttcctgcagctttctccattacctggaaaagaagggtacaattcagtaggtcccctcagagactatagcaatatgactgtgacctgatggaacctccacatctagagaaaaatgtccaataaacactcaaactgtacaggtctatgaatgaggaaagaggttgagttaaaatagatttggaagaaataaattaataattggtaatttaagcccgaggcatggatgagatcaatcagggagaaaatacagaagacataataaggagaggcaaggatagggcccctggagagcactaactttaaaaggaggtgcagatgatcagaagcccaaaaagaagtctgaggaagaatggccagagagagaaaaggagaactaggtgagcctaatgcctctgaagccaagcaagcaagatggagaggggtcaacagagtcagagaccacaaaaaggccaagtatatcaagaactggaaagcattcactggatttagcaacagaaaagtgattggtaaccaacaatagcaaacttcagtgggatagtggagatagataccaaatcactgagatctgaaaggcagatcaatatagtggattggcctctagactagtttgatgggagttttgagattctagtcttgattctggccattaactagctagataactttgaacaaatccctcaactactccaggctttggttttcgcatctggcaaaggatgagatcaagctgagtctatgattttctcattaattcctagataatccccccagttttatttttttattttttgtcatatctgattcaatacttttatttatttttattttttatttttgagacagcatcttgctctgttgcccagtgtggagtgcagtggtacaatcttggctcactgcagcctcaacccccgggctcaatcaccccaatttcatatcagactcacttgcttataacagcacacttcaaatccttctcagaccattttccaaccactaagaatcagtatatttcatgccagcttctgtcctagatactatggctataacacagttttcaaggaactcacaatttggagagagagagagaaatactaagtatgtaactagctgtcatagttctttaaaaaaaaaaaaagaaaaaaaagtaaggccaggcgcggtggcttatgcctgtaatcctagcactttgggaggccgaggcgggtagatcacctgaggtcaagagtttgagatcagcctgaccaatatgatgaaaacccgtctctactgaaaatacaaaaattagccgggcatggtggcatatgccatcatcccagctactcaggaggctgagacaggagaatcacttgaatccgggaggcagaggttgtgtagagccaagatctcgccattggactccagcctgggcaacaagagcaaaactctgtctcaaaaaaaaaattaaaataagtaaataaataaaaataaaaaataataagatagacctgattgtggtggctcatgccccgtaatcccagtgctttggaaggccaaaatgggaagatcacctgaggccaggagtttgagaccagcctgggcaatatagccagacacccatctctacaaaaattttctaaaaattagccaggtgtggtggtgcgcacctgcagttctaactacttgggaggctgaggcaagaggattgggtgagcccaggagtttgaggttacagtgagctattaccagattacagtgagctatgactgtgccagtgcacttcagcctgggcaacagagcaagaccctaaaagctagatataaatatattgtaagtataatacaatatactataacagaatctgtatgaagtgaaatgagggatatataaagtgatacagataagggcgcagttagctctatctaatggaagtcaagagtgttgtacttacctacactgttaagtaaacacagtatgcctcaaaaatggacacaaatatattaaggcatttccatggaggtaaaaaaagaacaggagaattgtgctaaaccagcgttgtcacctaacattccttctaggtagttttgttgtgatctaaatgaatatttatatataactgtttctaaactaaaattggttagttgttaaaatggacacaaataaaagttaaatgcaagaataatttatatttttccagtagattcaagaggaaatattttttgtcactaatgccatgctttaatacatttgcttgtctaatcctcatgtattatcttacttaattttgtaaacattagcttattgtatagatcactgacaaagtatctgttttagcagatagggacaaagtttaaataatttggccaaggtcatagtagaccaagatttggacccagcacaagcatcctctttccaggaaaccttccctcaggcccttagttggtttaagtgccctctctctgtactattagcatatgcacacacattcattttagcgttgactttaataataaggatgtttaccatgtaccagatacatagtacttgcacctatgttatctatgtttaagtgttttgtaggcattagttcatttaagcctcataactgccctttgaagtaggtgatattattcacaatattttataaaacaggaagccaaggcatagaaagttaagtaattactcaaggtacaattaataagtgataaagctaggattcgaatccatgcttttaaccccccaggcttcatactatgtaccctttcccttatactgaggaattctagaaggcatagttgacaggttgttgtgtgtgatatcactctgtgttcctcatatgaacacaagagaattttctctctgagccacaagtcatgaaatatttggctacccttgagtaactgatgtgttttctctttataggcaatgtgaattatataactgcctgtttttcacttttcactttgccaagaagctctgagtaaatttgttggctcagcgtttgtaagtgggtgaattggcctgcatatctgtattctgttgctttgaaatttttaaaaataaatagttgagagaaaaataatgtaaattttctttattttccaaattgttgacaatgtacaatgataatttttataattagaaaaataaactttgttctta

SEQ ID NO: 2621 - DNA, 1833 bp, Homo sapiens
ttaaaaattagccaggtggtggcacctgcctgtagtcctagctactcaggaggctgaggtgagaggattgcttgaacccaggagactggggctgcaggaagctatgatcacaccacggcactcagcctgggtgacagactgagaccttgtctcaataataataataataataataaaacaaatgaaggggttggtctagatcaaagattggcacacgacagcctgcaggccaaatcaagccaccatctgtttttgtaaataaagttttattgaaacacagtcatattcatttttgtattatctatggctgcttccacactataacagctgagttggagaatggcaacgaagaccatttggcccacatagcctagactgtttactattttgcccttttcagaagaaaattgtctgtccattgttgcgggaagtcacagaccctgaatggagagaccggctgaagccgcggcagaagaacataaattgtgaagatttaatggacatttatcagttcccaaaattaatacttttataatttcttacgcctgtttttactgcagtctcggaacataaagtgtgaagatttcatggacatttatcacttccccaatcaatacccttgtgatttcctatgcttgtctttactttaatctcttaatcctgtcatcttcataagctgaggatgcatgtcacttcaggaccctgtgatgactgcgttaactgtacaaattgtttgtaaagcatatgtgtttgaacaatatgaaatcagtgcaccctgaaaaagaacagaataacagcaattttcagggaacaagggagataaccataaggtctgactgcctgcggggttgggcagaatagagccatatttttcttctcacagaaagcctatagatggatgtgcaagtaggagaaatatcgctgaattcttttcccaacaaggaatattaataattgatagccctggggaaggaatgcattcctgggggaggtctatgaatggccgctctgggaatgtctgtcttatgcggtagagataaggactgaaatatgccctggtctcctgcagtgccctcaggcttgctaggactgggaaattccagcctggtgaattctagtcagaccagttgtctgctctcgaactctgtttcctgttaagatgtttatcaagacaatgcatgcacagcgggacacagactctcatcagtaattctaattttgcccttgccttgtgatcttttattgccctttgaagcatgtgatccttgtgacctactccctgttcgtacatcccctccccttttaaaatccctaataaaaacttgctggttttgtggcttggggttgccatcacagtcctaccaatatgcgatgacacccccggaggcccagctgtaaaatttctctctttgtactctttctctttatttctcagactggccgacacttagggaaaatataaagaaccgaaattgaaatattgggggctggttcccccaataatccatggtctagatcagtgatttcaaactgttctacagagacctaaggctctgtgcaggtacctcagggaaaagggaggaactgagagtggggctccaacccctggcatcttcctaccaagactacacctcttatttgttgaaattaactagttgaggccagtcacggtggctcatgcctgtaatcccagcactttgggaggccgcggcggtggatcacctgaggtcaagaattcaagaccagcctggccaacatggtgaaaccctgtctctactaaaaatacaaaaattagccgggcatggtggcatgtgcctataatcccagctactc

SEQ ID NO: 2622 - DNA, 1818 bp, Homo sapiens
gtgctctcgggttgtgtctgtgaccgtgactgcgtacctgtgactgtgcagcgcccgtggtgatctggggtagggggcacccctacagtgggacccctcccccattattctttctgtccagcccctccctcccactggagcagctccagagccattcctcacccccgtgacctctcccagccagggctgagaggattcgaggtggctgggagggtttccaggccccctgccccttccccacaaactgggtgatagggcggacttacctggcccagccctgcctccctcagccaacccagcccttgggctgtctgtgtcagtggtttccggtctttttttttttttttttttctggctaaaatagtttgcaaaggaccaggtaattggggaggggagagaggtgggggcaagggggaaatgcccccccatctccttggaggcagtggtgtgaatcttcttcaacagcaattaaagaggaagtgattttgtctagggggtgagctgctggtctgttcttggaggcaggtcagggcatggccttggtcaagatggggtactggggttggacagggacaggcagaggtgcctcccactggggctggtggcaggacagtacccatgggcatggaggtggttccatcatgtacaacagttctgggttcatgtagtggaggacgtgggcaggttggagtcagtggggaccctgggaacagagaaggcactgactcttaagatgatgccagtcctgggagagttgggatatggtacttagaggagaggacaggcccatggagaggggtgggaagatgggacagctttgtttaagagcaggaactttggagacagatctgattttgaaacctgcccctccactgcacagctaggggaccttggtggcatctgtttatctgtattctgaacagtatctgttcagagggcacctgaaaggcgctccagctctgaggagggctgccccgagccagcctgctcaccgtgagcactaggtaccagagtagaacatagagtaggggttcctcccctggcctcgtcagggggtgttccagagggaaggggtgggagacctcctgggaaagatttcccagctagctgcagaggtccctggtgtccacaaactcagtgtcagctgatgcaggcatttatccacctccgtgccatcaaagggaccaccaaggccacagcggcctgaagccggtgctgcctccatgagctgcagtgccactaggctcagcacatagccaatcctaccatttctcgagggcagctgaaagtgtttactcaggtagaggggctggacagggtagggttgggtcagcagccagtgcaggttgggcacagccatatgttgttatctaccttgaggagttagttggtagcaccagcatctttgggtagaattgcttctgacccttggtgcccaccagccccaagaggttcagctgcaagtgtgccactgaactgaggacacagcaccagacctgaatccagttcacatggaggctgcggctctacagggtcctaggctgtgaccacccagcacagcggcgtgacccaggaaaggtggattcaacagtgcaggtgcagtgacaagtacagaggcagctccactccttcctcgtggccaaagtttgctcccttcttcagaagtttgggagtgtgagagaatatgggaaggaaataaggaccctggagagaatgaaattgccttcaaagagcaagtgggaagttcctttcatttccagccagtgaaaaatggtcaaggtgtcagcaaacctcacaacaaatcccaacaccaagtaa

SEQ ID NO: 2623 - DNA, 2194 bp, Homo sapiens
cctcactgaagtgaatatgaataataatacaagtaattattatcgtattggattttggaaagttggatggtgatattcctttggcatgcgagactattaatatgactcgtgctggaaaaagtcactcatgttttctctgggcttggattcctcattccttcattcaatgaacatttgctccgcagttacttgtgcgaggcactctcaccggagactgaaggtatagagcaagcttgtccaacccgtggctcactaaccgcgtgcggcccaggacagctttgaatgccgcccaacacaaatttgtaaatgttcttaaaacattatgagaggttttttttttgcgctttttttttttttctcatcagctatcattagagttagtgtattttatgtgtggcccaagacagttctcccagtgtggctcagggaagccaaaagatcggacgcatggtatagagaaaaacaagaagcatccctccatagcgtatgccccacaagagacaatttcccagagaccagtagctgaggcaggtgtaggaagtgaatgggccattagatggatgcctgtggaagctaaagaaggcggatcggaggaagacaatccgacctggggagtggaggagagagggggagaaggtggcatcgacttggattttttaagattgagtcatttggggcacttggaaatgggcattctgggtagaaggttcagtattaacaaaaacaaaacaatactcttgagtgggaagaataatggatagtttgatttgcctagaatgtagagattaataaggatgccaggattctagggcgggggaccaagatggggagtcagtggtgggaagccctggaagattccaagcaaggcatgacagtgctgtggcagcggatagttaatttggccaaggagtggaaccctcctttgtagcgtgagagtgttggaccaaggatctttgcagcactgagagtctatgaattagccaatctgggaatacagggcttcatggaaacatcacagtgtaggaggattatggatggaaagtgcagctggaatgggaaaaggtcgaaacctaattagaagccttgggccaggggtagcctgtgatcacctgcgattgtgtttcagacttccagtaacattcttgggagtagttgttaaaaaagtgctcttcgtgtttctgtaacttgggtggcctcttaggcatgagcagacgttcagcctgtccctatcggcagggaacatttatttattttgatgcatccccagggaccaacagagagctataaagacagcagcctgttttgccagttggccagttgaaatgggaaatttcttatacaaagattacagacttaaccttcatgccactctttattataaactgttcatacagttctttgcagatggactcaaaatgaagcatttttttaccttaaagattgtagtagaggatgttataaatgtgtctttaattggttctgtgttttctcatacttatgaagcactgcattacacaatttgtctgaatgaaattggtagatgtggtccatgtaaaacttacccaatcagacaggttacagatatttgcctaaaatctgagcctgggcaccttagagatattctaacctcacccggaaactccgcaactggaaaggtgcagggattctggagcgaggttccacttcacattatcttctggttctgcatatgaatatttaaaaacttcctgtggtgttatatgaaatatgtatttgcatgcttttgcagctgctccatctaatagtatttgagaaggggaaaaaatgaaatgttgcttagtagaaattcctttggttaatgatgttaatcaatggtataaaaaaggagcatgaactctggaataagaagggacacctgaaattgaattccagttgtgtcgcttactacctgtgcgactttaggtctggcacttaactcatctgagtctcagtttcctcatctgtaaaatggtcaccacaataatcagctcgcagtctaacagaacaacctgtcaccactagaatcccacttgttggccttttatagccacacctacttccctcccactgcctcctccacttccttaactcatagcaaccactgtgtgttcactatctttttaaataattgtatcatttcaagaatgttataaaaatggaatgatatagtgtgtga

SEQ ID NO: 2624 - DNA, 581 bp, Homo sapiens
cttaatcctacctggccatcatacagtattaccactctccatacactttcttaggtgacttttgtatcttattctcttactacatacttccaacaactgttgttgagccgtaactctttggtgattactttgcgttttatttcttcctcactgagaaaatggaaccaatcagaagataacttataaaggcttccaccaatatataccttatgcccatgtgcctacatctctgtccgtttaccgtatatgttttcttctgtaactgagggtgaatgctctggtatctgtactgagaccagattctacacttgcacattagatcctactcacttgcttattcaaggatattgcttagtaattctttctctgctacattatcaattttttgcctctttactagctcagtcccccatcttaaaaaaactacttttctcctaatttccctccagctacatccctattttcttttccttcaccacaaattcctttccagagatgtctcaatttactgtctttgatttctttcctcctttctctcatgaaccctttccaggtaggtttttgactagctcatgccaaag

SEQ ID NO: 2625 - DNA, 977 bp, Homo sapiens
caagaagcccaatcaaatgcacacaagtaatctagaagacatgattacctctaaaatatgtgcatatatcacagagatgttagtgcagattaatatattaaagagactgttaaacaactgaggctgaagttttaaaagagccctccccccaaatcttcacgaaacataacctaagaaaagcccaaatgttactaggaatgtaagacttaaaattataaactcctaaaaaatagaagtgcatggtggaaacactgataggtcttttactatatgaacacaaacttctttgttaaaaatggatacctgaacaaacccatttaggcaaatagattaatctttaacaccctcattacaaagttcacacctctgaatttaaccgtcatgaaagagaatgatccaactgctatttatgttcaagtcctgtatttttggccatgtaactgaaaactccttattcattctttaacacacagtgcaatagtgaaatgactctgccactgtgtgttttttaaaaaaagatcagagtaagcatgttcctagtaaaccacaaagtaggatattgaggaagcaaatctagattaaaaggcaggaaaaaaaggcagaagtttaaatttcactaatttttcaatttattagcataccaggaccctttaaaccttgttcccattagcgcctggtattagatgtgaaggatcaaacctacggatctatctcctgactgcttttataaggcgtgtaaaagtcggttttcaactgcacacaggcctcctaaaatgccttgtttctctagtccctcctgctttaagcagcatgagcagtaaagcaggggttggaccaaataaaaagacaagagctaactgaattgtatgggagcagcatttaacatattcctagtcaaggacaggatgggaagtaagtgaagaatagggctcctggaacagacgagccccccgctcccccgtctcttcaaaatggat

SEQ ID NO: 2626 - DNA, 3748 bp, Homo sapiens
aagcatcagttcctttctcagaacttgacttgctcatgcactagagaatttgtggtccacatgcttctaggtgttactcgattcactaatactgaaacagctcagcttgtgaaagataaattgttcttcagacagagtgcttagaattagatttgtgatcagtgttttccttttgtgtgaaatactttagagtactgctataattgttattcaaattagaaggttatatacataaaactaaagattttcttgtactagtgcttattcttcataaacacagtgtaaagaaatctacttttttggtggtttgttttagactcccaactctgcctagtggcagaaaaacctcttaatagtgtgggtcatcataaaatctgccaactttaatccaaataagtatcaagagtcttcattcaatattctttcaaacttgtttgtctcgaacaaattagagttttagcacttattgttcaatgtactatagtaattgtatttaatagtaagaaaatatataagcaatgattttttaaaagggagttctcaagagttttggatttctttctgccgtgtatagaggtttcttatgcatggacatttgtgctgttttatatctttttcaattaaaaaaaaatttaaaggcatcaggctccctaagttcatttgtaaatagtggcttggaactctacacaatagggaagctcctaaaggctcatttagaccataatctagttaatagtatcatgctgaactctcagttttctttaggaaaccaatcaatcagtgtaggagggagaaagaagcagaggtcttgtctttttcctgatgtgattaggaggttaagttctttggtgtgggtttctttgcatttgcccccttaccatgctaaactctggtgaaatgtataagcagccttggcttttcctctcctgggtgctctgtgcttcaacattttatatctttcctcccatcagaaatcctgtgtctttgtgtggcagtagtagttggctagactttaagagaaaagcattttctactaaggtatgaatgaagatagtgggaaaagtgtcattaaatttcttttttaaaaaagtatgtttattaagaatgaatctttaatatctaacatttcagacaatatgaccgcatttcagataccatgggaagcagtacatttagtgaattagctggtactgtctgagggtacttccagtttcctttaggctgttgtgacttttcacagcttcctctcctctaattctgaacttagagattttcttctcatttctaatttttagtagcttattgttccatccagtagagcattataaaagtcacatctgcatcttccaacttatggtacagtgatgggaatttggaagcacccctggagcaaagaggctagggatagcattaacatctcccaagacaagtggtataggggaaatgaaggaaagactgtggccatgtatatgccaggcgttaatacatcagagctgcctgtatttaatttaaaacttttgatgaaactcagtggataagcatctttgtcatattttgtcaataatacattacttgcaattatattaaaacttattctaaatacctgtacctttcttgttctgtagatgtgtagatgatgttgcttgtttgtcaaaatattatcttttataaaagaaagtcctgcttcttatcatgatgtatgtgacttaaatgattgtttcatattaaaactatttcttccttatgtactgtttacatatacctctttttgggatattagttcagtacttttatacaaatctgagtgtgttccacattggtgacatgtatttttgcagtaactttttgttttgttcttagaacatgtctaaagtaacacatgcactagtgctgtggtctgtggcaaaattactgtaattcaaattggaaaaaaaaatgtttccagactttgtccaacatttattcctatggcaaaggaaattactatgtaatactaattatttcttatgctggtatgttttaagctactctatgaagtatgtgaaacatcaatatttatggattaatagatggcctgatgtctttcaaatgggagaggagtaaattttagtgttaccaactcatgacacttgtaatacaataaatcttaaaatttttattttccacttacaggtatactttactaaataattaccttaaatggcagtgcatattaggattttttagcacatactactaaaattatatagtaacttttaacttgtgctgatatttcccaaccaaaaaagacatcattcacttcatcataaccaaaataagtagtactgtaatatttatcttcatttatttagacatgattaagataccgtaagactcctctaatttacctggaatttttagccattgattcaaggacttgaatgctgtttacttggtactacctaatgaaaggatttggtaataaaggttataatcacgattttaaagaaaaatgtttcatcttgaaggcaaatttttaagctttttatttagaggtgtttacttaagaatagtaatttaaaagcattcttattttgtcattaagacaagtacccaaaagaattgtaataagtaatacttggccaatgcaaatttgtacatttgaaatcatacacttgaaagaaaaaaatgaaggcttgtgagtgcttaaactgcatatctttttaaaaattcaaattttagacatatcagtttaaattatccttaataaggttttactatgtcagtgatgtatattacaaaatgtctacctatgttatgttaatgatatctctatactgcatcatattcggcatggttatggtatattttgtacttttgattgtggactattgataggattgatatagcaataaatctgattcagacttaatattttttaaaacgctagataccatactgtatcataatcctattatatttgacttgaatgcccaaaattttcatagttctatattttatgttaaaaatttagtattacatgttagggatttatttttgtctgctattttcacatacattcttttagaactgagtctgtttctatttagatcatagacgtctaaagaagtattattaattcatgaactgctttgtggaaaaatttaaataaagtatgaaatgactagattaccccaaattgtttatttttttttttggttaatgaccaggttacaattctcagacaaatgaaattggcttgataactgattgaatatagtagataatggaaagtttgactctttaagggcttccaagtgttaaatacattctcaattctgaattacttcatagtaactacttaaataatggtaagccaattctcctttttctttttgagatatttaacacaatttgcgtcttctgatcccattcccttcttccccaaaaaccatgctagaatttaaaattggaagagtttaatttgtcatctacattttagtttttttattctatagataagtaagaagacaagtagacgttctgctgtcaagacagtccatgttattgttggccattcttttcagggataatgcttaatgttatttgtgcgttgtataaggaatgttgtttatcagtatatagacctaccattagtagaaatgatgtatggcaggctttcttgaataatatgtattgtaagtttgtttcctatagtgttattatggttcagattcttttaaataaagctagtttttaaagagaaaaa

SEQ ID NO: 2627 - DNA, 834 bp, Homo sapiens
gtttccagcaaaccaccgtgacagctcctccggaatccactgttggcttggtctctaaatcctcagcatcttcgtgatcttccctggcagcctcagcagcatctgcttggctagactctctctcctcttggttcatgatttctggggtcacgtggtccaaatctgcttctagaagttcagtttgtacttccactggcatttgattgacccgttcaacatgcagctcctctacatgtacttcagtaccttcttcagtctgaattcggcccacttctagataactcacttggacctgctctggaagctcactcatgtgtgaatcgtgcacctggctgtcctggagcagatctggatggacttgttccacagtcacttgtgctgaatccacctgaacctgaagcaatggtagcacatgcaccttcccaacttgttctataatagtcattgatgttacaggttcagtttgcacacgtgtttctactgaaagaacttcttccgttactagacgctctgaaatattgtgagcatcactgagatgcctccttaattcatttccttgcataaaccacaaatcacataaagtacaatggttgggtttatctccagtgtgtattaccaagtgatctttgaactggtcccagctgttaaacacactgttgcagacctgaaataaccaaaaatatgatgtagacaatacttatatccaaactgaaggaaatatgaatgcatttattctctgtaaagaaaagattgaaggcttattctgtaaatgttataaatatggtacctgcaatagaatctcgtccaagctatttcataattctttggttcatt

SEQ ID NO: 2628 - DNA, 1194 bp, Homo sapiens
ggggagcacggggcgacgctggctgcagagacccggtgacagcgtgagaggttcgcagagtactaggttttgacaagcttgcatcatgcgtgagtataagctagtcgttcttggctcacgaggcgttggaaagtctgctttgactgtacaatttgttcaaggaatttttgtagaaaaatacgatcctacgatagaagattcttatagagagcaagttgaagtagatgcacaacagtgtatgcttgaaatcttggatactgcaggaacggagcaatttacagcaatgagggatttatacatgaaaaatggacaagggtttgcattagtttattccatcacagcacagtccacatttaacgatttacaagacctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcctgggaaggctcgcaaaaagtcatcatgtcagctgctttaatatactaaatgcattgtagctctgagccaggtctgaagaactgttgcccaattcaacagtgccagcattccaactttgttaaacctaccaacatcttaaatggactttcctgtggtggtaccctttaagaggcggatgaaagctactatatcagtttgcacattctaatcactttccagtatcacaagagagatttttacttatataatagtcctagagtatgcagctggtaaaaccagaggctacatccagtattactgctaagagacattcttcatccaccaatgttgtacatgtatgaaaatggtgtactgtatactttaacatgccccatactttgtattggagagtacaataatgtaaatcctaaaagcaccactattttagcataataaaagaaagtccaaagagctcctatatagactactccagataacttcgcttctttgatacttgtagcttattgtaattttttttaagaaattcaaggtcattattattgtacaaaataagcgctttgattaacacagctatatagtttttttaattttttt

SEQ ID NO: 2629 - DNA, 1451 bp, Homo sapiens
cccactcctagctcttcttgaatatttgaaaagaattagataagggccatggggacccaggtcaccccacctcttcttttcagtttggctacaacattggagtcatcagtgctcctgagacagtcatacaggactttctcagttacactttgaaagagaggtcagaagactctccctctgaggttttgctcatgtccccctggcccttgtctgtggccatcttccccaatggtgatatgattggctcctttctgttgcactctttgtcaaccactttggcaggtgcagttcaatgcttatcataatttgttggctattactggttgccttatgggattctgcagacaagctgagttggttgaaatgctgatcctgggccactagattactggcttgtaatgcggactctgcacaagttttgtgcccatgtacattggagagatctcgcctactcccctttggggtacctttagtgctctcaaccagctggacgtcgttggtattctggagatccagatctttggtctggagttcatcttggggtctgaagagctatgcccagtgatactgggctttaccatccttccagctgtcctataaagtgtagcccttccattttgccctggaagtcgtaagtttttgctcattaacagaaaggaagagtactaatgagatccttcagcaattgtaggggactcaggatgtgtcccaggacatctaggagataagagtgctaggatgatacaagaaaagcaagtcactacactggcgctctttagagtacccagctaccaacaacccactgtcatttccatcatgctccagctctctcagtagctctctggaatcaatgttgtcttctattactcaatgagaatcttcaaggatgcaggtgttgagaagccaatctatagattagtgcaggagtggttaatattatcttcttgactgtagtctctctgtttgtggttgaaagggcaggaaggactttacatatgataggtcttgaggcatggcgttttgttctgtcctcatgattgtttctttgttattaaaggatgagtatggtgggatgagctttgtctgtagtggggctatcttggtctttgtggccttctctgaagttggaccagactccgttccctggaatactgtggccacactcttcagtttgcaatagcagtggctggttgctccaactggacctccaactttctagttggattgctcttcctgaacaattattatctagtttaagtgtgttgttgctttagggtcatggcatgcttatgtatttctgttaccatctgaccatggtactatgccaagttctcttaggggacctgaatctttccagtagaccacatttgagagagtatgagtcaactgggcatagttcccaacaacccaaaatacatacgtacttcactgaagcagatctcatgattcca

SEQ ID NO: 2630 - DNA, 873 bp, Homo sapiens
gtggctgtggttcgcggcggtgctgtcgcgggcgccctggcgcagcccacgcaggggctcctgaggggagacataagacatcagtcagtacatgtgaggtgtgcattggattgatccagaaagtcaggacgactccaagtggaaaggcctccaggtaataggtggattcaaagatgtttctgattggcagttggttgaaagaagttactatctgaaggcttggaatcaatagaaaggagtgtctgggttaagagaaggggctgtggagaccgaggtccttattatgtggatgaaatctcataggtgtccgccctcagaggcaatacatggcaaatgtttcctattcagaccttcaaaaggcactagactctcagccagtctcctcaggatcagaaaaagagctggaaagggaaggggagtctacagaatatgaatttccccacaagacaccgctttgcggggccatttcaaaatttgtcaaagagatatattttggggtaaaatacattgatactttgagggcctgttgtcacgtgatgctataccagcgtcagattggaacttggtgtcttgctgctatggagtctgctgtcagtctggtcagctgcacctgaactccaaagggaggtgggtataatgagccatgtccaatccccgtcccttcctggcctgagctcatttttcaggttcttcagaatccccctggtggagatgagggatccattcagtgggttggggaagcttagagttttatttttgatttacactatgtgaagcagaaattaaaatactgtaaccctgatagggttattttaaagctgcaggaatcaaggcaggttgccgtgggtaagaggatagacaggcaggtcatgt

SEQ ID NO: 2631 - DNA, 5543 bp, Homo sapiens
gactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgagccttggccgctttgtctgggatcaggcttatcctcctagcccacggcccgggagggaacaaagagcctcgaccctcaagctctagcctctgcctctcatcggagccccatgcgcccattcatcacctttctaaagacccctttgtctgcctggcaagcacaggtctgcaagggatgcccacgcccctgcccaaagtcctgcttttctaacaactgagctagattggattttcaagccacccagtcttgtgtaaacgacctcataccggtcttttttaccccctcagaatagaccatgtatagattcgttgatgcatgacgaccattccagcccattccttgctagctttttcattctcttccagtccgctttgactgtgctactgttttcctggttttctacagaatagcaagtccttctgtaaggatcaacctgcatcttgctcgcttaaataaatgcttattacctagggagcaggaatattaagaaatggagtgcaggaagtttaagagcatgtgtgtgtgttagcagtcccatctctctctctctcacacacacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttgaatagagttgacaatcaggttcacatcctcagaaaaagccttccaagctatgtcagcaacacaaagttgcaccacctcctgggtaaacttcaaagacacagaggccagcgggtggaaggaagtgtgatatttagagaacttagtggggcgggggagagtctgaactcatctagacaaactaaaaaaaatagcagaaatatagtctgtgtgaagctacagtacccagtttctttctaaaactgtaaccatgacgcccatgcgttttagccgtagaagaacaaataaggaagtatccttagtggtactggagtttctaattcaaattataacacattaatctatccaacgtcaaatagaaaaaaaaaaagtagagaaacagagtatacctatttcctgctttctaagctttaacttcagcccttcgagaaaccatctatctccagtatctccttaggtgataggacattgaaaacaggcaaccgtttggtgaataaagacatttctcttgagttctgcccacagattaaaaggacaaggacacacgttctttgttgacacttctgcagtgacttctcctttggcgagagagcacccagggccaacacaactgtcaccacaaccacacagagcaagttgaactcatactgggaacagcttagagaagcacgcacatctcaacaacagcctttgttatttaattcatgacactaaccacgcgcaagctcaaacaaacacacatgctatcctaaccatcactctaccctctatattcacatttcatttatggcttgactttttgtcatatcctgaaatgaagctttgcatttacccgatgagttgcgtctcctggtgctcctcagttcttgctatttcttttgtcttataaaagatcaggagcagacttattgtgcagatcgtccacctcttcctaatggagcgcatcttgggtgcccgagaaagtcctggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttcgggggcgtcactggcccttccctcttgctaggagataaacgctgcgcaaagccaatcaccaggctgagggggcggaggctgcttggagagtaacgtccccggctctgcctgctctgtgccgggagaggaagctcacagtgctacgcgcctgcgagctcgcgcacatacacatatacatacatacacacatacatacatatgcacacacacgtacacgcagaatcacacacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagttctgaaaaaaaagcagctaccatggacctctcttttaaacgcaagtacacccacacacattcggataccaaggaaggaaggaaagaaagaaaggaaagaaaagggaggggaggaaggaagagcaaagtcctctctaaaagtctcaattatatatatagcctctgattgtcacctctcctccgtcccaccatttttcgtacttgtattgggtggcagggacacttttcaagagttctgtgttcgattgttcactctgagtacctctccaccatcctccagtcgttgccctcattgggagagatgcttgctactctgctagtaccacgccttggttccggtctttactgttggctggtaggtcgggaggcacctctagcatgagacagtgtctggaagccaggatttccctcatctatatgcgccggtccccagctccctggtcgccagggtttctctccagttgaattccgtgttccttcaggttgaacagtagcttcagcggtttttcacgctcagaaatgatgaggcccaattccaatcttccctcccgccggaagtaagaaggggaattctgagttgcttgtcgcctgacagcttaaaatagcaacgaaaacagccagcatctttgcttaaaaacccaaggttcccgccagtgtttaccatacttcctctagagtttaagaagttaagaacttccgagatcttgaatttcctctttgcagcacagcgaacggggtcgggtataaaaatgctccaaggagcaagtaattacgaacgtttattgacactacaagtggcccacagggagcctttcgagtttattgatgtctaggcaaatccagcctgcattaatgcatttctgttagattgacttctgttagactcacttttcttctggcaaaaactgccagaataaaacagcttcttatttaagttaaaagggatccggggctgagggcaggggtcgggtgggagagggatgcatggttaggatgctaaattctcaaggataaactttgatttttaaacagtagacaactatattttagattataggtaaaacatcactctctgtcagggatagagtaatatgcatcgtttcattaaactcattatttcttaagcaatggttatggggcaggcaatgtgtgcggagatgggaacacaaagatgaataaaacttagcatctagtcagacacaaatcctactcactcaaagggggcatcttttaaaaataataatttacagtatggcaacatgaatcagaaacatcatttaaaatatatatggtatctgagtaagctcctgggttgaagcagatggggtgtttaagccttttgaagcccggaagatgagtttccgggtgaaggggacacacagactcctgttttcaaagctgacaaggaagtaagccaagcagagggaggatagaacattgcaggtggaaaaaggagtatgcgcaactccagagagtaataaaactctggtgctttggggcaactttgaagtggctcagtactgttagaagggaaagtggtaagggagagtgctggtccaaaagtttcggtgtactcataatattctatggctccagagtgtggaacagtcttctgtaatgagaaagccacaagaaaatcttcaagaggaaagtgagtataatctatattaagctttaaattacattaggggaaactacttacctagcccaaacaggaaaaaacaaacaaacaaacaaaaaaagaaaagaaaaaaaaaaaaaaaaagagcgaaacgaaagcaatcaagaactagttataggaacacataagacaaatttaaatgtccagaagaaaaataagtgaactctccaattgtataatgctgctgtttctgaattttttaagtacagaactttttatattaaggcgagcaattctgaatgactgataactgttcagcgagactccaggaattcttcttcccaaattaaagcaatttagtgtttggagtgtaattgaatgccatttgtttaatattgttagattcgttaaatatatagccattataatttgccaattaaaaagaagccatacaggccaatacttagacaaaagtgaggacagcatggttttttctcaatatgtaaataggtgcaagaactataaatattggataaaaagtcttttggaattaacttctattagaatgcttagtttgatgttcctgagcaccaaaagactataaagaagtcttttggaattaacttcttctattagaatgcttagtttgatgctcctgagcaaataagattgtttctaaattttcatttgatctttggattgtaagttcttcaataaagagaatatatttgtctttattcagcacaattctacaattatacaatagcctataaataaataatgtgagtaatggcagctggttttaaaatgatactttatcctttgacttaatgtaaattcatgttttcattgctggctgtactctcaaatctagctggcaagaaatgaatagatacttgcagtctcatggtggag

SEQ ID NO: 2632 - DNA, 1717 bp, Homo sapiens
aaacatgcaatttaaatttatttcaaatctgctacccacagtgtttgagccagggcctaactttgggtctttttgcatattgccttaaacctagaaatgctaccctgcaaacagggaaggggaaagaggaaggtgttaatccgaagtaagtgggagacagaggaacctcatgcacagttacagaaggcaggtttgctgttttaacccagatagaggggtttctactcttatttctaggaacacgacgacactggttgtgggagggagagagaagggatctttggtttctcctaattctagaatcattaatgcactggcatccagagggtgggtaatagaaatgtctgtgggtagttggtatgcacaaatggcccatcagctaactcatcaagctggtaggaatctgagcgcacaggtgggctgcggcaggcagcagtcctgggctcctcacagctgtgtgctacctagcagggaacaaaaaagaaagtggactcacacagacctgcagaaatgcagacagggtgtgaagagggtttaaatttctaatatggcggaccagaatgtcttgatctatttctaggccatctattctattccggtggtctatttgcttacttctaaacaaatgccatacaatgtggtggctttatagtataaaagcgtttaacaacaggtttatgtatttaaattcaacagagatcatctaatgcaataacttgtgctaacgggttaactccgtcgtacagaactcagactaaaactcgtctttccaactctgcgtatgtatttgaactttctacaaccattaataacagaaataattgaatgctagactaatactgtgtaaaggagcaatggtcaatcttaatctgattacaaaagtttgaaaaaagaagcctcactcttctgattgccattataataagtgatggctatactattgaatttgtaaagttatcctaatcaaatactacttttctaatttatatatatttttatatacatgactccaaataagactgtttataaaatgggttccatccagtacaagtttttaaactactgttgtaacacataaatttgtgctgcctccaacagcaatgattcaactgttagtctgattacatcattcacattatcaccaagtatatcctctaaagtgtctaattatcacttttataaagcacattcacaaagttttgcattcatcaccactacccagttcctgtttgtctgatttttattatttaaaaaaatggaaaaacaaaagtgcatttttcattcaataaatgttccatccttatttagttttgttgccgaaagtgaagtccatgactttagaatgatagcaatttatcaaccaaagaatccgtcttcacaccgtttcaataactgcagcaatttccttgaactgtctgtagaaattctggagagaaagggggaaaataatcacaaacctgaaactgtggaatcgtcatttcaaagcacttggtctttacttggcctgaatgatctgccacttttagcatcactgcaacgtaaggatacttaagagatctgcaagtgtctgagctcacagccatacccagtttccactgaaaatctacaagctggttggaactcacatcggacttagcatccagcggcggctcgctggacgcctccatgggcagcgtctgggacttgcggcccggactcgagagaacgcccccagacc

SEQ ID NO: 2633 - DNA, 1994 bp, Homo sapiens
tatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttgaaaaactacattaactggaaagttgaaaaactacattactttggagaataaaaccgaaagttcgtgtataccttcttaaaaaaaaaatcaaaccaaaaatgtgaaaacaatagaattgcaaagatagcagttaaaattttaatctgaaaataacctttgaatctcgggctaggttacgtccatatttgaagtggtcagtgatggtttgaacattttttgcaggatgagtgaaaatgcactggattatatttgggatttttgtttttggaattgtctgttttaatcacagccttaattcacaattggcaaaggcagtttactcaaaggactgggctaaatattctgtaattatgcatttttgataggaaaatgaaatttttgcaaacagacattttctttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaacgactactgtgatgagttaatcagaaaatctattaaaatctatatgac

SEQ ID NO: 2634 - DNA, 1827 bp, Homo sapiens
ggctgttgctgtctccggctccttcgctaacgattgcaggagaaataatgaggatgtaattattacagccctgcgcggagggctggggggcggcggacgcgggctcctctgcctgcgcgcccaggtggggctgggctgggctgggctgggctgggctggactggacgcctctccccgcccggccctccctcagcgcgcggcgtgtgcggtgcccgaggcttcggagcaggctggacctgggaacccggggaggggcctggaggagagatagctgggcgaggtgggcgccggcgagaaggcggagcccccggacagcgtaggttcgcaggtggagagcggacgcgggggcgagggtgcgcggcgggtctgcgatgcgcgtcggaaactcgcggcccccggtcccggccctgcgcgcttggagcccgggtccttccagcccctgcgcgacgccgccgccgccgccgccggtgaatggcgatcccggccacggcctggaattggaaattcgtgacttgtcggcggccccggtcttctatcgattaaagataaagcgatcagcagtgaatttatccttcgtgtggatgaactcggccagcccgggctgtggggggtttgggaactgtaaatattctccaaagcgccgccgcttctcccgtcttcccggactcgaggctggaggcagctccggcgacgcgaaggggggtaccccccggagaggtcgggcctggggcgcggcggacagagacccggtcccagagcctggcggagcccgacaatccgccctgtcaggaggaatctcatcaacagcccgtgaattaattgtccttgcagttgggaaataacccggtacctcggcgtagcccgagggagtccaggaggctctccaaggagccttcccccgggtcgcgaagctgcgctaaaccccggccccagcgcaccttggaaggcgcattttggcctgaggtgaacgcaccttacaccattttcattttacttccttttctctgagaaaggtaatagataaccaaggccaaaaatggcgaaatgatgaaaaaatggtaattcttggcaggtcaagttgttactctgggtttaaaaaaatgtcattaatcaggattttccagtagccaaattgtcttgtgccggcagctgggtgactcacagatttggctccaatagtaattgtagagtgtgcgtaccatttccttctggatggtgtgactttttcattgcttggaagagaacacattagaatattttatcccctacatctggcagcatgtggagcaggctgtaggcaatactctgtccaagcacatctgggcggggaggccgtggagggaccgaggtgacacagagccggccctgtcctcggttctgtctcgggtcacctgaggcatcttcaccgcggcagctcgggcgcgtgggatctgctctcagtgatgacctgggacgcatcctgcctctgtgcgccattcctgccccttcactgtcactccttggtgatcgcccgtgttcttgggtaagcagtggagaggcacagaatggcttcctctgttgatctaccgcgtcaaatctgtatattataatttcaggttaaagggtaagagttgtaagcaaaatgagtactacgtcaaataattcaaaggaacgaagtaattaaaagtaaagctttctcagcacgaagatgttttctcagataagcattctaagtcaacttttcatagtattcaatgtctatttgttattcttcgaaagaactttgcacttatgattgtccaaagtggtacagcttgagacagaaataaacatgtatttatttaccaa

SEQ ID NO: 2635 - DNA, 8865 bp, Homo sapiens
gcggggcttgtgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttcccgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatcccagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgaggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggttttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaaaaaaaaaaaaaaaaactgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 2636 - DNA, 3252 bp, Homo sapiens
ttcttaaccacaccctactatttcctcagtttaattgtgcataacattgggttagtctggaaattctacaaatctgtgacagcattcttcaatcaccacagtcagagcctatacctacctccacatcaaagttggtcatgtcggccttccacttaaaataatcttgaacagcacccccaaaatctcttgcagcctcatttgaggtaaagcaatgtttctctcctgccctgttgcatgtgactctaaacttcagcacttgaggctcagtttcttcttttgagctttcatcagtctcatctttgcaagatgccaaatcatcacctattaatgttgatacatcctctttgatggctggattttcataataatctaagatatgagaatctaaagcatggctagtgaactcttttttaacatttctctgatcgattttgacttcttgtccattattaatcttctctttacttgaattctgatttatctttttgcgctttgcttttttctttttaaaactggcattaattttccacacttttaaggggtttgaccatgggagttttccagccaagtcttcaaaatcctttagaacttcttcctgtaaaggacagagaaagaaattcattcatttctcaccactataatcaaacaaataaacctctactttgcttatggacagttggtatccgtgggggacactggttccaggaccgccaaagacaccaaaacccaaagatgctcaaaagtccctcatataaaatggtatagtgtctacatatgacctacacacatcctctcaagagtaacttaaatcatctctatcttacctatgatacctgatacaatgtaaatgctatggaaatagttgttatactgtattgtttgggaaataatgacaagaaaaaaagtctgggctggatatggtggctcatgcctgtaatcccagcactttaggaagctgaagcaagtggatcacttgaacttaggagtttgagaccagactgggcaacatggcaaaactctgtctccacaaaaaaatacaaaaattaactgggcatggtggcacgtgcctgtagtcccagctactcaggaagctgagatgggaggactgcttgagcctgggaggtcaaggctccaatgagctatgatcacgccaatgcactccagcttagacaacagagcaagatcttgtctaaaaaaataaatcttttacaaaagagaatgaacactgactacaatattcttaaggaaagaaagcctaactccaaattttatacccaaactatcagccaaatataaaggtgaaagacaaacatttctgaactcatgccattcaacagatacaaattataacaaaaggacaaataatgtgcctataatctatttaattatatcactaaaatgaaaacaagtgtagggattgtgattataaagcagaaggtaaatgttacaaactggcatgtaaatgggcatactgataccctcatctcttacacccagaggtcaaaggatagaagttaaagctgataaataaaatgtaagtatatttaaaagtttaagggtgaacactaagaaaaataactgaaaaataaaggaaaaaagtataaatatgccaatttcatcattgcttttagcagggattcaaaaaataccgtgtatatatggtagataaggtagataatatcaaattgtagttataaaggtaacagctagaacacacacacataaaccttccaaactattagaaaacacaggcatatgaaaaaagtaaagacataatgtaaagatttttcaaattaagaaaaaacaaaaagtatgagcatgacaaaactaagactaaacagttgtcattatcaataagtatcaatgggataaacacaaagatgacactcagtttgaatatgtacaagaatttacatagtgtatttgttgcaccactgtaatagcaaaagaatgtgaaaaaccctcatgccctaaaatgggactggttaaattattatacagccaaacaatggagtatacgcagccaattccagcaatgatactgccaggatctccaacatataggttgaacattcctaatctcaaagtccaaaatccaaaacctaaaatttttttgaagtgccaacatgatgccacacaggtagctgagatagtgacacctttgctttctgatggttcagtgtacacaaactttgtttcatgtataaattattttaaaaatcatataaaattaccgtcaagctatacgtataacgtatatatgaaacaaatgaatcttggatttatttatacataggttccaccctcagagtatttctttcttttttttttttttttttttttttgagacggagtcttgctctgttgcccagactagagtgcagtggcgtgatctcggctcactgcaacttctgcctcccgggttcaagtgattctcctgcctcagcctcccgagtagctggaattacagaagcccgccaccgcacccggctaatttttgtatttttagtagagatggtgtttcaccaccttggccatgctgctctcaaactcctgacctcatgattcacctgctttggcttcccaaagtgctgggattacaggtgtgagccaccatgcccaacccagaatatttcaaaaaacaaacaaacaaaaatccaaaacattgaaactacagtcaaaattacaaatcagtactcaatagaaaatgcagtaactttaaaatcacctgatttggggcagagcaatgaaaatcagaaaggattccagaagggtctataaaatgaaaagtaaccataaaatgatcaacttagaaaactattttaaatattgctccattcaaacctgtgccagactttccactgaaatgacaaaaactggaaacccaaaatgacggtaactgagagtggtgctaaggccctaagttttggttacactctcacctaagtgagaacctggccaaaaagggggaatttttttttttttgagatggagtctggctctgtcgcccaggctggagtgcagtggcgcgatctcggctcactgcaagctccgcctcccgggttcatgccattttcctgcctcagcctcccaagtagctgggactacaggtgcctgccacctcgcccagttaattttttgtatttttagtagacacggagtttcaccgtgttagccaggatggtctcgatctcctgacctcgtgatctgcccaccttggcctctcaaagtgctggagatgacaggcgtgag

SEQ ID NO: 2637 - DNA, 1114 bp, Homo sapiens
accttatttactgtattcatcaaattgatctctagggcaaattatttcacctcctgaggacagacacacatctgtcaacaggcagcaccatgtttatgttccaattggctagaaacacactgatgtttaatgaagtctgagttgccacaaaaggcatttccatagtcacggcactagtagggttttcttctgcatgagttcacttataaggaaggagctgtgactctccattacaggagttttcaacttgactgattctacccatttctcttgtgtgcattttcttatgtttgacaaggtttgataagtgggagaaggctttctcacaatcactgcatccatacggcctctctcctgtatgcgttctttgatgtacattgagtactgactttgtggtgaaggcttttccacattcattgcactcataaggtttctctcctgtgtgaattctctgatgggtaatgaggccatatttgtgtgaataggattttccgcactcggtacatacaaagggagtctttcctgtatgacatctctcatgttgtatgaggcatattttctggctgaaggctttaccacattcattgcattcatagggtttttctcctgtatgagttcgctgatgtataataagagtgcgctttgtggtgaagcctttaccacattcattgcatatgtaagatttctctcctgtatgagttcgctgatgtataacgagagtgcgtttgacagtgaagccttttccacattcgctgcatatgtaagatttttctcctgtgtgggagcgctgatgtacaatgagattgctcttcacggtaaagccttttccacattcactgcacatatagggtttctctccagtatgagttcgctgatgtacaacaagatagcgcttcatggtgaagccttttccacattcactgcatatatagggtttctcccctgtatgagttcgctgatgtacaatgagattgctcttcacagtgaaaccttttccacattcactgcatatgtagggtttctctcctgtatgagttcgttgatgttcgatcatacggctcttcatggtgaagcctttcccacattcattgcatatatatggtttctctcctgt

SEQ ID NO: 2638 - DNA, 2303 bp, Homo sapiens
gaaactattatattttgtaattaatatagtccctgttctctgcatccgagatatttatgttgtgtctatggaaataggaactcagtgagcaaatggtgggtagcatgtatttatagagagaatggagggattctaaggagggagcaaagtgactataacaagattagggacaagagacttcaaccagagagttctgtgatcaattccccgagatctctgcatcttctgagttttctgcttagaatcagggaagctcagtgcttgacaggaacgagcagtggcactctcagtttcactgtgttacaaaggagccctgaggaagggaggccgctggctgcccaggtgccctggggggaaagggacttctgctgctgcagagagtggcacccggtggggccaggggctctgggatggtccgtaaagctccccaggacttctttgaaggatgctttacagaatgtttctgggagaccagcctcaaggtcaacccatcacaaacgtgaggaccaggaaggaaccatggccagggttctccatttgctgtagagtatctggtgatacagtgagacactaaagagtcatcagccagttcatctttcctctgccaataagagtggatagaacaggaatgaagtgttactggtggtatttcaggcatcaggagccttggaaaatcatcgtaggggcccatgcctgtctgtccctaggcacctgggcagtgccacagaggcccgcccacgactggccaggggacagaactccagtagtgcatccctgtacaacctgcacataacggttatgtatgttcacctaaaggagagaatatactttctattcctattgcacaaaaaccttgtaaactttgagaggtgctgaaaaagccaattctgcaagctctcctagaggactgacattgtaacattagagtgagaagatttctctgccacattcttttgtgttaatccaggtgtgtcttcacacccagtgagtggaagttgctggagctcggtacaggtccacccagctgaagtgggttctttttcccactaccactggggcaagggagtgagcctaggtatggtcacctcagcagccacagtcttaaaagcaagtcgctagattttttgaaagtcccaagagaagtggtggtcttcccttctgtcatcccagtatatatagttatacatgtaaatatctaaataccccatgtaatgggaaggctatgtacagggcagccttcccaaacgctgtgagggcacagagctgctgtggctgctccaccagggtgtgctggtggctcagctttggggttggactcccacgttcacctccccctcctggtccaggcagaggcaccagaacccatcctgccttttctccagtgtgagcatttcagggagccaccatcagccttgggttcatgagaggaagaaacccccaaagaccaatgcctggagcccacttctccagcgacaccttccctcgccagagcaggctcctaggagtgcatggcaggggtgccgggtccctgtgcacgggtttgctttctgaacattgcccatcaacaccgccttcagggagtcccagagtaacctactacctcccccatcgctcctctgcccccctcaccctgtgggcaccaacacctcccgcacacagatgaaaaccatctacagagcccttcccgggtccctcgacccagtggtgtagccgttaccaatgtttacaaccaggggccgcccctccttagatgtgtttactcgcattcacaggccacctgttggtttgagtttcatgtgtctccttccctggcctaggttgacttgagcacacaactcgatctttcttcccctccatcaaggcagtgtgtgaggactgtgtgggaatgacatttcttgtacatacttagcacagcacctagagtatgaacttgtactattgttctgtaaagagggtgaaatagagcttattgtaaagtgtcgggagaagtatagtattgtatttgtaacaatatcgttctttgtatacacaaaactcaatgatctatatataaatataaataaatatataaataaaatatatctacacgtgagcctggaatgtggacaccgcacacccactgaatgtacttccttgacagtctggtcactggtccctccctccctccctcctccgtcccgtggccacagtcatccagtttggggttgtgatgtatttactgtgctatctatcttcctttatttaactgaacgctaatgtctgtataagagttgctgcaacaataaacaagaacttcacctctt

SEQ ID NO: 2639 - DNA, 3117 bp, Homo sapiens
aggagcgcttctcttttctagctcccctgccaggccagtccccgagctcggcccctgggtccccaaaccgactggcaaaaacgggcgcggagggaaaggaaagccggatgggtcgggcccggggaccacccccaagacgaccgtccccagcgccctttgggcggcgctgcccaccgtagtgggggaagggccgggaggggtcgcgcggagaaagccgctgggagggttgggggttgaatctcgggcccgcgcccccgccccagtcccaggagggagaaacgaggggacccgcgaggccctggctgcgggccccacccctcgctggccggcgggtctaggactgacagccggcggcggcacctcgccgcaccattcatttcccggcctcctccctcccccgccatcttccttcctccgcctcagtttccccacccccgcccgtaagcccccttaccccgtgccacagtccaccacacaggccggcagccgtcccgccatcttcctcctcgcctgctgctgctgctgccgccgtctgctccgtgctgctaggggccagagattggcggcgggagacaagggctatctgaccatccacagctgggccgccttcaccgtccggggggtagccgggaagccgaagcagtagcaagaaagcagcaggctcggtcggcggctatcacttccgcaacccaggcaggcaggcagtccccgccctgccccgccgcggcctcctccccctctctcttccctcctcctcactcctgcccccaccctacaacttcttcccctcacgccgcctttccccgggaagccaagatggccgccggtgccgacgccccggccaggccaggcccaggcccccagcgctcccccttccgctccgagcgggaggggctagcgagcatgcgcaataagtaacaatgcctggattttattcagatgctgtgtacccagccaaaagactacatttctcaatctccattgtagctggatgtggctgtgtgatcaagttatgaccaatgagatataagtagaagtagcttggccagacacagtggctcacacctgtaatcccagccctttgggaggccaaagcaggaggatcacttgcactcaggagttggaaactgcagaccagcctggagaacacagtgacaccttgtctctacacaaaatgaaaaagttagcagggtatggtggcatgtgcctgtggtcccagctacttccagctacttgggaggctaaaatggaaggatcgcttgagcctgggagattgaggcctcagtgagccatgatcatgccactgtactccagcctgggtgacaagagcaagaccctgtctctcaaaaaaaaaaaaacgcggctgggtggaacatctggaaaacatctttaaagaacgctgactcaatcaggaggagcaccattttgtttcttgccctctgcccttcctgcctgaaacagataagtgccctctgtgtaccaaaaaggaatgtactgtttatagagacttcaaatcagcagaaaattcaaatagttataacttttctttataatccatcatgaaaaagagtaacgacaaataagagtgcagtggtgcagtcatggctcactgcagcgtctgcctcctggactcaaagaatcctcctacctcagcctcccaagtagctaggaccacaggtatgtaccaccacacccagttattattattattttttttcacagagacaggatctcactatgttgcccaggctggtctccaactcctaggctcaagcgatctacctgcctcaacctcccaaagtgctgggattacaggcatgtgccactgggcctagcctggcattactcttacaaaggatacaccacgagttgtgctctcctgcagcgttttgcggacggctggctatcttacccagaatcaatcacactgggacactgaaaaaaaaaaaaaaggaaaaaagagcgagggagtaattctagcctgtttttacaagaacacagtggctatagacagtgccagtgtgaagatgactcagcaaacgtggagaaccaaagattctagggcagcaccaaaactgggaaagcaattacagcagaagttgccttccccatggtagcttagcaacttcgtgtctctccaaggcagagaggaaaatcaagtctaacaggccttcccgaaggctaggtgtgaaataccagaagccatctttgtttctggcgatgtcactaaataagtatttgttgatataaagtattacacatctgttctcccacatttcagctaaattgccaaaagttaaccctttctggagatccagaatggagcaatatacctagctctcattcattatttcccttgctgatattcttgcatagcttttagtttatgcatttgtcccaaataaacctagaaaaagccacttgtcgtaggacaagatgagctgatgatttgaatcactcccccactgaggaagaaaccatctgtggaaaagactgtataaggtacttcctggttgaacggtagggctctggagtcagaagtcttgaatttgaatcccagccctgaaatgtatcagctgtgtgcccttaggccagatatacttttattgcacaacatgtattacgtacaagaatatcacaagatttggaaatgttagtcctagaagagtttgacacaacgcaatgataagacagtatgaaaaatggagctatgaataaaaaagaatccataagtccccagagcctatgagtatgttatgttgcatagtgatgtagtttggatgcctgtcctctccaaatctcatattgaaatgtgatccccagtgttggaggtggggtctggtggaagatgtttgaattataggggctgattccttatgaatggtttggtacccaccccgtggtaatgagtgagctctcattctggtagtttctgtgagagctggttgtttaaaagagcctggcacctccccttcctctcttgctccctctctgtcttgccatgtgacactcctgcacccctttaccttctgccatgattggaagcttcctgaggccctcaccagaaaccaatgcctacaccatgcttcctgtacaacctgcagagcccaaataaac

SEQ ID NO: 2640 - DNA, 4757 bp, Homo sapiens
tatatatatacacacacatacacattttatatattaaatgtacttgaattagattgtgaggtggagagttctgctttccagaatttatgtgtattttatttatttatttattttgagacagagtcttgctttgtcgcccaggctagagtgcagtggcgcgatctcggctcactgcaaactccgcctcccgcgttcaagcaattctcctgcctcagcatcctgagtagctgggatcacatgtgcccgccaccgcacctggctaatttttgtattttttagtagagacggggtttcaccatcttggccagactggtctcaaactcctgacctcatgatccacctgcctcggcttcccaaagtgctgggattacaggcatgagccaccgtgcccggccttatgtgtattgtaatacatatatatatataaattctggaaagcagaactctccacctcacaatttaactcaatttccaagagcctttgaacacttaatgtgttcaatactgggaatactattcaaactgatttcaattcagctaaacttagcaaacaagatttatcctataggaagtcttactttacaatgattgaagacgttcagtacttcattaatgaaatcgtctttccagcttcctatcaacaagaatttttaaagtgcctactatacaaagcattttcctagttgatcccacagagtcacttggggcagattaccagatgctgagaagaaaaaacccttcatcagaggtggaggaaaaatggatttcaagagtgcttctggtttttgtcaggatggaccagagaatctggaacagtcctgaagaaaatagctggtggcttccttggccttttgccatcaatgatgcttcttacttggatttaaactgccattaggaaacctcttgatcaagaatttagacaagaatttcattcccatgtgataatttaggttataacactagaatggaacaaagagtagaatgtctttagttctttattttgcattatgtcataagaaagttcttgctatgttgtaaaatcgttgttagattcaggcttttggggattctgaaaacacattttgttagagttgaagtctattacctgagaaaggtaaaattgtgtcataattgttcatcatactaggtattaagggtagagacaagttacttcaaggtatagaaacactgaccagtactcgactgtgaaaaacatctttacctttagcattttttttttgaaacagtctcgctccgttgctcagactggggggcaatggcgcaatctcagctcactgcaacttccacttcctgggtacaagcgattctcaatcctcagcctcctgagagtagctgggactacaggcgagcaccaccacacttcgctaattttttgtatttttagtacagccaggatttcgccacgttggccaggctggtctcaaactcctgagctcaggcgatccgcctgccttggcctcccaaagtgctaggattacaggcatgagccactgcacctggcctgtgaagaaacatcttttatcaatgcttcctagactggtaggacatagggtgagaggcgagtggtggttcgttcttgattatgttcagatcttgaaagaattcaacattagggagagaagccttatcaaaagcctcaaaaactctactgaaggtaatatgatacctgattctcactatggctttatttaaaatagaagaaataaacccttctaatatctgcatcttagtcttctgaattaaactcattgactaataaaagatttttactttggagggtttagcactgcatcaaaaaggaagcagatctctcctatttgttaaacgctaaggaatgaaagaaaataacaataaatctgacctctttttgtcatatggcacattaaatatctttgaaaaaaaccccaaaacaataataacaaaagcttgccgctctaaaacgtttaaaatatcggacacaataataaatttttaaaaatgcaaggctaagcaggttttaaaaagtatagggactctccaagaggaaaacaaaaccaggagcagaatccaaggatatagggaagcactgaagccagcagctcccttactgacagtgccaatcgtggaatgccaacagctttagttttaactgtatgcaaggggctggttacaaagctgggggttaagggagaaagatttagataggagaccacagcataccaccactaaatcttcagttaaaaaaattcgtaatatactttcagagcatagctgatgatttgccaagacagacaagcgttcagatcactaaaggtgtaaccattaggtaggtgacttaacctcccagaacttcaagtttcttataaaatgtaggtaatagtactttcctttaggatttactttttgaggaatggagataatacatgtaaatctttcagagtggtttttaatagacaatacataatggctatcattaatcacaatggttcaggtatgtgtgttttcttgtggacccatcagggttttccaagattcctgcctgtacccagccaagaatttagggggcaggggaagcctctggggtttcgtgttgtcttggatattgatttccatttcttctccctttccataccttacagctggataaaagtaagataatggtgactaagaaaaacttgtaatttttttcctcagtccttatttttacattttttatttacatttttttttttttttttgagacagggtctccctctgtagcccaggatggagaacagtggctctatcatggctcactgcagcctcaaactcctgggctgaagtgatcctcctaccgtagccttctgaatagctagggctacaggcacatgccaccatgctcaactaattctttttagttttttgtaaatatgggggtcttactgtgttgcccagcaagatccccatagttacaactttttagttttgaactcctaggctcaagcagtcctcctcctttggcctcctgaagtgctatgattacaggtgtaagccacaatgcccggccctttattttaagatctgaaatacgagctgtttactggagttcattaatataaaaaactaggccatttttcactttatcattagataatcaatttacattttaattgccaaaatatctgtaattgaaaagctgttgaagaaaaaaagggatcttctgtacctggattttactgtttactgataaaaaattaccatttgaacaacatcttttaaagtcaggttttcttcataaggtttaatattgttaaaatttattaaatctagtatgtataatttgtgatccttcttgtacaagtgttgaaatgagtgctgtaaaatcaaccaaatgttttgaagttttggtgaatatattctgatgtaacttgctttcagttacccacagttcagatcttagaacttttcagaaaatttttatgggaattgagagaaaaatgtctgcaaattggcactgaaacagtgtttttatttgcatagttgactttttgtgtttggatgataacttttgccaaaggcaattttgagtagatcttttcacaaaagaatcctattttaaaactttaaataatttgttttcattaaatctaatcattttgttataattgaattccatgggtaaagaatctttaacttcatatacttttaatacttacataaaactagatacattaaaaggtcaatattaattatcaaaacttaaattttaccttgttcaaatacaagattactaaaggctttagattttttaaggcatattataaccttaacattcgtatttcttgaaagagatagacagacacttgtttaatgtgcatagagtttatttggtacatctatcaatttctacaataactgaccaaaaacagttcacacagtgtccacctgcactccatgtctaaaatgatttatttagtagggtattttgcaaggctagaaaggagagaaaggatttcacagtatcagtgaaaactgttttatcatgaaacaaatgtaatacattaatatattcattcattctctattagaaaacagcaaaattacattgttagttgtattatttacagtgaaaacttggaagacttgacaaagcatcagttagtttatcaacagacctaggaagctccctgtcccctcctttcagggtcctttccttggaaatgaaataaacttaaatcagattttacataactttaagcaccagcttgacaatttaaagttttatttcagttttataaaatactcctgctttgaaaggcaaagtgaatgtaaaaatgtgaatgtaattaaacaagtcactggcctggaaactttttattgcaatagtctttatgttttactactatattcacttcttggaatgaatttgcttgtaggtttgaaacaaaatatttgccttttgtcttgaaaaattcccttaaaaaattaattatttttggaactgtacaactacattttcattcgatgttaaatatgcaacttggtccttggatatcatgttacaaagtccaacctgttggataacttgttatagaaaacaataaaaaaccttaaactatcataaaatattactgatgttaacagtcatgtatgtataacacatcactgtatctagattttcctgttattggatgtttaaattaccaatgtacaatcaggttttaaaatgtaatacttaaatttccattcactatgtaaaattaaaagctctaaaagac

SEQ ID NO: 2641 - DNA, 1922 bp, Homo sapiens
ctaaaaattatacataaggatttccaaatcttagagtttcaaaaagtaaccatagggaaaaaaattgtagtaatttctataggcaatattctgtttgggttatcaaaagagcaactccatgctccgcattatttatagtccttattttaaagttttattagctctctttacagaacagatgtgaaggagttgagaggacaatcaactagattttatttttagaatataaagaacatttttaaaatgattaaacagcattaactgtacctcaggatctgcgcatgcatctgaatagcacacggctcaaatggtcctttccttttgttacatttagtagttgtgccatctttagtttttgctttgaacattgttttcctaaaagtcaactattactttcccatcaagttggttttatagttatgtctaaatttatggttcatgtcaaagtatttttgacttaatatccttttaaaaatatttaaactgatttattgctcaattggtgatagctgagaaaattttttcaatatgtagaattttcatggttattttgtatgaattatttttctgggtaagccatctgccacagaaattgacactatggtgagattaatgttaatgaaatgagcagtagagaagctactggattgctttaaaacattctttgattaaattactacatagttggtaagttcatagttttaagttacttaattgaagccctcagaagttgcaaagaatttatctgataaatctgcctttgcacaaatgtgatactgatgcatggacggctttgcggaatgacctttgatatttgtgcctagtggaaggtatggagctaaacaattaaagaactcttcattatggataggcacatattggatctctggtattttgggtagtggtattaacttgacaattctaatttattttagttagtatatgtagcaagttagtatgtttgttagtagtttattgtacttcattccagttggtaatatagttttcatcacactaaactttttatactaaatttctgtagaagcttgttgggtttgccttcaccagaaggtactttaaatacctaccatagctgatttgttataaagaaacaaaatgggtgttcttctgtttccttttgattatgtttactgtaattatttcattttggatttatacatttacaattgaataaggattataggttgataagctgtttattgtgaaaagatgtgttttgttacaaatacttgttttaaaaattaataagcccccaggaagtacagcattgactggcacaactgcccatagtgagcttcccaactaactgccttcagtggattcgggcaagtgcaaagtctttggcctattgtgtgacaaagaggtatatattaaaggaaaagaaaaatgacatgaataagaaaattccgtcaacaaggttggagtagggagttgttgaggggtttagtttgttttaaaaggtatgtgagggagtggtggggtggatttgtgtttctgactttttttctttaagcaaattccatatgttaccaaaagcacatgctgtatattttcttccccttttgtgtgtatatagtattttgaaagataaatgaattgggtatttgtatgtgggatgtacaaaattgtggccgctctctttgtggaaggaaaaaacataaatgaagttaatgcacttcttttcctagcccaaaagtcactgtgattatatttttttaatgaagtttagaaaaaaagctgttgtcttctcaattgtaaaattagtttcaaaatgctgcttctcttatcattagtctagtaattgttgaacttttctgcaaactgcattttacaaaattgaaacttggaagctgtattaacttttatagttaaacattgtattaaataaactatactataat

SEQ ID NO: 2642 - DNA, 1985 bp, Homo sapiens
tgcacttaatacccttcgggtacagatagttgggctgtaagatccataaatgtgcatgctatccctcacgtggtcaccacagtgacagtgtgcactctgagttctgttaccagccaaaagccagtccgtatctgctccatgtgccaaatggtttgacctacccccggcagaagatggcatcagtactgcatattccacaaatccctgctctgtgagccttggtaaggttttcctagccaatctggcctgcacagcattcatcactccatctccattatcttgcagttcaactgtatccacagctttaaaaaggatgctggttttacctgagcccattgatgatgccaatacggcaaaagcttctaaagctgcttggcgtaccctgcgtttgctatctacaagagctggggcaagatcaaaggacagtttgggcaagtcaaaatcctcactaggataggtcagcagggagcagatgcaaatgttcaccacctcctctctcactctggaatgcttatgtttgagatgttccaggagtaaacaaagcacctgctgaggtcctacttccttcattagcttgaggaagattttcatgtattcttgtttgatcaccaacttgttgtccgccagcactttgacagaagctgctataactggtcccaagaactgctgtacctgctctccaaggcgaataaccagtaaatgcaggacttcaagtgtgccatgcaccactttgaagttagaatcgtctaacaaattatatagcaaactaatgaagccaacaagactagaatgaggagtagaactagggttaaattttcccagcacctgctttagttcttcgacggcctgggtccggttcttatagtcttcctgatccaataatcgtgaatgcagctcctgaggaataatcccaaatttaagattgctgttggaaagagtcactgcacagggaaggggatcttcaggaaatccagaggcttcaagttccaaataataaggaacctgacttccaaactgggactccaggcggcgattgtagtgtctcctcagggcagagggcagacgagaaatgtaagattgaaacctgtcttggccaagtcgctccccaatttgttgaagtgcggagaaagctgtctcagattcttcttctgtctcctgatcaccaagctttcgggctagggatattatcacctcggtgagatccagaccaagcaacaagtcctcagtagtaagcaagatgggaagcagtagtgctgtggaagctctaagtcgggcatcggtactttccagtccttgttgtataagcgttctcagcacctctccaggactacgtttcagacatatatgaaggatctgcagcgcatctttccgcagggctggattctcttcccgtaacgagacaactagttgaggcaaaagtgctaagctaaaggcctcttcaagctggcctgcctccccctgaccccggagaacgtccgagagaagttgcaagcagagccgcttctcatcactacctccttccacaagcactcggcccagtgcccgatacaaagcttccttgcgtcgggggaagccaagtcgaccgccccgccgcggcaaagcagcttgcaaagcctggaaggcctcagaaggatcccgggcagtgcggaggagttgaaggagccgagtgtcctcttcatctccccctgacaaaccgcctccagactcagaccagctgcttgagactgcctccgagggcatcaagagggccgaggccagaggcgaagttgtagtggggcaggaaccgtggtcccccgcagctccacggaagtagtagtttttctctcctctcataatgcccccaactcgactatcatcggtctctggggcggaaggacgactgcggctctggagccgataggtagagaggcaaaagaacagcttcagcctgccgccaggccgcccccaactccgggaggcagcctctggcaaaatggcccccgtct

SEQ ID NO: 2643 - DNA, 708 bp, Homo sapiens
cctgtaattccagctacttgggaggctgaggcaggagaatcgctggaacctgaaagacagagattgcagcgagccgacatcacaccactgcactccaactggggcgacagagcgagactccatctcaaaaaaaagaaaaaagaatgggacacactactccttaggcaacagtgttgggttcatgtttatagatgatggaatgaagcagcgggggacaacttctggctggagtggcttggaggctggagcagctgagctttaacaagcatcagaggtcagaattacttggctagatcaagaagccacacagcatcataatgccgctggcacatctcccagaacaggttggttgaatccatggatgagaaacctgcagataccgagggctggcttcatttagattcctaatcattcctccaggtagtcaattttttaaaatcacattgacaagctcattcacccatttcttcattcaacacatatttattacagggtgattggacttctaggctgtcagagctagaaaaggccttatgcatcttttaccccacacccttcattttacccaagggagatggaggcagggctagccctaaacccagagtctctcagcctcacccctgatctaatcatcatctcaccaccccaaccaagcacttagcagtataaaaccttgtgcaaaatatatgtactttttcacttcaaaaa

SEQ ID NO: 2644 - DNA, 595 bp, Homo sapiens
gtctgggttcctgatttgtatctgttacccttcatggaaatggctggtgaagcaaaactatgtgtgtaaaactgcatctgccacaggctgcttgtccacaaaagcagcaaagcatctctatggaatacctccgtatggatctgtaaagaagagtcccacttcagtcaaagacagtagattatgaggtgaagaactgaccagcgatgatcggccagaagactgtggcgtttcaaaatcagataagtaagaataatggtgtttgcctgcctttctttcttgatcagtacctggacttcctgctctttcccccattgttttgaaaaatggtctctattcacataatttcacagattattttctccagaggagactatgacaatactgaaaaacattttcacagtcttcagatcctgataatattcatttctgtgcaatctattttctccacaatgtatttgtagaccacaattcacattggcatccagaagataaacttttttgccctgaaattaaggaaggggaaaggagacttatcatacagtctctacagtttctacagttaattacaatgaaagacactaaaagcaaaataata

SEQ ID NO: 2645 - DNA, 1327 bp, Homo sapiens
acctgccctaaaaatttatccagacccaccagggacctgtgcataactataaggaaaagaatgtatttctctggacttccctgaattagcaatccaggtagctcgaaagaggcctcctccttccaaactggctcaagggttttctcagctacagaggtggagtacttttccttgcccagctgaattatagtgtatgtgtcattggtaccacttttgccttttggcttcagatctttggcttggagcactgtgacctgcacgtgggttggaaaccacttttgggcttgctcggacagcatcatcctgtcctgtttctctgcccccgagttccctagcacaggcagtgcccctcccggagggagagcctaattccttaatcactgcatcctaaggacacttaacggaaacaggcaggctcagggctccccgacttccctatggctgatgtcaaaacgcctcgcgggggcagcccaggggcacggccgctccgggggtcccctttcgtctggagaaacacagaggcccaccatcacctggccgcgccgtgcaggcctctgcgcggacccccgcccctgtctccaccttccccaggcctgcggggcacgtgaggcctggccacacggacccgggcggagggctgcgggggtgaagggagcccccgccccaattctgcacccctggcctcccgcctgcctccttgcggccgagcagcctccgctgcctccgcgcctcccgcccgcccggcgttcgtccgcaggctcggcccggctcctcctcccgaccccgatggagattcagaaacataaggacaacaagaaacttccccaaggtatcattatagtctttagacttcagacacacaccacacctcaaatatatacacaactgaaaggaaaattaaggaagtttttcaaagaaccctattccgagtaagaagtgtgttgcatgaatttctaaggtcaaagatgttgattcattcatagtgtgaggcccagaaatcggcatttttaaacaagtacactggacatttctaaagctggctaaagtttgagagacactatccaagggaaatttctccgtaactctttttctcagaagaaaagtaaactaaaagtaaaaataagcagtaccactaagtttcaagtgatcttctcctaaaagaagaaaaggcctatattcaggcacaagaaaagtatattctcttttatccatgcagaaaacagctagtggttgaaaatcaacacttcagacctcttgtctacataaagccaactgcccctttgttttactgatgtcttcaatgattttacttagatttttctacggc

SEQ ID NO: 2646 - DNA, 2628 bp, Homo sapiens
gtcagcacacgtggagttctgggtggggcgctgggcagagggactcggcttctagggctctgagccaggccgagggacagactgctgggaagtccccaaaagggcagcagcactgaggggcaggattccagggtcctggaggcggaagctcggccgactgactcccagttcgagagaacggggcgggggcagcccaccagtgctggaacccgaggggccgggcgaggaacgctggactgggagcaggacccttctcgcctcggacaagactccttgtctggggacccagcccgacttcattgtagctgggtcctcgagaaagcgaaaggagccctccttccccattggcctctccatcgctgcatcccaagaagaaagacaactcgggctccacttgcttgctttttaataacagagcagagagaatacaaggccaggagcggggcctggaggaaaacaggacttggggtgctcctgtgagagcgacgctgccaactccatcccccagggattgtgaagggggttccttctggctgtgacagtgctgaacgaggccagagagtgcagctgcctggaggcacaagcctcctcctgatccagggggctccagggagaccaaagcagctgtcaagatgagagaaattgaaaaagaaaatggaaaactctccagcctggctctcagcttctgcatctccatgcaagaccagagacccacatcactccctcactccacccagttccactccaacaatacctgggccctgccaggagtgagaaaacggtcctcttcctgtggataggttgctctctcctcttccagatcagggtattcattggtgctggggaatccacagccctcttcgccaagcaccactggctcagatgcagccccagagctgccccactgggccttcttcagtctgtggagactttaggctgaggagagaagtgcctggaggccaggcttcctgtctctccattcttcacctttctgttctgaaatacttcctgctgggactccagggagttgtcatttgacctttaaccctccactcccaattttctgctcccctcagactgaagcatattgtctaggaacccagaggtgaccccaacctccccactgtcctccagttctatggtttgctttcctgtcttcagtgatctagtttccactccttccagctcatgtggctcatcctccttactgcagttccctccttctttccatattacagaaatctgtttcaatcacaccaaagcccacagcttccttccaagcaacctcccctcaaagctcccctcaaacctcccctcaaagctgtcaaccccttccttagctcaaactgttctgcccccaaatcctgcatgactcccagaacccagatgtctcccttccttactcgttgatgatgctctgacgccttcttaggtcctccaggtggtaagtgacagccctcacccgggcggggactcccccaaggccctgctgctgcattccttccaaacatggcctcctcttctttcttctccaaagcatttcagggggtgggagctgctcaggaggatacagaccaagctgggagcaaccagtggctctctgtgccagagaatggggaaaaagagctagaaagaagaactggctctctcaagggagcttggattgaactaggtagggagtctggggtcttgggaagacccctgtgatctcgaaaacatgatgactgattcatagaaaggaaggcctggtcagtgcactggttggggaataacagagggaagcggtaataaggagagcttgggacaggacagcagtgggtgcaattttaacagagaaatgttaaacggcagagggtctgtcttaccagcatgggtggaatgtgctgctcctccagccaagtggggctgtgaagaacaaaaagggggctataagtgcagaggggacatgtccatccatattgcttctttaataatctctcccgacctcctttctgtcattaggagctacaatgtccaccagccagtgggaaattaaccgcagactagggcctattgctatatgggtttatggtagtttaatccagttaagaccacatccagttagtttccattttctcctctactcacgtgggcctttgattaaggttcttccagaagacatctccataacgctggggcatgggtctgaggctctgggaaggcaaccttgggggtggagatcggctgaccaccctggaacacctgaggtgaggacaaggtaggctcgggtctggctcttcccttacagcagtctactcatcccaaggattcaggggccatctttccatgggactataaagctgcccaggttccctcgggccatgtcctctcttaaccactttagctgaagaaggtggtaaggcctctgctttgaaaggaaattgaagctgggttgagggtggagattggctatagtttgaccctcagatctcactgagtttaagctctatatcggggatgtccaatcttttggcttcctgggccacattggaagaagaaaaattgtcttgggccacacataaagtacactaacactggccgggcgtggtggctcatgcctgtaatcccagcactttgggaggctgatgt

SEQ ID NO: 2647 - DNA, 4098 bp, Homo sapiens
tcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactgg

SEQ ID NO: 2648 - DNA, 1125 bp, Homo sapiens
atttatttcataggtctgttttaatttcatgtctcacagcatacattatttaaccaagaggtgctggacagagattgtaaaaagggaggaaacatttaggataagaaaccggctcaattccattagaatttgatcctatcttgtaaagtcttgctaggataaatttctataatacttcttttgtgcttacaaaaaaacattaacttctgaatttccaatgttgtaaataaaaaaattttacaattaggtatgcattcaattaacacacaaggcaaccaaataaattctgtcatcaacattagcataatgtgtatttcccgtcactgcactaacattaaactaaacttcaaaccacaaaaacattgtgactaacattaaaaaggcaagctgtaagatactcaaagcttataaaggacaaattgcacatggttaagatgggacatcatttgacaagggctggtgttgtgcatatggctgcttttttttataagaaggccaccggcaaacagggcaacaatgtcggcccccagccaaccacatcacaatgcaattctgatgaaacacatgaccacaaggcaaccccattagcaaacatccattttcaaaattctctaggcaaacaacacattcagtacagtgcagcatatcagcaggccaagttaaccaatcaggttccatatcttcattagtgttatatgatccatatgacctccccttcctttcacatgggctggtctgacaatatttattggcacatgaacaagcctcagcatcacagtgacttgctgttcctggagaattgtgaagtacgctttgcttatcttcaaatacttccttctcactactcaaagtgtctgtgttctcactttccgagtcattttcagtatcttgagacccctccgacatttcctcttcagactggactccaagacatttaaatcgccacattgtgttcagcattataaatggttttgatccgagaagctgcatgagcagttatccatttaaaaatgtgctctacttcaatcttgcgtccactgtattctttaagcatgactttcccttttgaagtacttgtttgtggaacagacataatgagtgtggatcggacccagcctcttctcc

SEQ ID NO: 2649 - DNA, 3587 bp, Homo sapiens
tgcagctccagggagggggtctgagtcgcctgtcaccatttccagggctgggaacgccggagagttggtctctccccttctactgcctccaacacggcggcggcggcggcggcggcggcggcacatggagggacccgggccggttttaaacctctcgtccgccgccgccgcaccccccgtggcccgggctccggaggccgctggaggaggcagccgttcggaggattattcgtcttctccccattccgctgccgccgctgccaggcctctggctgctgaggagaagcaggcccagtagctgccaccatccagcagctgctgccgcagccattacccggctgcggtccagagccaagcagcggctgagcgaggggcatcagctaccgccaagtccagagccatttccatcctgcagagccccgccaccagcagcttctgccatctctctcctcctttttcttcagccacaggctcccagacaggacagccatcatcaaagagatcgttagcagaaacaaaaggagatatcaagaggatggattcgacttagacttgacctatatttatctaaacattattgctatgggatttcctgcagaaagacttgaaggcgtatacaggaacaatattgatgatgtagtaaggtttttggattcaaagcataaaaaccattacaagatacacaatctttgtgctgaaagacattatgacaccgccaaatctaattacagagttgcgcaatatccttttgaagaccataacccaccacagctagaacttatcaaacccttttgtgaagatcttgaccaatggctaagtgaagatgacaatcatgttgcagcaattcactgtaaagctggaaagggacgaactggtataatgatttatgcatatttattacatcggggcaaatttttaaaggcacaagaggccctagatttctatggggaagtaaggaccagagacaaaaagggagtaactattcccagtcagaggcgctatgtgtattactatagctacctggtaaagaatcatgtggattatagaccagtggcactgttgtttcacaagatgatgtttgaaactattccaatgttcagtggcggaacttgcaatcctcagtttgtggtctgccagctaaaggtgaagatgtattcctccaattcaggacccacacgatgggaggacaagttcatgtattttgagttccctcagccgttacctgtgtgtggtgatatcaaagtagagttcttccacaaacagaacaagatgctaaaaaaggacaaaatgtttcacttttgggtaaatacattcttcataccaggaccagaggaaacctcagaaaaagtagaaaatggaagtctatgtgatcaagaaattgatagcatttgcagtatagagcgtgcagataatgacaaggagtatctagtacttactttaacaaaaaatgatcttgacaaagcaaataaagacaaagccaaccgatacttttctccaaattttaaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaacaaacttgaataaactgaaaagggacctttttttttaatggcaataggacattgtgtcagattaccagttatagaaacaattctcttttcgtgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccattttattccagttttataaaaagtggagacagactggtgtgtatacgtaggaattttttccttttgtgttctgtcaccaactgaagtggctaaagagctttgtgatatactggttcacatcatacccctttgcacttgtggcaacagataagtttgcagttagctaagagaagtttctgaagggttttgctgcattcttgcatgtatttgggttaggggaatggagggaatgctcagaaaggaaataattttatgctggactctggaccatataccatctccagctatttacacacacctttctttagcatgctacagttattaatctggacattcgaggaattggctgctgtcactgcttgttgttttcgcatttttttaaaagcatattggtgctagaaaaggcagctaaaggaagtgaatctgtattggggtacaggaatgaaccttctgcaacatcttaagatccacaaatgaagggatataaaaataatgtcatagataagaaacacagcaacaatgacttaaccatataaatgtggaggctatcaacaaagaatgggcttgaaacattataaaaattgacaatgatttgttaaatatgttttcttaattgtaacgacttctccatctcctgtgtaatcaaggccagtgctgaaagtcagatgctattagtacctacatcagtcaacaacttacacttattttactagttttcaatcatatacctgctgtgaatgcttcatgtgctgcctgcaagcttcttttttctcattaaatataaaatattttgtaatgctaaaaaaaaaaaaaagaacatagaagacaaacatcagaaataaacccatccactatggttaactcatttttgaatatggtgtaaagtcagtttaatgatgaaataatattattttcaacaaatagtacagaaattaaactatgcaaaaatactattaataatgatgttggatcattacctcacaccatacccccaaattaactcagaacatggcatacaccaaatataagagcaaaaactatgaaatttctagaagaagacagaaaaaaaattatgactttggcttagttgtttcttagaagtaacaggaaaagcataattcataaaagataaattgaaaaatcggacgtcatcaaaataaaaaatggtttatcttcaaagtcacctgttaagaaaatgagaagacaaatcataaagcagggagaaatttttgaaagtcatgtatctgataagggacagttaaaactaaataaaaacacaaaccatccaattaaaatgaataaagggttcgaataggtatgtcatcagagatcatataggaataaccaataagcaaacaaaagatgttcaatatcattagttattagagaaacaaaatttaaaaaccacaatgagatgacactacacatttgccagaatgatgattattaaaaaagaccaagtattggagaggatgtgaaaaaactggaacctcacacattgacgatagaaatgtaaaatgaaatagccaattcagaaaacattttacaagttttctttgtttttgtttttaatttattatacccttaccctatgactcagtaattccacttctag

SEQ ID NO: 2650 - DNA, 1396 bp, Homo sapiens
cctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatattttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccag

SEQ ID NO: 2651 - DNA, 595 bp, Homo sapiens
ctcttgtttcagcaaaccctgacttacgtctcctatttgacttgaggcggcacagtggccaagtcgattggccgtggcaagtgaccctccctgtggctgaagtgttctgaggactggcgagagaggcgcgccatgcttgccccctgttcaggttgggagcttggctgcttccgtctctgtctccgtcaggtccgactgtgggctggcgctgggcgctggtcttgctgggcttgccaagccaggccgtacagctcaggtaggggcgagcgctggcccggatcggagactgaggtccctccgcctggcccggcgcgccgaactctgaaggagtggacactgcaggtttagatatcaagtcatcagggtctggctgtgtagaagttcaaagtattgagggtgataattgcaaaattgaaacagagcatgggactagcatcttgcagtctgttaagggtcaaaaattgcatgttcaaacaaaaggaggcaaagtgatctgtctgggaacagtttatggaaatatagatattcatgcatcagataaaagtgtaagattgaaactttctttttttttagtaattgcaactttgcttccatt

SEQ ID NO: 2652 - DNA, 270 bp, Homo sapiens
caggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgaca

SEQ ID NO: 2653 - DNA, 2132 bp, Homo sapiens
tactgaggtgtactcccctcacatccttccagctgtgatgcctgtgctccttctcctccctaagagatcatggaagatggcaagcaccctgcccacccttacagaggccgggagagcagatgatgactggcaggtgaactctcacccacatccggcccaccctgtctggtacctctgactcccactgacttttccaccaggtgctgcctagcccagctgttgacttaactgacatctggagcacagtccatctggctcccaggaaaagatccacccacaccctctcccacatcactcggggattgagacaaaagtcacctgcctgaggcctacatggctagggtggctgccctctgggagtggaagggaagctgccagtttcggtctctactgataaggagtgagggaaacatggtcagtccctgaaggagaggcaactcccagcccacttgcttttcagtgcacaaagcccagtcatgaaagccactgactttattgatctaaaaaactttacaaggacagtgactgttctgccaaaaaaggagccaaatggtatcaaacggattgaaagtgagggtgggggtgagggatggggccgggaatccattcaggaaagctggtaactgtcaccagggaactggcaagggaaaaaggacgggggaggcatgcaagagcgagaatccaaaaaaaagttgaaatggttaggggagaaaactcccaaaagaccccggagtacgtcggaggtgagtacgacaatagcaatcttttccttcgtagaggacaggggaggagtccctactcggctgcaaactctggatgagggctggggattgagagcttcccagagagcatcacaagaaggcgtcgcaccactctcgaaggcatccgaagcagtcccgggactgcttggcgttggcgccacaagtgtctttcagccattcccggaagaggtcttcatctttctttagcaccagaaactggccaaggacaacataggcctgcaaaacagggaaaaggaaggagcgtgctgctcagtgctcagtgagagataagagcaagacagccattcctgtgccattcagagcacacaagcccaggaagcagcgcgggttttgcccccctctcctctccaccaggtgcccaggctctggcagcctcttcagattataccttactgtccatcccccagcagatggaatcacttcccttccaccccccgcttgcactaggtacacgcagccaccccacaccttgtcaaaacccctttcctccagcttcttgcccaggacttcaccaatcccagccaggctccccactggcttctcccccatgggctctgccacgaagtctcggtgcttttgggaggttgtcatcttgatcaggcttaatctaggaatcccaaaaaaaaggcagattagggctgaagacctggaacttctaagggcccacgagcaatctcatagtaagaggaagccaagccaggggttacagtggcttgctcgatccccctcatcctgaaaggagaaaacagttccagggagactcttccctactatttttaagaggagtttcttcctgcaggacctggattttgatcttgccccagaggaaaaacgatcctgcctaacaggtggcgcaagcggggcagtggaaagatgcccagagtccgtagccagggctgcgcggaagctatcactccctctgtgaccttggctgaaccaagacgacactgcctgcctggaacggccacttggcgtggaaagctaaccaaagggtctctctacctacagggcgaagcgcacacctagcgctgcgcacacccgctccccgcccgcggggttcacgccgcgccccagctccgcccccaccgcgctagtttgtctccggctgtagtgtgttgccagactgaacttctctgttgtgtgactatgctagacttggggtgtacaagcgtgttgagaaagatacggtttatttcaaactccttccagagaggttgccaggatgacttctctggagcatgcgtatagttttatattacactagtacttaagattataggagttactttttttttttttttttttttgagacggagtcttgctctgtcgcccaggctggagtgcagtggc

SEQ ID NO: 2654 - DNA, 1747 bp, Homo sapiens
ggctgatgcaggcagcacccttctgtagaagtagttgccttactgagaaaactttttgcctgagtgctggttcttcttttcggcaccgagcacttgtttctaacagagacatgtgccaccacgcccggttaatttttctatttttagtagagacgggattctgccctgttggccaggctggtctgaaactcctgacctcaagtgatttgcccacctcggcctcccaaagtgctggattacagggttagccacaacgcccagccatatttaattttaatatgtattatctttagaataatttcttttttgaaaatcttttggagtgttttactttctttcttgcccttgaaacctggcatatagcaggtgctcaacaaatattgaaggaaggaatgagggtgagagagagcagcggttttccaagggcccgcacaggaaagagacagaagggctccagttgtcttctgtaactgcccccagcagcttcaggctccaggcagggagcaaggaagctatcagtacctggcaatatcagattctgtgctgcgccccaccaccatgatgtcaactctatggatgcttttgtctttttttggccttgggagggaccccgtggcagaggctgcagagaccagactgggggcttgaagcaggccccttcgaggctactttctcagacctctgctctcagatgcttttactctccccaactcttaaggatccttcagagtactgcaagtactgctctgaatcacaaaacgtcagattgaaaccccaagggtgatgctccacaaatacagaccttgaggtccctgtgcatcagtcctttactgtgaagaaactccactgcctctgcgatctgcaggaagatgtgcagacacacgctcctctctctctcctctatggtacatcgtccattcatccagtctttgaggttttcttttctgcacagctgcatttgaatgtaaagatacacctttggtgaactgggctggagtttttctgtggtgtttttagtgagatctaaacttaaagtggttggtcttggaggagaaatagacaatgtagcttcagaagaagatttgctactggtgggcttgaaagcagttagtttattagcacaatggttgccaatatgcaatcgattagttttcggctcttctttactggaagcattatcacagccagaatcttcaaatactattgaagaggaggttctctcccttgaccttacataaggagaagcttcagaaggacaaagttcaaaggagtgcccctcatcattgccatccatagtcccatcttccacatcacagtctgtaaggcaactgtcctggaggttgtatgctgcatccactgactcactgatgtcctcatggtccattcctgagaattccagtggtgagaactggctctcagatgaacttgtctggtcacaggaaatccctactgaaaaagacctgcttctttgtggtgaaggagctatgatttcaatatgttcttttgtagcgaaaggatccattctgcgtattttaactgatggtgcatccattgggctaggagagctgagtggccagtctgtgctaaaagtgggagaaatacaaaggggtaagagtgaatatatattgattcaagtacctgaactgcaccctctgtttaaaaagcttcaactgtaataaggccacttaccaaatgacaacaaaacaacatacaaactaaataaaaacatgcaatgtgagatacagaa

SEQ ID NO: 2655 - DNA, 1761 bp, Homo sapiens
actcttgtgatcatggctgatgcaggcagcacccttctgtagaagtagttgccttactgagaaaactttttgcctgagtgctggttcttcttttcggcaccgagcacttgtttctaacagagacatgtgccaccacgcccggttaatttttctatttttagtagagacgggattctgccctgttggccaggctggtctgaaactcctgacctcaagtgatttgcccacctcggcctcccaaagtgctggattacagggttagccacaacgcccagccatatttaattttaatatgtattatctttagaataatttcttttttgaaaatcttttggagtgttttactttctttcttgcccttgaaacctggcatatagcaggtgctcaacaaatattgaaggaaggaatgagggtgagagagagcagcggttttccaagggcccgcacaggaaagagacagaagggctccagttgtcttctgtaactgcccccagcagcttcaggctccaggcagggagcaaggaagctatcagtacctggcaatatcagattctgtgctgcgccccaccaccatgatgtcaactctatggatgcttttgtctttttttggccttgggagggaccccgtggcagaggctgcagagaccagactgggggcttgaagcaggccccttcgaggctactttctcagacctctgctctcagatgcttttactctccccaactcttaaggatccttcagagtactgcaagtactgctctgaatcacaaaacgtcagattgaaaccccaagggtgatgctccacaaatacagaccttgaggtccctgtgcatcagtcctttactgtgaagaaactccactgcctctgcgatctgcaggaagatgtgcagacacacgctcctctctctctcctctatggtacatcgtccattcatccagtctttgaggttttcttttctgcacagctgcatttgaatgtaaagatacacctttggtgaactgggctggagtttttctgtggtgtttttagtgagatctaaacttaaagtggttggtcttggaggagaaatagacaatgtagcttcagaagaagatttgctactggtgggcttgaaagcagttagtttattagcacaatggttgccaatatgcaatcgattagttttcggctcttctttactggaagcattatcacagccagaatcttcaaatactattgaagaggaggttctctcccttgaccttacataaggagaagcttcagaaggacaaagttcaaaggagtgcccctcatcattgccatccatagtcccatcttccacatcacagtctgtaaggcaactgtcctggaggttgtatgctgcatccactgactcactgatgtcctcatggtccattcctgagaattccagtggtgagaactggctctcagatgaacttgtctggtcacaggaaatccctactgaaaaagacctgcttctttgtggtgaaggagctatgatttcaatatgttcttttgtagcgaaaggatccattctgcgtattttaactgatggtgcatccattgggctaggagagctgagtggccagtctgtgctaaaagtgggagaaatacaaaggggtaagagtgaatatatattgattcaagtacctgaactgcaccctctgtttaaaaagcttcaactgtaataaggccacttaccaaatgacaacaaaacaacatacaaactaaataaaaacatgcaatgtgagatacagaa

SEQ ID NO: 2656 - DNA, 317 bp, Homo sapiens
cttttgcagcgacgccgagcgccgggcgcggtggcgcgtgcctgtagtcccagctactcgggaggctgaggctggaggatcccttgagttcaggagttctgggctgtagtgcgctatgccgatcgggtgtccgcactgagttcggcatcaatatggtgacctcccgggagcgggggaccaccaggttgcctaaggaggggtgaaccggcccaggtcggaaacggagcaggtcaaaactcccgtgctgatcagtagtgggattgcgcctgtgaatagccactgcactccagcctgggcaacatagtgagaccctgcct

SEQ ID NO: 2657 - DNA, 22194 bp, Homo sapiens
ctttcgcgtctgcggtgcccggagtgtggtacttctcctagttgcagtcaggcttcatacgctattgtcctgcccgttagagcagccagcgggtacagaatggattttggaagagggagtcaccactggacctccaaggaagccacgtgcagacatctacaaccttcgatctcctgacgagtaagtctttgtctcctatgggtctactgtagaaaacacgtgctttgagaagctttagttttctaggaaaacgtgggatttaacaaagcactttctatcgagcatttattaggtatttaaaaaagtgttctgacggccgggcgctgtggctgacgcctgtaaccccagcacttggggaggccaaggcagatgggtcacctgaggtcaagatttggagaccagcctggccaacatggtgaaaccctgactctattaaaaatacagaaattagctgggcgtggtggtacgcgcctgtaatcccagcaactcacaaggctgaggcaggagaattgcccgaacccgggcggcggaggttgtagtgagttgagattgcgccactgccctacagtcggggcaacagagccagactccgtctcaaaaaaaaaaaaaaaagaaaaacatgttctgaatgttttattctcacagttcaaatattggaactaggtttctggtgaagaaacaggtttaagagaaatgcctgaagtgaaagaaccttgttagtgaagaggcgtttaacattttaatgccacttaaacatatttttggattccattcttcctgtgtgttggggcgcttaaatttccaagtggagggatgatttattgacatattttggaaagccaaatgtgtttttctgttgaactagccactcaaaccagtgcccgactacataactaatatttttgctagagtccaggagtgaggcgtttacaaagtctgggcttcatgggaacacatgtgaagcttattgttccagattgttcttttgtcaggtaacttgtggtaacttgtgttaaaatgcaatctcttggtacttgttcacttcccaactcagtaaatgccaactacttcctcaactcttccagccacactggcttctatcatgggcctgtactcagagtgtaagcactgaagacaggggtgtttggtttggctaccaagttattgccagctacaggatacaacacagaagtgctcaaacaccgaatgcaaatttgcaaatatgaagcataccaaccaaatcttactcctcatggctttcaaatcttactcctcactcaagaacttcctgctggcatatatgatgacttagcttttttccccgacagatcgactatgttgatctaacttttctaagccagtttctgtctgatatgccagcttgagcagctcctttgtcccagctcccctgggcatctagctgatgggagctcatttttctgttttttcatttcaggtttattgttggccaaaaccaggctttgattgaaccaggatgaatgcgggtgttggaagtagaatatatatatacatataaaattggtaagtggtgccaacacgtcttccctggctgagtagacacaggctctggagggggtagtagctgcttttcagtgtgggtttgtcaccctacttcttgtacgactcaaatgtggcctttgcagctgatgatacagcttctttccccatcagatcgaccctgttgatctctacactattggccagttttgtctgatgcattggccccagtaataactcctatctttgttttctgcttatctttatcagagactattgcttgttcatgggaactgggctttctctattttttccagcattcagatggcttcttttgacctgttaactttctataggttgggagccacgtgtaccagtgtgtgttgatcttggcttgattcagtctgccttgtaacaggtgaggtttctgctttctatctgccaaaccccaccgcaaaatttgtccaactgggcctaacctcaggacccatttccaagttgggtataaaactgggagaataagtcattaggactgacattggcctgttggtattactaggtctttgttggaaataagagcttggagttccaaagaaaacgagcacttgaacaaaagatttctcagcaaggcaaatttacttctgccgtagggtgctgctgctggcattcctggcaagagcacacctaacaaaagagagaaagggtttttattcctaacaagtagtccctgcttctgtgtcctatccccattggctggagtcgacagcgcaatctaaactagtcctgattggctattttaaacaggaggcatgtgggttacagctgtgggaagggcaggaaacttgtttacagagctggttgctaggagtgagggggacttttccaaatagggaacaggttacaggttgagattggccggagaagttgtttatagaacgggtaactcggagcaggaaggtatgaggaagttgaccttaagaacaaagaacaaggaagttaaaactttgaagagaaatccattgtatctaacgatttcccccttttgatttttataattatttctcttcagacttgttttagcgtgtcttgattttgttcctcttggtcctctgaaattagaagcttaactgaatgatgcgagggaggattgaggaagattttggtgggtgagagctgttaaaataagcttttgtattaatcctcagatacagggtatgatacagcatcctacaagaatgagcaaacctattctgatggcaggagattgaggacgtaagtcctttccatttgcggaactatttttccattaaaatcgtgaaggggtcatttattccagaatttctagctagctcattggataaagcagtaagtccttgggcctttgttatggttccatcgggagcagtattattagggatgaaagtacaacactgggttccaatcatgacacaaactacacctttctccgctagtatcatgtctaatgctattgtattttctcaggccgtttgactggtgggccctaattgttaaactgttcccttaatagcatccctagtataattaatgaatcgttgctgggttacattttttgtgttttttttgagatggagtctcactctgtcgcccaggctggagtgcaatggtgcaatggttcactgcaacttccacctcctgggttcaacctactctccttcagcctcctgagtagctgggggctgtcaccatgttggtcaggctggtctcaaactcctgatcttgtgatccacccgcctcagcctcctaacatgctgggattacaggcgtgtgccaccactcccggcccaatctacatttttatttagagttgaccaccagaacaacatggattcaaacttgcagctatttgattttgggccttaaatctatctggcactcctcgtgggattccaatggcatctatataaacatgagagtcacgagggacatccattgttttatgatgttctgtttttatgtatgttttctggatgaaataccagggtgaaagggagatagccaattggattagagctcaagtgccacgccaagtaacttggcagagtattcagtaatggtccaccacaacaccaccatacgtttgcttggggatgaataagggacgactgattggtaagctcctggaagggcttaagctcactgcatctcgttaggtctccaagcaaattcaagttctccccctgtgagagacacgaggtaaaattggcattggaagacggatgcttgatggccctcgggggctgacccgcagggtgtcggacttcaggggacttcaggaaacagcagcgagagagtttggcatagcttattgccccaggttgtggggtcttggaagagagctgccatacaacttaatgcctgatcggctggaggacgatccgagtggaaagggaacaatctggggctctggcttaccacgtgcgtaagcataacaatcgctttgtttagcgagcggacagaatgtttaatccattccagccatgcatttgcatctcggtaccgtttcaattggtagagtttgctttagatctttaacctctacaatggtcactttggttttgtcattgggtgtttgtttagaaggggatgaagggggtgggggaacaatgaagcgcatttcgaaagatcctgtagggtctatccctaatgttgcggctcccatgctgtagaagctacttaaagtgggattaggattggtggaggtagaggtaagaatagaaatttgcactgggttacattggtgatattggcaattagagggggccttccctttgaaacgaaggtagggttgtagagagatgcagctttttggggaagtctacccttgaggatcggtattccataggacgtcattccgggatgggcagaacctctcctcaaacccttcccattcccaaactgcaaagaatgtaatggatttagtttcgattaggcaagcattgtgtgaggatttagaatttatcttggaagggcagagatatttttctgagaaggccagttgcctctggttttggagatccccacaggatatgacaagacaggcatcaaatgtgattgaggtgagcttgatctagttacattaatgataaaatagctgacggtagagagaggaaagaagacaaggcagtataagagggttaaagttttcgtagctttaggttggtagaaattggccctggaacaatagcccatgactctgaagatggtgatgctgttttgactggggtatgatgggtccaccccttttcggctgttcgggctgctgtttcagttaggagtgctaggtatggtccttcccaagctggctccttccagcttttgataaggatgtgatctccaggctggtattgatgtaccaggaactgtaagggtggcatctgtgctaaaatacctttagttctgaggtaagagaaagtggaaagccaagtatataatttgatcctttgtttcaaaggtaggaatgtcagtagtaagagtgtaaataaggcagtccacataacagagagataggccagtatctttctgagaggcagtcctgactgaattaggtgaatctgtaaacccttggggtaggactctccattggtactgctgcttccatccagaatgagggttttcccactcaaaagcaaatacttctcttgtcttcagccaagggacatgcccagaaggcatcttttaaatctgttactctgaaccattgattgtcatggaattctgctgaggatggtaaaaggattggggacaacagggtgggtagtctggactatttggttgatagcctggagatcttgtactagttgatgagacctgtctgatttctttacaggtaatactggggtgttaatagggggacatacagggttcagggaatcagtcctgaatgagaacttcaactacaggctttaattctattctgccctctaggggaatgggatattacctttttcttactatttcccctggggtctttaactttgtatggattggagtgacttgaagtttctttttttctttcttttttttttttgagttggagtctctgtcacccaagctggagtgcaatggtgtgatcttaagccactgcaacctttgcctcctgggttcaaacaattctcctgcctcggcctcctgagtagctgggattacaggcgcctgccactgcacccagctaatttttgtatttttagtagagatggggtttcaccatgttggccaggctggtctcaaactcctgacctcgtgatccacccaccttggcctcccaaagtgctggtatttcaagtgtgagccagcaagcccagcctccctgatttctttttcctgcccatacatgaggatgaatgtatttttcttctgcggtggtaagtctcttcctaataagttcgttcctgcctcagggattaacaggaatttaacatgggctgatcaatttttgtatagacctctgtcttttaagatttttgctttaaatcttttatccctgagatagaaagttcttctgaagaacaggtgatagataccagatgggagggaacgggagcgagctgctgctgaatctgtaagaaggttttaagttcacatttgggtcccacctctaaatttatcaggggctcttggtgggactcaaggtaaaagagacagcccctgacctccctattttcctggaaggccataagtggaatattttttctttttcccatttggggcattctcttttgaagtgacctactcttccacatttgaaacatttgttttcccctcttccctgtcctgcactgtgacttccaggttttattcccttactccttgtatacagtttggtcgctggtggcctagagggtttgtaagttttacttccttgtgtctcctactgcagagttctctgttgtaaggtagacagcatgatttttgccttttgtttctgctgctctttgtccctacttatatgcttctctaagaagttagtctctgggacaatctttccaattctctatcttttgtagttgtttttagaggtgtttggccaagtcttagtaacaaaatgaagctttagcatcccttgccccagtgggtcttccatttctaaacctgcatattttctcatctgttctttaagcctatttaggaattcatgggtccttcatccatcccttgtatgttgaatgcttgggaaatactctcagttcgggatactgatggaacattttgaccggtagggtgttaatgttcccagactaccaaagcagccctatggatcatggttcttctcccaagaagggaatgcctaaaatggacataagctcggcccatacaactggggtcctaaaaaatgatttgatctgctaccccataagggtcatctaacaagggcttgagtttttctttttttttagattttgtacttctgagctggttaagggggcatttacgaagctgatgcctcctctcccaaggggcacttcttcaaggggaagagagttgggggcaattctttggaggtggaaaggggaaagggaagttctgagtatcctttttacattgttctatttcatgctgtagggcttaagtgtgtggctagggggaacatggggtattgattcaggattatatgggggagggactgatgagtggggggatcctgtgtaccggcttgatgcatggggtttggcagaggcaagtggtctggtgggtcccatatgttagcaggctgttcgggggtagagaccttactcctttcagaggagttggcttctggcttgcttcctgtagttatgtttagtcctttcactatccttttagcatgagaacctaggggactgtcagaggggatgttactgtcattaatttgatcctttctatttactgtctttcttgaggtattttgcataatgaaggtttggtgtgaggcccaaaattagatttattgcctttcctcataggctcaacctcccttactggagatttcttgccattcctttctctagagggtcagcccctggctactggagatttcttgcactcttctccttttgcttcatccttctctggctgcttcccaggagggaatatttcaggtcctccttagcattggtgtgtcagtataagccccatgacaggaatccaccataagctatacgaggtgaccatggaatcacagatccggaatcatcgctcgcttcgcactcagttgtgcgtctcattgacacactttcaacctctaaaatgccctgaccaccaaggaaatactttgtcgcccctgtgacttttcttaacttggtctgtgcagttacctggtcaccgcagtatgtgaggatcctttccgcctgtgttgctgagagtctgggtttatgtgtcaccttgggtgggacccaatctcctgtttgtgaggccaccgcaaagaggtggtgggatgcctctcctcaagagaggtgatcgtgggcttctcctgaaggagaacggtaatcccagatgagctcccaaattgttggcaataagagctcagagttgcaaagaaaatgatctccaaaagatttctcagcaaggcagatttacttctgcagaatggtgctgcttgcactcctggtcacagtgagagcaccccgaacaaaggaggtgaagtggtttttatccctaacacagctagttcctgcttctgtgttctatccccattggctagagtccaatctaaactagtcctgattggctattttaaacaggaggggtgtgggttacagcagtgggaagagcagttgccacgagcgagggagacttttccagataaggaacaaatgcgggttacaggttgggattggtgggagaaatgtttacagaatgggtaattaggagtgggaaggtatgaggaagttgaccttaagaacaaagaacaaggaagttaaactttgaagagaaacccatcatacctaacagtcttgtaagaaaggatgacaaagtgattgaacattgggtggagctaattttccttggccaattcacttagtaagataaggagctccaaatcatatttaagttgggagtcaattgattttacttaattcttgtgaggttcagttataagattcatcatactactaccatgagccatcctcagctccttgttacatgggcctgttaacatggcagctttgtctataagcaaacccaggagagaaagacatagcagagatggatgtttgaagtctataccttccaccccctttaaagagaaagtaacaccactccttttctgtgtcccttggggacactacctccatgtctggtcacatggctggactttacagcagataagcatactgtggcctgagaccatgattgtatgctttccttctgctgacctttacaatccctcaataaattgagctaacacagggaagcttttttaccaaataactgtgttgcatcatcctccagtttgcctggtgtccttaatcaatggaaggggaataagcaaactgagttttcttacaccttttgagtatagtgtttttgccatcatagatgtggctcctcataattctccaacttttatattaaaaaaccaaaacctcaaaaattgtagttcatgtcagtcagtgatgactcatcttagaagtattttgtttttggatgtgtgaatgtgcatagttcttaaagtccaacattcatgtaataagacatcttgcatataacaatgacccttacgtctaagatgttaaatagatcctaagcctggtataactttattcaagtatccttatttgcccctaaaatgtctttaatacacattacttgggttatttcttgaatgaacatacaggtatcccaatttctgtttttaagagaatggggtcttgctctgtcacccaggctggagtgcagtggtgcagtcatggcttactgcatccatgatcctcctgcctcagcctcccaagtagatgggactgaaagcacacactgccatccctggctaatgttttcatattttgtagagttgcagccttgctacgtgacccaggctggagtgtagtagctattcacaggcatgattgcttgaaactcatggcttcaagggaaactcccaccctcaatatcctcagtagctgcaactacagccataccccccactgctcagcttctcatcctttaaaagatttttactggtagtgtcctcattctgggtttttgtcttctgtgtttactgtgacatgaagtcatttttagatgaaggttaaacattttgccaacgcaggtacaatatgggattcaataaaagtacagaattaaagttgtcttattagagattgggaagtttcccagctccgtttatcggtacttggccgtaccgataaaggggatggacttggagtgaccaggtcttagtcacatgtattttcataccctaaacaagaagcggtatagaccagaatggagcactgattgtaatccaccttctttcttagaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatcttttaaatcaaaatgctgttttgtttggccattggagataaccattgaacagggataacaagtagtagttaggtatttgcagtttcatttggttttagttttttgaggggagaatcaccctagtgggcagttggtttctgtgggcaaagcctgctttccacaggtattgtgcctcgtgattggcttctgcattggaaacctaagaataagcaagcacacttgggccagaattcaaagcagagggtcaatacagaggtatctcacttgtatgcttacacctgcacaagatcgtgtatgttaaatcgtgggtattaggccttaatggttgcatgagatgagtaaggatgatgtgggctatggtatttgtttataaacttcataggaaattgcaaaaataggctgcatcatttatcaatatgtgatgattttttatttaaaatacacagtgaataattttttaagtatcttaaaatctcacctcaaagatgggacctctagatttcttttttttttctgaggcagagtctcgctgtgtcacccaggctggagtgcagtggcatgatctcagctcactgcgagctctgcttcctgggttcacattctcctgcctcagcctcccaagtagctgggactacaggtgcccgtcaccacgcccggctaattttttgtatttttagtagagacgggttttcgctgttttagccaggatggtcttgatctcctgaccttgtgatctgcccacttcggcctcccaaagtgctgggataacaggcatgagccactgcgcccagcctgggacctctagatttctaaaatgactcctggtattgactcagaatcccctccccttgactaggctggacctagtgtaacttctgagacttgctagctctttttctcattctccttggcttgctcactttttttttttttttttgagatctcagctcactgcaacctccgtcccctgggtttaagcaaattctcctgcctcaccctcccgagtagcttggattaccacgcctggctaatttttgtatatttagtagagggggttcaccatgttggccaggctggtcttgaactcctgacctcaagtgatctgcctgcgtcaagcctcccaaagtgttggaattacaggcgtgagccaccacgcctggcctagcttgctcacttttaattaagctgccatgttgggagaggccagcgtagcaatcaactgaggttgaaccattagtgtgggaggagttacccaacaaccatgtgagtttgtaagcacgtctttctgtagcggaggcttgtgagaaaccctgagagcggacccacccagattgtgcttggatttctgacctatgggaaatgtatttcaagccactaggttttgagataacttgctacaaagcagtaaattcacaactctataatgcccactctaaaggtcctgacatgggcatctccattacctaagtcaactgatgctacttcaatttctccacgtagcatttgaagcgtttatgtctggccccagcctacattttcagacttatttgtgcatttgacttaacatgtccaaaactaaatgcctgatgcttcactcacctaaccccattccctgcaagtctgtgcttcctgcgatcttcccttcccaggtattggcaacaccagaagtccagttggtcaggagctgtggaatcaacctcatgtaccatgtgaatcccttggcaaatgctattggttctaccttcaaaatacatctgaaacccaccccctcttagcgtcttcattgctaccaccttggtacaaaccatcaaacaagcttggaatactggtctctacttcagcctttgctccctacgatcaattgagatgcaaccagagcgatctgtgaaaacctgaattaggtatggagctctctgctcagaagcctccagtgtcttccccacctcacacagtaaaagccaaagtccatcagggcctacatgatcttccccttcccttaacctctaacttcatctcttccctttcaatcttagccacatgggccccctgacttctccattcctttaggattactccaacctcagtatcttagcacttgattttcccactgcctggaatgatcagccctagacccccagagctttgcacagccctctgccttgtgtcattcaggtatttgctctcactccctctggggaactgtctaatcatctctatcactttctattcccttatcttgttttttatttttttaaatagaaactgttgctcaggcgggtctcaaactcctgggcttaagggatcctccctatttggcctcccaaagtgctagaattacaggcatgagccaccatgcctggccatgtttttacttagtgcctaacaggtactgcctatgtgtatagtatatacatgcatgtacatatacatctatgtatatgtgtatatatagtttgtcatacagctgttaagtggcagagcatgcatttgattctgtcagtctgctcttgtatttgtggggtgtttgttttgttttttgagacggagtcttgctgtgtcccccaggctggagtgcaatctcagctccctataaccttcgcctcttgggttcaagggattctcctgtttcagcctcctgagtagctgggattacagaagcctgcacggtgccccttaatttttgtatttttagtagaggtggggtttcaccatgttggccagactggtctcgaactcctgacctcaagtgatccacctgcctaggcctcccaaagtgctgggattacaggcatgacccacgtgcctggcctggcacttgtatttgtaacccttggcttaattgcaacatgttacttcaatgcagtctaatggatacaggaaggagataatttctggctcttaaaagctcaaatgcttttgctggacttctgtgttgatgagataccactgaggtcagaaatggccccaaatacctgccagccaggggccagagaagcttcctggagaactcccagccacacccatagtctcagctttgctgttgcttctctgagctccaaggcagttgtaggcctctaatgatcaaactattggcaacccgtctctagctttagctcctaccagtcccaccaaacatttgatgcttcagtctcgttttacctctttgtcttattgactgaggagtcctttccttctataagcttcagtttcctcatctgtgaaatgaggtttattgggtgcttgccacgtgccaatattgtgctattatctcatttaatctataccccaactctgttattaccctattttatagatagcaaaacaggctcagggaggtttggtgagttcatgtaccttgaaggtggttcttgaaagctgggatgtgaaccagtactatcctaggcccctaatttccaagggcctttgcttaagaccctcaccaactgcatgggtaaaagcacaagcatggccaggcgcggtggctcacgcctgtaatcccagcactttgggaggccgagccgggcagatcacaaggtcaagagattgagaccatcctggccaacatggtgaaaacccgtctctactaaaaatacaaaaattggctgggcgtggtggcccgtgcctgtagtcccagctacttggcaggctgaggcaggagaatcacttgaaccctggaggtggaggttacagtgagccgagattgcaccactgcactacaccttgacaatggagtgagactccatctcaaaataaaaacaaaacaaaaacaaagaaaaacccacacaagcatttctggaaagctgtgggaaaaaataagagattcacaatgtcttccagaattttagctgagaggtggtggtattatctcccccataccccactactcattttctgggaacagagcagttttacaaatggtttggagcttgggcttattcccagctcctggcagacagcagtaacttccccagatctcctatctgtaaagtgggcataacatgtctttcctcctggagttactgtgaggatcaagtgagacaatgtgtcctctaaatgcttgaccacagggttaggtcagtaattgttgcgggaagtcagggaccccaaacggagggaccgcctgaagccatgacagaagaacgtggattgtgaagattttatggacatttattagttctccaagttaatacttttgtaatttcttacgcctgtctttactgcaatctctaaacgtaaattgtaaagatttcatggacttccccaatcaatacccttgtgatttcctatgcctgtctttactttaatctcttaatcctgtcagttgaggaggatgtatatcgttccaggaccctgtaataattgcgttaactacaaaaattgtacagcatgtgtgtttgagcaatatgaaatgtgggcatcctgaaaaaagaacaggataacagcaattgttcagggaataagagagataaccttaaactctgactgctggtgagccgcgcagaacagtcatatttctcttctttcaaaagcaaatgggagaaatatcgctgaattctttttctcagcatggaacatccctgagaaagagaatgtgcacctagggataggtatctgaactggccccaccggggcgtacctgtctcttatggtcgagattgcagaggtgaaataaactccggtctcccatagcgctcccaggcttattaggaagaggaaattcctgcctaataaattttggttgatctcaaaaccctgtctcctgataagatgttatcaatgacaatggtgcccgaaacttcattagcaattttaatttcgcctcggtcctgtggtcctgtgatctcgccctgcctccacttgccttgtgatattctattaccctgttaagtacttgatgtctgtcacccacgcctattcacacactccctccccttttgaaaatccctaacaaaaacttggctggtttttgtggcttgtggggcatcacggatcctaccaacgtgtgatatcacccccggacgcccagctttaaaatttctctcttttgtactctgtccctttatttctcaagccagctgatgcttaggaaaatagaaaagaacctacgtgattatcagggcaggtcccccgataagtaatagtcatcttcatccgagtgaaaaggaataaactagtgattgtgcaacaacttggatgaaccccagagatgcgatgctgactgagggaagccagcctcaaatggttacatgctgtgtgattccatttatttgacattctggaaaagacaaaggtatgatgaagggaagagatgatggtgttgccagaagttaggatgggtggcggatgtggatgtaaagggatcgcacaaggaagtgtttggggtgtcatgattgccgtagtggttatatgaatgtactgggccaggcatggtggctcacgcctgtaatcccagcactttgggaggcccaggtgggtggatcacctgaggttaggaatttgagaccaccccggccaacatcgtgaaaccccatctctccatctctactaaaaatacaaaaattagctaggcgtggtggcgcgtgcctgtaatcccagctacttgggaggctgaggcaggagaatcacttgaacctggaaggtggaggctgcagtgagctgagatcgcaccattgcactccagcctgggcaatagagtgagactccgtctcgaaacaaaacaaaaacccagatttatagaactgtacagcaaaataaaaaaatagttttattgtatgacaatttttttattatttatttttgagacagggtcttgctctgtcacccaggctggagtgcaatggtgcgatcttagctcactgcagcctccaccttccgggttcaagcaatcctcccacctcagcctcctgagtagctgtgactacaggtgcgtgctaccacactcagctaatttttaaatttttttagagataggggtctcactatgttgctggagttgatctcaaactcctggtctcaagtgatcctcctgcctcaccctccgaaagtgctttttaaaaatgttaaaaacaaacataggctctggagctagacttgggtttaaatcccggctctgttatgtattagccattggctcaatcttctttttcttttcctagattttgcctgcctgagctcctctagtagtggccacaattgccagagaagatagagcaggtctctcccaggacttgcagctccagcctgtgtctgcaaggggtgttgtagcgactgatttctccagcccatggcaagaggccttcatcttgtgcctggaaagagggaagtacaagtccgtctggcagagatggtgcagatgggcaagtttttcagacactgcagccagcacttctgggaccgcagcagtggagcctgcagagggccggttctccaggcatgggctactgacattgtcacttccagactccttatgcaataaacaacccctaaacagatttattcacaatttctccatcctaacaagtcagtgatcagttttcacttttccacattcccttctgtccccattatgttcccatagtggggcagcttctacctgcatggttggagcttcccatttttaaagaggcaagaaatcctttaaagttctttgaaatgtttgtagcctgttccaattttataaactgtgaagactgagcaacacacaatgcatgggcctcatatggcctggaggccaccagttggagacctctgtagcttgagctgtgtccctttcagcactgttcttgtcattcctgagctgggatgccccctgaaacataggatgctcagttaaatttgaatttctttttttttttccttgaaatggagtgtcgctctgtcgccaggctggagtgctgtggcgtgatctcagctcactgcaacctccacctccctagttcaagtgattctcctgcctcagcctcccgagtagctgggattacaggcatgcaccaccacacccagctaatttttgtatttttagtagagacagagtttcaccatgttggccaggatggtcttgatctcctaacctcatgatctgcccgcctcggcctcccaaagtgctgtgattacaggtgtgaaccactgcgcccggccgatggcaatcattctttaagatgcagcctccgtggacctcgtaccttctcagtaatttccatattctttgctgacttgggtttttcctccaaaattgtctgggataaattgaggtttgtggagtttcctgatggctagtttccaaactggcttcaaagcctgggcttgtggaattggctgggtctgcggccagcctaacccatccttcggtcacagtctcccatggtcctgatattaattcatcacaggtctgtttagaaggtggcagaaacagacggtcttgggcttatttatatctgtggctttttttaaaagacagaaaaggagaaatctggatcctttccttgtcagcctcctttaactaaatggtcttttgctaaaatagactggccccactgtgtgggtaggaagggttgagatgggagtgggccaagtgagtgagaactttttttttttgccttgatgttaaaatggcagcatgtgcagtcttctgcctctgcccaggttgacctgatgtttttacagggagagaggctgcttgttgagtgtggtggtatttatcatagtgtatgttaggctgcctcaaacatccctcgctgtcgtacctttcagccaactctaatgtacctctctcagcctgatttctccccacttgagttataataacaacaactgccttttaaaaaatttcctactgggcttcatgctaggtactttccacgttttatttttatttatttattttttgagacagagtctcactctgtcacccacgctggagtgcagtggtgtgatcgcagctcactgcagcctcaaactcctgggctcaagcgagcctcctgcctcagcctcccgaatagctgggactacaggtttgtgctactgtgcccggctaatttttctatttttttgtagagacagtgtctccctttgtttcccaggctgatctctcctgggctcaagcgatcctcctgcctcaacctcccaaagtattgggattactggtgtgagccaccattatatgttttaaataatttattcctcacctcaagtgagtgaggtaacatcccagttttacagacaaggaaacagattgggcaggggaagtgacttgcctcagatgcacaataaatggctctgccagtgtcttccttagcgcctccgatccccttctcacccttgtcctctctgctcctctctgctcaatgctcctgggagcgtgaactgcattaatggctccttgtctggtggcctcaaggttccccaggaggcagggagggtgaggctgagatgtgtgctcccctaaggcacatgcctcagcctggctgcctctgtctaaggccacagcccctcaagtgcttccccacctgactttctgggctctggtaaccgcttcctgcctgccccatcaggtgtagggggtgcttcatgggtcaacattagcttatgtggtttccttatatcctgggcgcacctttgttagtctcaaattacattctgcttgaactattctctatccagtgggttgtgactatctagaggcagagttgggatttgaaccccaagacttcaaaataagctctgtgcaaatggcctcccagagctgcctgctggtttcttctgcgaggcctggcttctccattttggcttggaccatggcctgctgtcatttccacaacagttgcaggaagttgccaaatgcgttttctgtgactgccaggctggtgaccctgttaaaaacaaagcaacaacaaaaaaagcaatttcttcaattaaaattacaaaacagaaaaaaaaaaagatgtcacacttgggggaagctggttgaagtgtacttgatattctacatactattttcgcagttctctgtgaatcaatagttatttccaaataaaatgttaaaaaaaactttattactaaatcagaaaaaaacaacaacaaacaacaacaaaaaccaaagcagaatatgtggtgcactgttgagggaagtacagaaggataaaaacaagaaaatactgacacaactcagactccactgttgaaccttattttattttatatacttctaggtcttttttttttttttttttgagaagagtctcagctcactgcaacctctgcctcccaggttcaagcgattctcctgcctcagcctcccgagtagctgggattacaggtgcctgccaccatgcctggctaatttttgtatttttagtagagacggggtttcaccatgttgtgcaggctggtctcgaactcctgattcaggtgattcgcccgcctcggcctcccaaagtgctgggattacaggtgtgagccactgcgtcaggccacttctaggtctttttctacatgtttatatatacactgtatgtattctttaccaaagtgggatcataccataatgctgttttttttttgttttgttttgttttttgtttttgtttttaagacagtcttactctgtttcccaggctggaatgcagtggtgtgatctcggctcactgcaatctctgcctcccaggttcaagtgattctcctgcctcagcctcccgagtagttgggactacaggtgcccaccaccacgcccagctaatttttgtatttttggtagggacggggttttgctgtgttggccacactggtctcgaattcccaacctcatgtgatccacctgccttggcctcccaaagtgctgggattctaggtgtaagccaccacgcccggcctatagtgctgttttgtaacctctgtcagttaaccatctccattttttcacatcaataaatttcccatttgtccacaaaagtcctgtacagctggcagaggatatgtgtgactggaggccattaggtccttcaggttcttccagcctagcaccaccctttcttcccctttaccataggggcttgtcctagagaacgtctcaccttctggattcatctgagtgttgccttctgggggtgtcacttcatttgttcctctgtatcctgcatcccctgtaaattggagagtcaatctaaagttttgataagatcaagttaaatattttggcaagaaagcgtcatacatgatgatgctgggcacatcaggtgacatcacattttatatttaatggacaaataaaagttgtatatatttactgtgtacaacacgatgttttggaatatgtatatgttgtggaatggctaaatcaagctaattaaaatatgcattacttcactttttttttttttaagagacagagttttgctctcgttacccaggctggagtacagtggcatgatctcggctcactgcatcctctgcctccagggttcaagcgattcttctgcttcagcctcccaagtaggtgggattacatctgccaccatgcccggttaattttttgtatttagtagagacgggtttcaccattttgctcaggctggtctcaaactcctgacttcaggtgatctgcccccctcggcctcccaaagtgctgtgattgcaggcatgatacttcacttattttttgtgataagaacacaaaatctcttgagcaatttttaagtacacagtatattcttattgactatagtcaccatgatgtacaatagagctcttgaagttattcctcttgtttaactggaaatttgtaccctttgatcaatatctcctgaaaacaattttctctgcttctctcttatgactttgacttatatgtgtagatgccacatagaagtgatatcttccagcctgggcaacagagtgagattctggttttgtttgtttgtttcttttttttttttggagacagtctcactctgtggcccaggatgatctcggctcactgcaattctgcctcctgggctcaggtggtcctcccacttcagcctcccgagtagctgggactacaggcatgcaccactacgcctggctaatttttgtatttttttgtagagatgggttttgccaggttgcccaggctgatcttgaactcctgggctcaagcgatctctgcctgcctaggcctcccaaagtgctgggatttcaggcgtgagccaccatgctcagctgagactgtttctaagacagtctcactctgttgcccaggctggagtgcagtggcgggatcttggctcactgcaacctctgcctcctgggttcaagtgattttcctgcctcagcctcctgagtagctgggactacacgtgcccaccaccacgcccagcgaatttttgtatttttagtagagacggggtttcgccatgttagccaggctggtcttcaactctcgacctcaagtgatccacctgcctcggcctcccaaagtgttaggattacaggtgtgagccaccatgtctggcctcacacagaattttaaaaacacattttaaaagtgtattcaagggttgacatgcaatagaattagcaatttttactgctttatcaaggacattcctaagtgaaactggctctcttcttgttactgtgggcttgtaggggtgaagaatacagtgattactaatagaattaggtgccaccactttgattcatgctaaggagccagcagctttgtcctctgttgtttttgtaccatttaacgcaaatgtcacaggggaatgttaaaagataaagtcttactatcattatgaaaattcttggccgggcgcggtagctcacgcgtaatcctagcactctgggaggccgaggcgggtggatcatgaggtcaggagattgagacgatcctggccaacacggtgaaaacccatctctactaaaaatacagaaaattaggcgagcatggtggcaggcgcctgtagtcccagctactcaggaggctgaggcaggagaat

SEQ ID NO: 2658 - DNA, 1251 bp, Homo sapiens
ccacaatgcgcaggcgtcatcgctcacttctcccctcccggcttctgctccacctgacgcctgcgcagtaagtaagcctgccagacacgctgtggcggctgcctgaagctagtgagtcgcggcgccgcgcacttgtggttgggtcagtgccgcgcgccgctcggtcgttaccgcgaggcgctggtggccttcaggctggacggcgcgggtcagccctggtttgccggcttctgggtctttgaacagccgcgatgtcgatcttcacccccaccaaccagatccgcctaaccaatgtggccgtggtacggatgaagcgcgccaggaagcgcttcgaaatcgcctgctacaaaaacaaggtcgtcggctggcggagcggcttattttgactaaaggagaagttcaagtatcagataaagacacacacaactggagcagatgtttagggacattgcaattattgtggcagacaaatgtgtgactcctgaaacaaagagaccatacaccgtgatccttattgagagagccatgaaggacatccactatttggtgaaaaccaacaggagtacaaaacagcaggtatgtctgattgacctgggctgcttccgagaaattgatgagctaataaaaaaggaaaccaaaggcaaaggttctttggaagtactcaatctgaaagatttgaagaaggagatgagaaatttgaatgacacccatcagtctcttcacctctaaaacactaaagtgttttcgtttccaacagcactgtttcatgtctgtggtctgccaaatacttgctcaaactatttgacattttctatctttgtgttaacagtggacacagcaaggctttcctacataagtataataatgtgggaatgatttggttttaattataaactggggtctaaatcctaaagcaaaattgaaactccaggatgcaaaatccagagtggcattttgctactctgtctcatgccttgatagctttccaaaatgaaagttacttgaggcagctcttgtgggtgaaaagttttttgtacagtagagtaagattattaggggtatgtctatacgacaaaaggggggtctttcctaaaaaagaaaacatgatgcttcatttctacttaatggaacttgtgttctgagggtcattatggtatcgtaatataaagcttggatgatgttcctgattatctgagaaacagatatagaaaaattgtgtcggacttaaataattttcgttgaacatgctgc

SEQ ID NO: 2659 - DNA, 7569 bp, Homo sapiens
attgcagctgcctctcccgccgagttggagacggatgggctgggacgggttttgggggggtgtccccaattctgactgggagtggaggaacccctcctgagatctcttgtgggggtgccccctccccagggcactccccagtccctgagccagccgagaggaaggaggccagcgatgcgactggggcggctcctttctcctgcaccccaaatgtgagggatgcaccctaaattttgctcttttcaaaataggggaccaggatctcaggggagagtagctgaggccttgctcggagtcccaggagatccacaggtccggcatgaacagtgagaggtcagaggtggaaggctcagcaggagaggagaggaggatcagcagaggtcatgagaaggccagaatccagggtcaggctgtctggaacaggaagtaaaatgggccgagatggagcgagcccccagtgtgcttccaaggccactcccacctccctgaaacaccctgctacgtactgatccaatgccctgcgctgtgtatgagagcaccttctcttctgaaacccctatacaagggaggggcccctgcggagaccgtgccctgccatccaggtgagccctttctccccaaccccgtcagctgtgtgggaggaggaggactcctaccctggtcgaagttgagtttcttagctggaggagtttctcctagcccttcaatatccaccacgtcactgttggcatcggagtcgttcagagcactgagtgtcacatctgggaagggggcataagctaggttctaggttcccctgacagcctctcccccagccccaagcttcccaaagctttgtgcctcctctcccctcccctctgcccctctctgggaacctccacagggacaggaagagagactgacccttctttgacccaggcccaattctctcactaaacctcagatgggacctttaacccctaggcagcaactccacagccctcaccagccttctgtttctttatggggggacccccggcctcagggacactggagctgctgggaggaggggcagctggaggaggtgacaagacaccagatgccaccttcttgggccctttcttgggtgactcagctggaagggggatgccagaatcttcatataccttgcgtttcacagtggcctttatctgggccctgaagaaaagagagaagaggttaggaaaggagtcatcagagagactaacagaagaggggacgggaggggaaggggttctgggagtcccttcataagaatccaggtcggggccccaacccattggtagggttctcactttctcgaagttttacactcactcaggatggatggagtgtggagagtggagtccctgaactgagtagtgggaaaggcccatctcctaattctcttctgggagagacatcaggtagagcttggtgatttacaggtggattgagatttactgatcaactagttcagggtcaccatatccctggaaacactgcagtggggtcctcaaacatttatataaataaccaggggacttccatcatcaaatacaataacagcatctcaggcaacctaaattcacattcttggaaggattaccacagcattttaggaacttctgaccaactgtgacaattctattctttcagtcctcaaggggattctaaaaaactagtgacaaagtagggaagcagctgagctggaaaggagttctgaggacgatggaaccttgggtaaggaggaagaaggctgcccacccgcccttttctggcagccaccctccctcacactgtccgttccttgatgacacagctgatgtgattaagatcgtccccaaatcgcttcacagcagccctcagcatctctatttccgtctccgtccacttcgcactgtcagaaggggagaggggggatagcaaaaatgggagggggggtgtggagcccgcccacaggctatgcatcccacagccaaccagccgcctccttccgatttctgggaccccttccacggatgcataaagaggtcctccgtaaggggaggcggaaagctcttgaggccctgcgggaaccgggaggaccccaatcacaagaaatcacaaccacctccaccttagacacccctttccaccatcaacgttaaacggctgctgtacacagcacactgaaaccaactcgccaggaagggcttttcaaaacagacccaccaacacagcctgcagccgtctgggggaattccatgaactggggtggttgggagtggcggtggtttgtggtcgacccgttcgcagcagggagaactgtgaaacaggagtctgggctatgggcctgtctgtatttttatctgtcattcattccctcacccaacgatcatttattaacaccgactctgtgctgtgccacgcacaaagggaaactaatgtctgtccctgtgctagagagggtccgtgtctgtgaccgagtccaagcgcccgctctcagcgtccacgtcccagtccgggctcacgtaccccgcaggagaagagtcggccacgggatgcagctgcatcgtcagctccccgagcttcgtgaaggcggcgccggccgccgagaagatctctccgacctgggggcggggcagcgtcacggggggccggcgcccgccctccccgtcccgcccggagcccctagccccaccccaggctcggctcccgcccgccccccgcccggggcggaagagccgcgagccaagtggggggcccgccctcccgtggccgccagggagcgctgtccgcgagggaggtcgaacctttgtggacgctgacgtcatggccccgcgcgcctcctcacggagacgccgccgccgccgctacacgcgagccgggaccacggagagcagggagactgagcggctcgggcccccgcgcaggaagtcccgccctccccgcagcggataggctcaacccggcggctccccgccccatcagacgcagtcgcttagaccgctcggcgcgcccagtcgatggggaaagccttcgcctcacttccgcgccacacttcgctccacttccgctcagacatcgggactttccaggcagaggccgacctctagtctcagccccgtgctcgcccccactcaagcacagacacagggctgaagagagcagattctctttattgagatacgggacacagcgaagggtggagaaacggaacagccccccagcctcagccctctccacgggggccggatgccagagatgggagaagggattcagtctctcgcccgggaaacccagtcccgcagagggcgccggcaagggtgggacgcgacctgggtgacacggtgcagggagtctttaaatagaggaggggctggagcggggaaacgcgccggggccctagcgcaccatgtattccttgcgcttattgagccgaacttggcagaaagagaagcctccgaggaggaggtaaaggcctgcagcgatgaaacagttgtagctgacttgctcgtaaaggttgtatatgttctgggggccattcctgggggtgggaatgaagcaaaggggtcaaactttaataggagccaacattttctgagcactatgtgcccgacacctgtttaggcgctgttacgtgtattactttattcaatcttcttgaccatcctatggggtgagatctgtcatagccattttgcagaggtggactgagaagcacagaaaagtaaaatacctaaagaggtcacacctaaggtggtgggtttgggatggccgctgaggtctgactccctggctcctaaccacattctcaagaaagccgctctcctctccaagtcctctaacctaggggccctaagcaccgggcctcccagacgtaattctgaccctaggcctcgccacctcccacctgctcccagcccgcctcccccacccgaatacttactcaaaatctttctccgtgaagggaacgtcctcaatcaacacagcggaatggacattgaaaaatattccgagcattatctggaaaaggggaatgggtagactgttgaattcaggcacctgacctcatgttcacttcgtaaacccctcccatttccaatgttgctacaacacccgagcctgagattaaccaaaacgaggtggtggttactggattcggactcagccacctggaacagggcgtgaggtggtgacattgagacaagtggtcgaggcaagggtgggaatagtgaccaagccatctctcccaggaacccagattatcgtcctctctggaggcgtcatcatcacgggacagtgcggaagaggggagggagaaccggcacttcttcatatcatttcttcttgaagtggcggtgggtggattactgggaaaacaaggcccagctacacatttctggaacaagcactctcttttcctcccatgtcctccattcaactcaagcacctctcaggcaccccgctcttgtttctcctaccttgaggggtctccacctttaccagccctggctcctcccactccagggccctccgctccagttcccttttttctttttctttggggacggagtctcgctctgtcacccaggctggagtgcagtggcgcgatctcggctcactgcaccctccgcctcccggattcaagcgattctcctgcctcagcctcctgagtagctgggattacaggcgggcgccaccacgcccggctaatttttgtatttttattggagacggggtttcaccatgttggtcaggctggtctcgaacagttcccatttttcaatttcagtctgtctccttctccggggcctgtagatccccggcccctccggcctgcctgcggcccagagtttcctcgcctcccagccctcccagcccggagcccctcaggccctctccgatccttgccggggagtcccctcaccaacatgatcactccccaggcgctgaggacgatgccgcaggcggccagcttcggcccacagcacaggagcgacgccataaagaagggagtcggggatcgccgaggtgcaagcgggctcggaaagcggtgggagaaagcccaggatgccctcgcaggggggcagagggggcgtggccccggcctcaaccatcccatccgggggcggcaggcggaaaaggctgggctcctctcaggactttcgcgggagacggcgccgtctgaaaccaaaactgctcctggggaaaccttccttgacctctgtagctagggcgtgagtattggaagagcgagggcctccggtttgttggtccccctccccccgcacacgggaatggaaggagctggtatgtcacgtgaccaagcctgtcacgtcacgtgacgaggaactagccttagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgagaccgggacttgctgtgttgcccaggctggtcttgaactcctggtcttaagcaatcatactgctttggccacccaaagcactgggattacaggcgtgaaccaccacacccagctcttaaaaccacagtatttctaggactgcaccaaggggcaatgcagtactgcagccttcctctgactcagtttggattctctctgtccgttctcaccacactactaaggagagaacagtgccaggcaggggaaggagaggtacctgaagttctttctccagttgagcctgaagctcttccatccccgagggcagcactagcctggagggcagagaggtcgagcgtctcaacagcatggggttggcaccattgaggaactggtagctgaacaactcatcatcctgccagcactggcgaaccttctctttggtgggcggtgaaaggaggatatatgtaccacagcctgcatatcccttctccaaaatctaccccaggggttcaggtatataaccctccctgaacccagcttctgcgttttcattctcaaggcctctctgagttgaccagatatgataaggtctcttcttgcaaagagttacgggggactgtggagtgtgatgagtcatccagaggggccattaagggattatggagacctcggggaaccactgaccagccagggcactcttctggccccagaagatctgatcaaagtcttctaggcagttccaggagctcaggagggtgtaaacacgtttgagggccatctccagagccctaggacaggtattgaggcttaactcatcagctgatccctcagtccctcaccgtctatcatcattcttggccctcccagcccttatttcactccgaggtctagcctttttctcaccctgccttcagtgtccattcaaagtccagcctcttctcctcatggaatctcatatttggaggtagatcatccttacggtctgcagcgatggtcaggggtaacccttccttccaggtggcccagctaggagttggggacaaagcttcaggaaggatgtcatggtcagtgatggggccaggggcaggggcaggggcagggaaggggtgggacagtggtggcggggttagtttaaggggtgggtggtcaccagtagatctgctgtctgtctttcagttccttctctcgatgcttctggaacatgtccaaagcattgtctcctggcaggcgggctggggagacatcaagacaattggcctcacggctctgtctggtcctatgcccgcctcttgtcctcatctccctgtggttagccgtattccatgttttcagccatgcactgttgcttttatctctggctttgcctcatttgattatccaccagacacgtttatcccatctttgccaactttgcactcctgctttctcttatttcagccctcatcctttgcctgtagataaaaacctcctgtttgccaccatttcttgctccttcactcatcttcccctacctggccttacttcatcaatatctatggttggaaaaaaatcaccttaattaaggtgatgaaatcttagtcacctatacacctacacctactgtctactacagattgctttgattaatttcacatcttaaacctcacctgccacgccttcacctgtcctcaaaagattctacatttgcttttttttttttaaacctcatctttctggatttactatcataatctgtatctatggacttattctgggtcttttctgcatttacactcacctgtctcaaagtcatagatttgatgttccatccctactgccctcactcatctctggattcatctctcttttactcattacccatggttaaaaattcactatttgggccgggcgtggtggctcaagcctgtaatcccagcactttgagaggccaaggagggcggatcacgaggtcaggagatcgagaccatcctggctaatacggtgaaactccatctctactaaaaaaaatataaaaaat

SEQ ID NO: 2660 - DNA, 759 bp, Homo sapiens
gtctcagacttgggaaaactgcctaatattatgctgtagtggaattatgtttagatttgaattcatctgtgaagcattcaaatcaaagctaaaagcctaaatgtgaaatgctaatgacaagcctgagaagaaaacaggtgacatttgtatctacgataaaaatttttatacagaacctactgcctcaaactgaatcccatcaagaaaactagtttctattgtattagtaactcaaaataaattatcacttcgaaaacttgctttcccacactaaggtaagttcagactagattgaacactccagaattttttactacagactgtttttaagttagaagtgatggcaattttataaatagagaatatacttccactgatgcccttactgtgccaaaacaaaaatcttaagaaaagcaagtagacaccttcataactatgaatgaagctgctgaagtagtgtttaggatcctccatggcagttagtgaatgtaagaagtacagtgttaaagtgttgtaaacagttactcagtgcaatgtatagcctgagtctatccatgatggctatatccaatttgacatcacgttatggatcagtacacaatgaaaaaccaaagaaccacagtatatcttattcttaacttttgtaaaccatgttttatgggtaactttttagttttcccaaaaggctgataaatttcaatattttgaatacatcattgttaattttgagttggcagaggtaaactaaccaactaccat

SEQ ID NO: 2661 - DNA, 1863 bp, Homo sapiens
atatgtgtatatatacgtatgtatgtatacatatgtgtatatatagtatgtatgtatacatgtatgtgtatatatacgtatgtatgtatacatatatgtgtatacatatatatgtgtgtatatatatacacatatatacgtatatatgtgtatatatatacacagttgaatcagtgggattaatacctataatctctggttttcaaaggtaatatagaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacccttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttagttgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttacaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaat

SEQ ID NO: 2662 - DNA, 297 bp, Homo sapiens
gccgggcgcggtggcgcgtgcctgtagtcccagctactcgggaggctgaggctggaggatcccttgagttcaggagttctgggctgtagtgcgctatgccgatcgggtgtccgcactgagttcggcatcaatatggtgacctcccgggagcgggggaccaccaggttgcctaaggaggggtgaaccggcccaggtcggaaacggagcaggtcaaaactcccgtgctgatcagtagtgggattgcgcctgtgaatagccactgcactccagcctgggcaacatagtgagaccctgcct

SEQ ID NO: 2663 - DNA, 468 bp, Homo sapiens
atagggcagaaagccttttgggtgatatttatatattttcacacaatatttctaggtccctaaatgaatcatgaagcattatatagaaccaaaaaaatgtattttcttacattatctcttaatttaatttcataaatctctagtaaatattgtaggtaactacatttcagtatgagaattcacctcaacaggaagtctttatagagggcttaatcttcattagccatatattaccaagttcagacttatataatgaacgggtagttggcagacattcgctctgtaagacaaagcaatagcgttttttctccctaccaacaaaaaggcagagtccctacttttaacaaccagggcttttagaaaccacacagtatttcctggggtacatgaaataaaaaaaccatagggctggggagagcctagcctccccatttacactgagctgcttgatgaggcaaccctttcact

SEQ ID NO: 2664 - DNA, 4044 bp, Homo sapiens
ctggtgggtgggattggagggtgggaatgtgtgagggtgggtgggaggctaggtttttggctaggagttctgaaataggctcaggccacttttttcagacttttaagtgtgtatgtaagtgtgggtatgtgtgtttttaagtgtgtgtgtttaaaaataatgttttatcttccctccctgttccttaccgttttcattttccaacagtctactagagaaaaacatggttggccttgagaacataaaggaagaggcatgtatttgacatggtatttttccctttctttatgttataattgagtagtagccctctaatttgtagtttgggcaagtacagccaacaccctgactcttaaccttattatgagaacttcctttttacccctttttttgtttttgtgcaaaacagagatggggttgaggaaggagggttggcgagcaaggccagcttctgccctacagaattgggtgtgtcttttttttcaagtgaggctttgggaaagtgttcaaatgagagcagtcttaaggtctctaagagatggggaatgtgctatgtatatcctgcctgtgaaagcccaaaccatatgggagaagctagaggatactaaaaacaatgaaattgtgatttggaagtttagaacattgttttaaaaattacattataaatgtaagacatgctttttatgtgtatatccgaagggaaacagctacatcctcaagtttttgcagcctatatgacttgagattggagcttgtgaatttaacagtactggtgccatgagaatgagcaaagcctagccaatggatactattgtgtttagattgttcatctttggtagctttaggttcttgatcgaggttcttaagatttctaagtcctttataaaaataggtcaagagtcctgttgttatggaggcttgattatcccagatattaggagtgaacatttttaataaatctttcagaaaatcttggctagaaagaattctaagttagttgtctaaccactgaaaactacctagccagagatcatttaatgagatattctttgatcttcattgcattttttttgctctggaaaaggtggttcaatttgagtttgttttcatgatttgattgcagcttacttcatgccaaggattttttagggagaggtcgaattatttttcatttggaagtcatagggagacaggagttgtacttatgctgctacttgccaggaacaggttgggaagaaaattgtggctgttggaattgatgatgtactggcctaatatagaaaggaatttgtaggcaggagtaaacgttaactgacggtgggttagtgccctgcatcttgcatatttgaactgtctagagttcctgccattgctgggtataaaacgaggagctctctgttgacctgtaaatcattaatacttcttgacttagagtgtcacttcactttatagatgacattttcctctttccccttgatattttctatgttgtgttagataattggtagatatatagttgtggtttagtacatttagggcttctatttatttagattttgtttgttggagtctgtttccaaaagggaatgtgccatttagtctgcatctgtatctttgtggacttgatgatcactggtttgattttgaaaaatgtcttttccagcttttagttactctcatcaaatgtcacatattttctaatcacatgcactcctttaccacagaggcacataatcatttggcctcatagcagttatccatggccgtactgtagtaaagttccttagaactttgccaggagtgaactagaaaaaagtgcttactagggcctaagagttgctttgtgccgtgtagtccggcctttgcactagtagatcattgctgacataggtcagtttagagacctttctgtgttaatgcctcctggtactgtcttaagatacgtacagtgtctgtttttagatctatgcatatgtcatgaagctccttgtgggctctgcatgaagctgctgctttgtttttgggttaacagatgtgcctgtcaactagcatgtgtattgtccaaattccataaacttaaggtttttaagggctgtgtggtttctgagctctatgtgtctttcctatccttgtaccttcaaagggtgagaaatgagatttatacatccaaagttagtctgataaatatggctttttgtttctccatgtaacctagactgtcaaaaataagtgatggtgataagtaggcctggagcctcagcttctgtaaatctcattcctaaaattttgctagactcgtgttggcaaaaacaaatacctgtggattgtccttaaggcttttaatcagatacctgtgttgctgttagctgaactgtagtgaagcatcgatccaaatcggtcttctgaagtatcagttatgcttttgagtttagaaaatacttaggtgttagtctagtcttcccattcatgaatcagtgtatgtccatatcagagagcctcaacttcttttttcttcctttttaaaaatgattttagtgttttgatttagtgtatactacatagttcagtattattggctttaccagtgttgacagaaaaattttaaatctccagttgcaaacagcaatggattaggatatggaaataaaatcatggtgacatcactgctgagttatcttaaacctctgctacttaattctccatattgaaatgcatactcctccacatacatggcttccaagtaaaggcaattgtagaggggccctgtctatcccagtatggttggattttaaacatatctgtgtttccgttattttgggaactgattaatatttacaattttttttgtttatgagttattttgatactaagaaaagagagaatctagaacatcttgcagttgaaatacaaattttattcttttggtcttgggagaatttaagcagtctatgcaactcatcaaatggtgagaaatagccctccgaggttccagtaagctttcagtgactttgatacctccccaagtttcttgagttgctgcttgttaacacccagcttttaactgagtgtttgctcctgatggtttaggagattttcatgttgtatcacactgtcaagttttattttgtctttttatccctccgtggatgtgagtttgaaacaagcacggtacagtaatcctgcctgatagagtagtctggaatgagaattactttttgggtgagagagttctccattttaatgtttctaaagtttttcatatgaacttggcattggaaaagggaggtaaagaaaaaggacgtttactaaaagcagtgtctactcttcccctttgtgagtgtttattcatggctaatgaaaaaaagagaaggactcttgggttttgtgttgccatgttaagcatggagagggatgcttgacagcatgctaattgaagccagagcaagtatgtccttcatcaggtaatcaggaactcttcagttgaagctgaggaactaactgattagttgttgatcataatataattggttacaaagtggaagtgccagctggcttaagtacccaaagaaaagaatgcagcagcctaacttagtgttaccatatgttactgaatttgaaactgaccttttttcccaccctacttcacacacctaaaactcttttcttgtcagaccaaagagcgaaaagaaaaaaaaaagtaaaacactttaccaatctgtcactcaggtacaattttgtggtgagatttttgtctgttctctttgtattgctcttaagagtcctttctcagcatattattctgccattgcctctgtcttccttggggcacctcagctctggatgctacccctgggatatctactgctgttatgtgaatgataggaggtaagtgaccattatagtaagggctctttgtaaaaaaattcaaaaaatttaaaaaggatgtatacattttatagtctggctatcagtttgatatcttgctgtcaagtatgtttctcaatctgtatttatccatcccatcaataaatgttaatggtaaaa

SEQ ID NO: 2665 - DNA, 656 bp, Homo sapiens
cagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgatgaaatgctcagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccgaggcatgctacaggtggattttgcaaatcattttgttggaggtggtgtaaccagtgcaggacttgtgcaagaagaaatccgctttttaatcaatcctgagttgattatttcacggctcttcactgaggtgctggatcacaatgaatgtctaattatcacagtgtcagagatggctttggattccccattctgtgtgctgctgtctggctcctga

SEQ ID NO: 2666 - DNA, 1866 bp, Homo sapiens
ctggtggcttttgtatcgtaacctgaaactggcttagtactttttcctaaaagctcaggatttgagaatgaggaccccttcgccaggaaaacatgtatacactcaaaattttgcttgcagttctagggtgtttagacccttctcagatacctgtgcatcttatgggttttgtttttctctttgagacagtctcaccctgttgcccaggctggagcgcagtggcatgatctcagctcattgcagcctccacctcctgggttcaagtgattctgcctcagccccttgatcagctgggattacatgcatgtaccaccacacccagctaattcttgtatttttagtagagatggagacagagtttcaccatgtaggccaggctagtctcaaactcctgacctcaagtgatccacaagcctgggcctcccaaagtgctgggattacaggcatgagcaactgcgcccagctcttgtgtaccttatgtgaggaagtcctgctcaatcaggatcggtcacgcaggccctgatcttgctactctggttccatgtcctatggaagaccaaagtttaccaagatagatttttcccttcatagtggcagatagtgttaacccctgcaccatctgtaactcagaaatccccaccatttcttcccctgggcttcagaatagaattgcctggtttctctgatgatcagcatggttccttaaaacccaaatcagcaaggaatgaacaattttgtttggcatggatgaaattagcactgtttggctcgttaggccccaggcaggcaggcaccttaattttttccttgcatattctagtcttcagaagcattgccttttgtcctactggtagtgacatagaccaataacagggcatctggggattttaatcctgaaaacagtgagtctgatactgcttgtgtttttcatcagtgtccaccccaagtgggtcttcctgctattctcttcacttagttgcccctcacttgccatctgagcaattggcaaggatgtgccaggcctaggttaaacttggaaacatgcttgaccattctattccctggtcctttaagatcagtttggctgcaattttggctccttggaccctcaagcatagctggtaaatcaagttagagatgtaactgccttaaaacatgccagcttaggctgggcacggtggctcacacctgtaatctcaacacttcaggaggctgaggcaggcagatcacttgaggtcaggagttcgagaccagcctgaccaacatggagaaattctgtccctactgaaaatacaaaattagccggatgtggtggtgcatgcctgtaatcccagctacttgggaggctgaggcaagagaattgcttgaacccagggaggcagaggttgcagtgagccgagatcacaccattgcactccaccttgggcaacaaaagcaaaactctgtctcaaaaaaaaaaaaaaaaaaagtgccagcgtatgaggtaattagattggttctctccagaggtaacctgccaagaagagatgctatagatgttactcctatactgtaaaacattgtgaaatcagattactttaaaatgatgtattacaaagttatgcaaaaaagcagttgtgactatggaagcccaaggcttatatcccagctctgtcttacactaaatatgggtacagtgtttccactctgtccataaaatgggagctaatattctccaacctgtgtgcctgacatgatggttaaagggattaaacaaaacaatagtttgtaatttattctgtcagagcaaactgctggtaaataaaagggactaagttgacgaaaaataaattttaaaaaacctaataaaacaagtttgtaatttat

SEQ ID NO: 2667 - DNA, 3275 bp, Homo sapiens
atcttggacaataaatatagtacatggctatttttcatttttatcagtctaattcaaattgaggtgtgagtttaaaatgtatttaggattagtctgctgatgctagtcatctttctcctatctatattcatgtatgttggtgtccatggattggtatttattttttctaaacaggtataggcctctatggactgagtcacgcaccacccccattacattactgaggactataattcatgttctgtctcacattctctaagtgatctttataaccctttaatacatttttcttccaaactgaggttagctggaaaaatttaagagattcaacaatgagcatctgtccttcctctataccactactagagaaaggtattaattacctcctagttttcatttgaaaacaacaaaacacaagatcaatcaaatatcatttcccagttgattaaaacttatacattttatacatttcataaacaacgtttcaccacaccaaaatattgttgaattatagttaaaactggatttataaaccgagtaaactcaatagtactgtttagtcctttataaatttggtgatagaaaaaaaggaacattaacagctttagataagtgtagagctagctggcagttattaatagattttatttggcctaatactatgaaggctcttcatgccctgtttttatcttataaaccaaaaaatgccaatacacctttacaagtatattctgaagggcctcttaaaaaagcaccctatgactcagtatttaagcacaacagcagctaaagatacgcagcaaactgaagtggccagctaaaagaaaacagatctttctcacaaatacagcaattatattaaatatatttattacgagtataaaatggtttttaaaaagcccaaatgattctgattttaaaacttgatgacagatccatcaagtacaaacgtgtcattcaatagtggttattttttcctggtcacctcctccctattttttcagagagataaatatttgcctaatactgtgtttaacttcttccaagacttacctgagactcaaaactgtggccatggatattcattaaaaactctatcactgtggcacaatttcttcttctgcattttggagcttgtttaggaatgctaggttccaggaaactgtataaataaagccaatttagtgagaaaacagtgcaacctggttgtctgaagtgcctgatgaatttcacctaatggtgtaaagggcactcccaggtgctttgacaggttcacacagcaggactgggtgagattactgactttgtatatgtctatgacatttacacacatttgggtatttactgtacatactttaaaatagtggttaggtgctgtcattttcatgattttgacagttgagaaaccatgttagggagagagctttgtgtgacaccctaatcagaccgtgaagggacaggtctgagttgttcatagtgcagagcgaggcatggccacggtacacagcacacaggtgataggcaaatatttaatgcactgagccttttgtgtgtaaggataattagttactttaaggtattcggcatacacttttacatttccatattttaattggactttactggtcactgtggggcatagatacaactgaactgttcaatcctaatcaaataaaactattagtacattcttatacatctttttgggacaaagtacctcctacttacagagtatccaatgtaaattttttatggacaaagtaaatgtttataaatattttggcattttataacttttcctagcatagcttgagggctgataagaaactcagcagaaacaggctgtggttggcatgaagacactctctctctctctctctctctctgctctaggggattttactcactttgggacaaaagcaatatagtagcatcttttcactgaccaaggtaaccagagtgttgatcagatcacactgatacctacaagtggccaaaattaaatgacaagcatggggggaggtgccaggaagtggcaggggtatagagtgtgagagagaacagatgcatgtgagtgtggtgtgatgagggaagcagctcaagagctgacacctaaacccagaataatttcagaggtgaaaaattaccacctctcttactagtgacattgaagagaaaaaaaattagggtttttcactgatatgttactagtatttaggcaaaaacacaacagaaaccaaatcaagtcactataaagcagtaagaaaatatttaaaaaagacattatcaaactttagtgaatgttattctaagtctcgaaaatttagatgtctgtttagactaaaattttgccaaaaacaaatccaaagtgaaaaagtagcaattttagtagacattaacaaacattatgcagatatagatacacatatgaataatgcaagagatttacagaagtgtagttttggcacttttacttggattttttaaagaaagtgaatacaaatatctttgtacacaaattctcattctggagaaacaggatgtagaattcaaaggtgccaacatctcccttcttaaaaataacattgaaacgggtaactgtacctgttaaatctcctggttggcaacttttaaaatctggcttccacctaactccacaaatttgacaaagttatttttgtttgtgtaagtgatactggttatccacttccagtacatgtaccatttggccagaggtccataaataatattaacattttcaatgtagaaatcttgaagttctaaagggaaatattgctcagtagataaattctcctggaatttcttgtagcaaaggttcctcaaatttaaatcgtttggaaatggccttttgctccattttctctttttcagactgtctgcattgtcctagagtatatgaagtaactacaattaactcttcggttacaatggattccttggtttctgatttgtcggtatccgaattaatttcaggcacagaatgaccttcttggagggcatttgcttcttctagtgccttttccatcctgaaagaaggctcttgaatactgctctgtgtcaaccaggggtgctttagacattcttcagcagtggctcgatctctgtaaagatacatgttttacagttaagacatgttagaacttcaattaaaattagagcataaggtactgtatttattgcattatattttgggaagtctgacaagttggcaaaaatcttactgtgattcctgaataaaactattagtcttggaa

SEQ ID NO: 2668 - DNA, 4211 bp, Homo sapiens
gctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagggcagggttccactcccattgcccaggctggagtgcagtggcgtgatcttggctcactgcaaccccctcctcccctattcaagcaattcttctgcctcagtcttctaagtggctgggactacaagcgcgtgccaccacacccgcgcttataatagaaaataatttttctgtttttttgtagggatggggtttcaccatgttggccaggctggcctcgaactcctgagctcaagtgatcaacctgcctctgcctcccaaagtgctgggattacaggtgtaagccaccatgcccggcctctgatttttctatagtgagaacataactatttctgtaataatattaaaaatacttgtcagtatcacatagaattttcaacagcagattcaaataaaatgaatccttgtgtgtgtgtatatatatatatataaatgtagaaggataacatctataataggtgattactatgttgactgtatttacagggatggagaaaactcaaaagagccattagtatttttaatggagaaactcttaatccaatcaataaggaaagcaactgttatggaaagaatgagatgtccaagtgtttgaaacaatgctctgaacacacttcatacttctgaggaagagctttgaacaaaggagtaaacaagtagaatgctgagaaaaatagggagacgacagtggcacatgacacctagtttttttttttttttttctccatggttcttttggtatctctccttcctttccctgtcagccacagttctttatattaaattcttttgatggcgagaatcctggagtaggagtgagaactggactgtagatgcacctctcccactaaccacctgtttggggcaaatagtctgtctcgttgggagatgaactttacaagttcaattactaaatctgaaatatctggattagaatatttctaggttttttttctgctcttgacattctatgataactccatgacaaatgttctttttccaaataattaaaacttaaaacatttccgtttaaaccttcaaagacaaagacaacttcttctttctgcatttgagtcataaacatctaaactaataagttagatgttttagggagaatctatttgcctacaataaccaccccccctccaaaagccaagccagcagatacgtggaaatgggaacctgcaatattctacctccttccttttaatctcagaagaatttttataactagagtaaagccacattatgacaatgagaaaaagttggattacttttctttatttaggctaaaatttagacttaaaaaaagaatatgctaacgcatagtatatacagtattgctccttgagggtaacactggcacataattcttcttagcatccccaaatcaatttgttggagattagcacatagtaggcactcaatagatattagtatgtgttccttgttcaatacaaacatgttcatcagtaaaagaaaccatactgctaataattttatttcttgatttagaagcaaaatataggcgcctaatattaatctcttcaattttaggttctaattcacaacagtccaagtttagcaagtctagtagttttcatataaatacctcatacagttgcaagcagatggcatctatgaacccaacttgcatacttgggattttgtttttcttctccctgttcattagatcctgaaaatacaaatacagaccagacacacagatgtgcatttatttatttagttagttattactttattattttttgagatggagtctcactctgttgtccaggctggagtgcagtggcaccatctcagctcactgcaacctccacctcccaagtttaagctattctcctgcctcagcctccctagtcaggtgtgcagtaccacgcctggctgattttttatttttattagcgacagggtttcaccatgttggccaggctggtctagaactcctgacctcaagggatctgactgccttggcctcccaaagtgctggcatcacaggcatgagccattgtgtgcatttatttaaagaacacaaagctggctctagaaaggtgaatcagtgggttagcctaggaaggtcagacagcaactaatacaaaaagaaaaaaagaggaaaactcttatgttttatttcaaggaaactcattccaaaaaacagaagtgggctgagaggaatctttacttgtatctgagatccatactctatgtaaaaaggcagtatgtatcaaagacctttaaattctgtttgcccttcaacacgacaactttgggaatttatgctaacaagataatgaagaatgaggtttggcggtttatctattcccttggtgtaatgtttgcagtgttcactattacaaacagcactgtgataaacatctatgatagatgaaacactgctctgaacacacttctgaggagaactttgaacaaaggagtaaacaagtagaatgctgagaaaactggggagactgtggtggtggcatgacatctggtcatctttcctccatgtttcttttggtatctctccttcctttctctgtcagccacagcttctctattaaattcttttgatggcgagaaccaaggagtaggagtgaaacatctatgatggatgtttatcacagtgctgtttgtaatagtgaacactgcaaatattacaccaagggacgtaggtaaattatggttacatcgatttcatgtaatcatgataatacataagaatatttgttaaaatgaaaagtggtttctaatacttaagcggaaaaaaacaaattacaaagaacactgatacaatatgatgaacccaagagtctttattatgccttttattggttttgctttctgtaatgaacatgtataattcttccaatgagaaaaaagttttaaaaaataaaatgagaaattgtggtcctaaggaaagatcccatagagccataaaaaggagtctacaattaaaaaaaaaacaatttgaataattcctaccaacaaggtttcatacttacagtgggttctatgttgagttcttttctctctctgtctccttgatcaaaaaattcagttgctacaagttctgctatctgaaataaataacagactcagttttgacaatgaaaagcatatcattctttaaaacagagaccgtgaatgaaggccctgttaggagctgtatatctccattttatagcaaataagcagcagcttgata

SEQ ID NO: 2669 - DNA, 1229 bp, Homo sapiens
acctggcccgcgctcaccttgaggccgcggatctcgccgaggtgcagctgcaggcggcggttcacctcgcggatgaggttgctgtggtccagcatcgcgctcaccttctccgcctcggcgcgccgcaggctgcggatcagctcctccttgctccactgcagcagctcctcgtccgacactttggacaggtcctccaccggcgcgggcggggccgcggacgagccggccggggctggggaacaactttccgccgccgccgcagccgccgccgcgcctccggccgccttcgacatggtatccgcggggtggcaggtgcaagtgggtggaagaggcgaggcgactcccgaaggcgcgggcgcggcgaggccgcctccgcccacacccctgtgcgctccggcgagtcagcggcaccgcccaggggccgctgggttggggcggcgggggtcgcgctgggtggccatcctacctcgccatccccgcgcgcgcgcccgcgctcccccagggcccggcagccagccgcttgctgctgccgaggcccgtcccaactccgcgcaagtccatggtgaggggcactggggagcccggggctgccgcgggaaatcctcggggacagcgggggagctgcaccgccgttcccctgccctctcctccgccctaagccgagactgtcgccccccgcactctctgccctgcacacaggcgtgcacgcacacgcactttcctcccccttgcccagctgcagcccccggcttctcccctctcctagcttggagggcgcgccgggcaccgcggcgcctccccggctgctctagcgacgccgccgcggctgcccgaaggctgctgcgctcctcctgccgccttcgctgcgcccgcggccgctcctaggctgctccggaaagccttcgatttgcagagcggagtcgagaaggggtggagggtgggggaccggctggaggaggagcctggagctggggccacccgtaacccgcagcagctcccgcatgggctggacgcagctgccactcgaccgctgcccgggccctcgaggtgcgctcccggctgtcctgcccgggagggctgggggcgcggctctttctgcgcccgggcgggtggggctggaatggggagaaggtgaggagctgtggccgcccggtctttgggaggctcgcgcgcgccaccgtgtggcggaagaagctccctcctctgccctctgcacaccggccttgtca

SEQ ID NO: 2670 - DNA, 34908 bp, Homo sapiens
acacaccctcggattgacgtgcgcacgcgcaccggttaccttcaggagcgccgaagaaggaaagaaggttggaatgtcggtgtccatacctgattctaagcgagggagagggaagggggcggggtggcctcagagttttaaacttggggagtaaaaagaagtcttgagttgggagagatgggtgtccctggtagtggatgaacaagtgtcccctgcaggacttagtcccccaacctgaggtcgccccaagaagattatgggtctccggggggagtccctggacgccagttttcccagaagtcagattcaagtgattagaaccagagacccggctctcccccagctagagcagcccaggttccctctagcgccagagctgctgctctgccacgccggccaatgggaggtattagtgtttaagtaactgcttgggtcacagtagggggtggggagcttttctgttacagaattctaaaggtccctcaagcttggcttctaggaaggaattggttatttttctccacttgggatgccggaagtaactagaatcaatttgttgctaggcaacgtgttttgaaggacgcgtgtttgttggactcaaatctggattcgactttcacatggtagacacataatatcaggtgtactccctatttaatctctggagttgctacccgctgaggatatgtaccttggtagatggttgtgaagctaaaatgacataaaaatgtataaagctctgacatgtggaagatgcttaataaataacaaattttattattattataataaaaatagaaccagctggaccatttccggaaccaagagaatacagagacgtggccattttttaattctcttagtcatctgttcacattcattctttaaatctcctgtgagcccttgatgataggtaggaggcaaaggaaaaatgccagaatggaagtttttgaaaagaactcaatggagtcattgacaaatacatccctagtttgataaggacatagcaggccactgcctcctctattacaggaacacccttacatagaaaatgtcttgtttgattgaggacttttcatttaaacaaggccaagggtatgtcttgatcaacacatttgaaaacattagttttgttgaatttgcttagtactgatgaatggataatggctgactggttattcccattgatccactacaaggaagtgtaagaaaacctcaaatttgattaaactttctttctctacctattcttccccctgacagaaaagctcaagttcatttgtaggatgcagtgtttagtttacttactgctcctgaagggagcaaaaatggattaatgggctgggcacggtggctcacacttgtaatcccagcacttttttttttgagacggagtctccctctgtcccccaggctggagtgcagtggcgcgatcacggctcactgcaagttccgcctcccgggttcacgccattgtcctgcctcagcctcccgagtagctggaactacaggcgcccgccaccatgcctggctaatttttttgtatttttagtagagacgaggtttcaccgtgttagccaggatggtttcgatctcctgacctcgtgatccgcccgcctcggactcccaaagtgctgggattacaggcgtgagccaccgcacctggcaatcccagcactttgggaggccgaggtgtgcggatcgcttgagctcaggtgtttcagaccagcttgggcaacatggcgaaacgctgtctccacaaaaaaatataaaaaattaactgggcatagtggcacgggtgcggtggggtaagggggggtcgaagctgtagtgagccttgattgtgccactgcattctagcctgggcgacaaagtgagaccctgtattaaaaaaaaaaaaagattcatgaccttggagaataaaagtatgttctccacatcgaggagtggttagagtgatctggcttccaccttgggcctcaaggtcttcaagtgccaagtggaaatacatgcactacctgcccctgtagctcagaacatggaatgagagaaaataaagcccctgacacagagcctcgcacatgacaattcgtcaacaactgagatattattacttctaccataatattctgtatataaataaaagtactttcaggatagccgtaagaattaaagatcattaggtaaagtgcctggtccagtacctatttgaaccactgatgattattttgcttctctctgatgaaaaagcactacatttcatctttatttgtataacttgagaaataagtcacctaacttttctgcagaagttattattggtgttatactcaaaaataaagcacagtttagccctggcctgtgcatttacaccactgaataaattaccaaaagtgtctgtctagcaagagttcgttctaacaaagtggagaggaagagccagttttatacaaatattgaatcatcccacaactacatttcatgaaactccctgattttttttaaaaagagactcttgctctgtagcccaggctgcaaagctggagtgcagtggcctgacctctcagctcactgcaacctctgtatcccctcagcctcctgagtagctaggactacaggcacaggccactgccccccgctaatttttttttctttttttatagagacaaggtctcactatgttgcgtaggctggtctcaaactcctgggcgcaagcaattcacccactttggccttccaaggtgctgggattacatggcgtgagctaccatgcctggctaactccctgatttttaatggactcatttttattacagatctgaatgttagcagtgccttatgttaaaaatgtttaaatcacttttagtgtttttctaattataaaacaaatgcagagaaacacaaaagaagaaattaaaaccatccagaattctaccactcagtaataacctcagtcaataattctatttttccttctatcctctttgtgctcacatatatatatatatatatatatatatactttacaacatttgcattagatgtgtacacggtgccagcatcctttttgcttaacttttcctcttaaacatttcccaaatgtatttaagcctcaaaacatttttaatggctgtataatatttatccataatttattcaaacagtccccaatttgaaatttttcaacttttcttatgtaattcattgtttcaaaaatatttgttgagggccggacgcggtggctcacgcctgtaatcccagcacttttggaggccgaggcgggcggatcacgaggtcaggagattgagaccatcccagctaacacggtgaaacctcgtctctactaaaaatacaaaaaattagccaagcgtggtggcaagcgcctgtagtcccagctactcgggaggctgaggtaggagaatggcgtgaacccgggaggcggagcttgcagtgagccgagatcgcgccactgcactccagtccaggcgacagagtgagactacgtcttaaaaaaaaaaaaaaaaaaattgttgagtacttagtatataccaggcattatgccagacataagatttaattggtgaacagtaaactataaaaataaggttttgatgaacatctttgtaaacaaatctttggtggcatctttcatttttagactcaattcctaggactatgaaaacaacttcaaaaggcattcttcgagcttcaaaggcaaatttaagaaaccaaatttctgaactgtaaaatattaactttttggaaaactaccaacaacggaattaatatttatttcgtgcgaagtgtgaacttacccagaagatgctttcttgttagttactgtgaagtacccagggtatttgaagtgtattgactttggcttttacctctaatcctttccaggatttgctggttttctcaacagtgtgagattgtttgaagtctatgtaaattgccctacttccttctctcagttaaaatgttaactattttatttccagctttcctcttgtaagcatgtggctttgctgcatttctttcatttaccttttcatgtgaaacattttgtattttcacatttattaatctgaaggccgatttttttttcttctaaacccaaattataatacatatattcctataagacatggactttacatatcctgtagttaatatttgtcaagaaacatcatataaattaaccaatgcatttagggaatttaataatagatattatttattaaaagcaacaatctttcctgcaacacaccacatacacacacacacacacacacacacacacaaacacacacataccctactattctttgacaattaaacattcatatattaggtcaaaccatatgaaattaccattcgtggataaaaaatggtcaaataatggcaacttcatatggctttatttatattaatattttattaagtagtttatattttttcaactttcttcaaatactgaacttcctgattatcatactaaggatatcctttttactgcatgagattgtgtttgttttgactttcataagtattagaatctagtcaggagggtgccataaaatgtttgtttattatttcaaagacagtagagggagcctggagccaaaacagtgttattgtaggcttcatggaaatgattattatcctccaattcttgatgtgtggataaatgtaaatactagtatatatgtgaaataccaattttttaaatatttattttaaaaaaggttggtcgggttgggcatagtggctgacgcctataatcccagcactttgggaggccgaggcaggtggatcacttgaggccaggagttcgagaccagcctgggtgatatggtgaaacccccgtatctattaaaaatacaaaaattagctgggcatggtgggccactcctgtaattccagctacttgggaggctgatgcaggaggaccgtttgagcctaggaggtggaggctgcagtgagccgagattgagtcactactgcactctgtcctgggcaacagagcaagactctgtctcaaaaaaaaaaaaaaaaaaaaaaagttagttgtgcttaaatgactttcataagatgtgaaagagaaagttggcagctgaacctcatctgggctcacactggggccaatcagaatttcattgttctctctcttctctgagtattgctagagacagcacactgccacacgaacacatctgtgctctacaatttcccccttttcaaaccatagtgttgatcgccctttcatttccatgggcattaatatcatgattctttatgtcaacagaacttcaaaatatgttaccattcccaattttgtatcttacagtcattgtagtttagttgatggcttcctccagacatataaggaggcacttggatcctgtcaccaactcatatcctaggaaagtgtttaataacttaacaatcctttcacggactgggaattttgttacccttagttaaagatgtctcttgctgagctctcctcaatcatctttgcccttagcccaatattttgttaagtacccactgaccctggtgttacaaaggagttcctaaggtaataactggtggtatcatcaccattctttactgtaaatagtctagggagggctccaagtccctgaggtaacaggaatccctaaatctagagataaaatggagaagaatctctctattgtaaaacccaaaaggaatccgtaggtagaatcaatcggctacagcagggtttcctaaactggtgataagggaaaattcttctggtatgttattaacatgcagagaaaaaagcattgcccctggaggaaattagtttgtttgttaaactgttaaacaaagttttttgtttaatgtagaatgtctcagaggctttagtatgctaatatactttgtcagtttctcagagggagttttttttaatgtgtaggctttctcaaatttacttgaccagggaattttgctttttttcttagtgctgtttaggaactcttgaagtacaagatacttcctctgactgtgacttgaagatagctgtgagaaaaaggccccgccccacccccactcaattgagaatcaactaatctaaaagcaaataaacctgggaattgtacccaattatatattgacatgaaaggtgatgttgttaaaactaaacacaagttgaagggcttttcataaaagctggggaaagcaaatgttggaaaaacattccactggggtgtttcccctgaattaataaacaaatttaagtcagtctcaaaacaaaatgaaacagaaaacaaagcacatggccctcaaaagtgcccttttttcccgtcctgagcaccaagagtctctacatgtgggcatccatattctaattttcatcattgctcagcttgcccttgctggctttacaccgcactgctgaaactgctctggcaaatagtgtcagattcagagcggtatgtgagaggggaccttctgcttcttgccttaggagatttttctactgcatttgacataattacttctcattcctttttttttttttttttgagacggagtctcgctctgtcgcccaggctgcagtgcagtggctcgatctcggctcaccgcaagctccgcctccttgcagtgggttcactgcattctcctgcctcagcctcccgagtagctgggactacaggcgcacgccaccatgcccggctaattttttgtatttttagtagagacggggtttcaccgtgttaggcaggatggtctcgatctcctgaccttgtgatccgcctgcctcccaaagtgctgggattacaggcgtaagccaccgcgtccggcctctttttttttttttagatggtgaggtaggaggcaggactcgactcgagaggcagggcttggacactggaccagattgagaactagctaaaacagggccaggataaaatcagctttcaatcagatatacccactgtgtgccatgtcaatttactattgccatagcaacacttggtagttaccacccctttccgtggaaatggcccaatggttactaccccttccctagaaatttctgcataaaccatcccttaatctgcatgcaagtaaaaatgagtgtaactatgactgcaaaatgccctgagctgctattctctgcctaatgctcctgctttgcaggagcagtcacagagctgtaacactgcctcttcaataaagctgttttcttccacccttggcttgcccttaaattctttcctgggcaaaaccgagaacccagtgagctaaggtccactttggcactcacttaccctgcatcaacagggtcttgctctgtggcccaggctggagtgcagtggcgccgtcacaactcactgcagtttccacctcccagtcttaagctatcctccctcctcagccaccggaatagctgggactatagtgtgtgccaccatgcctgggtaatttttttatttatatttttgtagagatgaggccttcctgtgttgccctggctggtcttgaactcctgggctcaaatgatcctcctaccttggcctcccaaagtgttgggattacaggcatgagccaccatgcctggtctttctcgtttctttctgaaacacttttctcttgtctttcatgaacctcattctcccagttctcctcttcatgagcttctttgtgtgttttctacctgtgctcacgctataaaaccttgctgtgcgctaagatcccctcccacccgtcgacatggtctccctggtgatctcgtttacactgacggttttatcgaccacctttatgctgactggccctaaactgagcttcaggtcacatattatctaactacatgctggacaaatatacttaaatatcccatagacatctcaaactctatttgtccaaagctgagcttataagttttccctctgccccagttgtcactgtgttaccacaaccttcatgtcattaaattcaaaagtaacttttcatctcatcttatttgacctttcagctatatttgacacattgtattcctttattctgaaaacattttgctttgtttctgtgggtctatatcttgtatctgtgacattgtacctttctgattttcttactgtttctgactacctctttttttttttctttttttttttttgccaatttacatttctctagtaaatatttaaatattggagtttctcaagtctcctcggctactgcatcagtggtctatcactgcataacaaccaatcttgaaacttagtggctaaatgtaatcccagcactttgggaggccaaggcgggcgaatcacctgaggtcaggagttcaagaccagcctggccaacgtggtgaaaagctgtctctactaaaaaatacaaaaattagccaggtgtggtggtgtgcacctgtagtcccagctacttgggaggctgagacaggagaattgcttgaaccctggaggtggaagttgcagtgagccaagatcatgccgctgcactccagcctgggtgacagagcgagactctgtctaaaaacaaaagagaaaaaaaaaaaagaaacttagaggctaaaaaaatggcaaatattttatttgatcatgattcaatggggtagcaagttgaggttggcttggctgagggcttctgctgctcctatgtgtggtcactcatgtacttgtctggtggctgactggggcccctgtaatctatgactttattctcatgtatgggtgttggtggtggctgttggctgagcctttgtctcattgtcgtttaccttctcaaagggttaatctaggcttcttaacatggtggtctcaagggcaagagcagaagctgccagtcctcttgacttctaggctcagattccccctcatcactttcaccatattctattggtcagaacaagacacaaggccagttcagaatccaggggtggagaaataaactccaccttttagtgggagacaaaaatcacattgcagagtcatgcaaatttggcaagaggcatatgtggctattttttttcagtatactacaaccctttcctcttcttattcataatcattttctaagagatttcatccattcagcttggctcattgtccatcaataactccctaatacatgtcttctcagacctcaactctgaattcacatagcatgagcctccttgacttcttcttttggatgtatcaatgatacaagctcgatagctctaaaactatattaatgattttctaccagaaatcttgtcctctttcagtccctatcttagtgactataaccactggcaagtaagaagcctgggcaaacctcttttttttttttctttccccatatccaattcataacccagtcatgtcaattttatattctgaataactctccacaccatgcacttttctctgtttccacttctaccactttaggccaagctactagcaccctttacttggattactgcaactgtctcctaatgtcacttcattcactcttgtcccctctatcaaatccattctccattcaagagccagagtagtcgtttaaaatgcaatttgataactttttgttcaaggttacaaactaagcagctatgcttgtcatctcttcctcccaacacctttattaaaataatataaaattttgaaaagcctacatccataacaaagagaattgaggcagggctgaccatcattaagttcaacatttttagagggaagaaagcaatggagaaatagtgactgatgaatcaagatagaggcagtctaagcctctatgttgcatggaaaatagatccaaaaagagattcttttggaaaagtctagatattttggactagatggctgcagatatgagagacggacatgggacatggaacagaaaaaagagaggttaagtgatggcctgcaatgaccaccatcctcctcattccttctaggacagaacagttagtagccaagtattccctaccttaccttaggccaaagaaggaggaggaggtgaaggtgtacctccaaaaatattaaatgaactctcttttttttttaaaaagatcttctgtccttcctctcattcctaagctattactgatctgccttttaccaccatagatctttgtattttctacaattttatatcaatggaattatacagtatatacttttttatctagcctctttttttttttttttttttttttttgagatggagtctcgctctgtcgcccaggctggagtgcagtggcgtgatctcggctcaccgcaacctctgcctgccgggttcacgccattctcctgcctcagcctcccgagtacctgggactacaggcacccacaaccatgcccgactaactttttatatttttagtagagacggggtttcactgtgttagccaggatggtctcgatctccggacctcatgatctgcccgcctcggcctcccaaagtgctgggattacaggcatgagccaccgagcccggccttgtctagcttctttaactcagcatcataatttcatatttaatcatgttgcaaaatcaacagttcattcctttttattgccaggcagtagtccattgcatggatataccacaatttatctgttcacttgttgatggacatttgggttgtcttcagtttctggctgttacaaatggagctgttattaacattcacatgtacgacttcaggctgggtgcagtgactcatgcctgtaattttaatgctttgggaggctaaggcaggaggatcacttgaggtcaggtgtttgagatcagcctgggtaacatagtgagactctgtctctacaaaaaatacaaaaataaaaaaaattaactgggtgtggtggcatgtgcctgtagtcctaactactcaagaggctgaggtgggaggatcacttgagcccagaagtttgagaccagcctgggcaacagagtgagaccccgtctctaataaaataaattaaaataaaataaaataaaaataaattaaaaaaaacaaaaagacgttctatggacatatacttttgttttcttgggtaaacacacaggagtgttttgatatatgtatgtttcacttagggtacacatagggtaaacacataggagtaacacatagggtaaacacataggagtcatttggtatatgtatgtttcactttttaagacactggcaatgtgattgtatgttttatgttcttaccagcagcatatgaaaattccagttcgtctacttcctcacttagtccaggtataggcagtcttttgttttgttttgttttgttttgagatggagtttcgctcttgttgcccaggctggaatgcaatggcgggatctcggctcaccacagtctccgcctcccaggttcaagcgattctccataggcagtcttttaaattttagccattctattaggtctgttgcattatctcattgtagttttaatgttaatttccccaatgattaatgattttgagtgcttttttcatttgctgtccatatattttctttggtgaagtctttgttcaaatattgggactgtttaaaaatttcctttctaattatttagatgggagggtttatatacagtcttatattgcttaatggtggggatactttctgagaaatgtgtcattttgtgatttcatccttgtgggaacatcctagagtgaacttacacgaacctagatggcatagcctactatacacctaggctgcatggtatggcctgttgctcctaggctaccaacctcaatagcatgttactgtactgaataccataggcaattataacacaatgataagtatttgtgtatctaaacatatctaggccaggctcggtggctcagatctgcaatcccagcactttgggaggctaaggcagataaatcacttgaggccaggagttcaagacaagcctggccaacatgatgaaaccctgtctctagctgggcgtggtggtgcatgcctgtaatcccagctactcgagaggctgtggcatgagaatcgcttgaatctgggaggcagaggttgcagtgagccaagatcatgccactacactccagcctgggtgacatagcgagactctgtctcaaaaataaataaacatatctaaatatagaaaaggtacagtaaaaatatgatataatcttatgagaccactgactgtctgcaatctgtccttgacttaaatgttatgtagcataggactatatataaaatatatatatacacacacatatatagtataaatatgtatatactaataaataaatccatatatattgccttttcattctcttaaagtgtctttcaaaagcagaaacttttaattttgatgaagtctagatcaaatttttgcttttataaatcactattgtgtgttttatatcttttttttttttttttttttttttttttagagttttgttcttgtcactcaggctggagtgtaaaggcgtgttctcggctcactgcaacctccacctcccgggttcaagtgattctcctgcctcagcctcccagatagttgggattacaggtgcccgccaccatgcctggctaatttttttttgtatttttagtagagatggggtttctccatgttggccaggctggtctcaaactcctgacctcagggatccacccgcctcagcctcccaaagtgctgggattacaggtgtgagctaccacacctgacctgtgtgttttatatgtaagaaatttttgcccaatcctagaccaaaaagattttctattttcttccagaagtttcatatgtttaggttttacatttttgtctgctatccatcttccttaatttttctatatggtacaaggtatgaattgaagtctatttttagtttgtttatttatttatttatttatttgagacgaagtctcgctctgtcgcccaggcttggactgcagttgtgtgatcacggctcactgcaacctccacctcccgggttcaagcaattcccctgcctcagcctcccgagtagctgggattacaggcacccaccaccatgcctggctaattttttgtatttttagtagagatgggatttcaccatcttggccaggctggtcttgaactcttgaccttgtgatccacctgccttggcctcccaaagtgctggtattatagtcatgagccaccttgcctggcctgaagtctatttttaaaaacgtatggttttccaattactccagcactattttgtttttttttttttgggatggaatttccctcttgttgcccaggctggagtggaatggtgcgatctcagctcactgcaacctctgcctcccaggttcgagtgattctcttgcctcagcctcccaagtagctgggattgattataggcgcccgccaccacacccagctaatttttttgtatttttagtagagacagggtttcaccatgttggccaggctggtcttgaaatcctgatcttgctgggtgtggtggctcacgcctgtaaaatcccagcactttgggaggccaaggcgggcagatcacaaggtcaggagatcgagaccatcctgcctaacacagtgaaaccccatcactactaaaagtacaaaaaattagctgggcgtcgtggcgggcgcctatagtcccaactactctggaggctgaggcaggagaatggcgtgaacccgggaggcggagcttgcagtgagccgagactgtgccactgcactccagcctgggcgacagagcgagactctgtctcaaaaaaaaagaaagaatcctgacctcagatgatctgcctgcctcggccctgcaaagtgttgggattacaggcgtgagccactgtgcccagccagcactatttgttaaaaaatgttttttctactctgaattgcctttgtacctttgccaaaaatcaagtgaccaaataaatcagtatatttctgggctctaacatgttacattaatctattttattcatcaatcttaatgtcaatttcaaaatatcttgattactgtagatttataataactcttgaattcaagtaatgtatgtcttctaacttggttcttctctgtcagttgttggttgggcgtggtggctcaggcttgtaatttcagtgctttgggaggccaaggtgccaggatttcttgagcccaggagtttgagaccacccttggccacacaaagagacccacctctgcaaaaaatgaaaaaaattagcctggtgtggtggcatgcacctgtagtcccagctgctcaggaggctgaggcaggaaaatcccttgagcccaggaatttgaagctgcaatgaggtatgattgtgccactatgctccagcctgggtgacagaatgagactctgtcaaaaaaaagagttgtttgggctagtctaggtttttgggtgctttttattgtttttttgtcttgcatttccatataaatgttaaaatcagcttgtcaaattctacagaaaagcctgctgaactattgattgcaattacattgaatttgggagagatttgacattttgtcaatattgagctttctcacccatgaagattatatatctcttcatttatttagatctcctttaataatttatcttgcagtgttttgtagtgtcttttctttttcttttttcctcttttttttttttttttttttttgagatggagtctcgctctgtcacccatgctggagtgcagtggcatgatcttggctcactgcaacctctgcctcctgggttcaagcgattctcctgcctcagcctcccgagtagctgggattacaggcacacgccaccacgcctggctcattttgtatttttttagtagagatggggtttcaccatattgatcaggctggtcttgaactcctgaccttgtgatccacccccttcagcctcccaaagtgctgggattacaggcgtgagccaccgtgtccggactttttttcttcttttttgagacagggtcttgctctgtcacccaggctggagcgcatggcccactgcagactcgacctcctgggctcaagtgatccccctgcctcagcctcccaagtagctgagactacaggggcctgtgaacatgcgtggctaacttttaatttttttttttttttgaaacggagttttgcttttgttgcccaggctggagtgcaatggcgtggtcttggctcaccgcaacctccgcctcccgagttcaggtgattctcctgcctcagcctcccgagtagctgggattacaggcatgtgccaccatgcctggctaaagttgtattttttttttttagtagagacggggtttctccatgttagtcaggctggtctcgaactcctgacctcaggtgatccgcccacctcagcctcccaaagtgctgggattacagatgtgagctactgcacccggccagtttttgtatttttttgtagagatatggttttgccattttgcccaggctggtctcaaactaggctcaagcaatctgcccacctcggcctctcaaagtgctgcgattacaggcttgagccacggcgcccagccatgttttgcagtttctagtgtacaggtcttgaacatcttttgtcagacttattcctaaagtatttcatattttttgatgctactgtaaagagtgcttaaatttcaatttctgattatttgccattagtgtacagaagtacagttaattttttttttttttttgagatggagtctcgctctgtcacccaggctggagtgcagtggcctgatctcggttcactgcaacctccgcctcctgggttcaagcaattctctgcctcagcctcccgagtagctgggattacaggtgcccgccatcacacctggctaacttttttatttttagtagagacggggtttcaccatcttggccaggctggtcttgaactcctgacctcgtgatccacctgcctcggcctcccaaagtattgggattacaggcatgagccactgtgcccggccaattggggtctccctctttcacccagactggacgggatttcgccatgttgcccaggctggtcttgaactcatgggctcaagcaatctacctgccttggccccctaaagtactgagattacaggtgtgagacactaagcccagccaaatacaagtaattttcgtattttgatttggtatcctgaaactttgctaaatttgcttatttccggtagctgttctgtgaattccactgaattttatacatagaagagcatgtcatctgtgaataaagacagtttatcattttctttcattctaggagcctattatttcttttttttttgtcttattgcactggttagagcctccagcataatgctgtgtagaagtggtgagagtagacatctttgctttattttttatcagagatggggaaagcagtcagtctttcaacattaagtataatgcttttggtagattttttaatgaataccctttataagattttaagtttccttctattcctgagaatttttgtcaggaataaacattcaattttgccaaatgcttcttctgtacctactgagatgatcacatggtttttctttttaagtttactattatgttgaattgcattgatttttctactagtaaactgaacaaattcttgggataaactaacttagccatgatatattatcttttaaaaatattgccagatgcaatctgctaaaattttattaagaatttttacatgtacattcataataacattagtcattgcttttctttctttgtaaagtctttgtctagttttggtatcagagtaatactgaccttctagaatgagttggaaagtattctttctcttcaattttctgggagaatttgtatagagtttctctcttcaatgtttggtagaattcccaagtgaagccacctagacatggagtttctttgttggaaagtttttaaaactttctttctggtaaatagctattctggttacctattttttcttaagtgagctttggcagtttatgtcttccaaggaatttgtccattttgtataagttgaattattggcataaagatgttcatagtagtccttattgtccttttattacctataaaatatgtattgatgccactcttctcattcctgatactgataatttgggtcttctctcttttttccttatcagtataattagaggtttcataattgtatttgttttctcaaaccaacttttggtttcatcgatctgctgtattgttttctgttttctgtcactgatatctactctgactttattattattattattattttgagacagggtctcactgtgtcacccaggctggagtgcagtggcacaatcatagctcattgcaactttgagctcctgggcgcaagtgctcttcctgtctcagcctcctgaatagctaggatgatgggcatgcaccaccatgtctggcttactttgatttttgatatttcctttcttttacttactttaggtttcatttggccttccttttcaagtttcttcttaagatgagagctctcatgtcaatgattgaaggctttttttttttcaaatatgaatgttcagcgctatgaatttcttcctaagttcaactttagttgcattccgcaaattttgaatattgtgtcttgcatgttcatttagttctaaatacttcctaagttcccttttcttttttttcactgttataataactttaatttatcttgcattttacagaagtctatgaactattttaaaaaagcacctccttaccccatatcacgtttctctgacaggtgttaaagtaggcaatgagtatgtcaacagcttgagcatcagcgtcttgcaaggacttcagaccaaccaaccactcgccaaaaatcttggcagcttttttatcttgtttttaatacaatggtatatccactctgatggcaaacctgtccagccacatctccacaacaagctttgcaaaatcagtgattagcaaattagttagctttggcacggagctgtgctcgcttgcccatgacagcctggaagccaattttgataatggcaacagaacatctagaatgacaagtttcgcactgtaggaaatagagtcgcatgtccttctgcaggattgtgtccggtgatcggcatgtgtgacaagtgacatactccttgatatatcttctcaagacattttctatctgtttctgttggaatcttcctttgattacaagttggttattaccatctatagaaccacttgtacccaattcagccaataaaaatgcaaggagatgtttgggttgacgatgtaatagtttacagatatctgtaaagttgacaaaagaagttttcttggttcctactcggacgacttgtggaggtttcatgacaaatttccttttctccccagcaaccatatctggattcttttccctcatgatgttgaacactcgattcagcagctcctcgtatgtgtagtctctttctgagcctgcccaagcagggcctgtctgattactgaatgagataccatcatcttttttgttgtcttcatcttctagagcttcatcctcatctgggaacttaacattcttctttttcttctttttattgccaagcataatgtcaaggtcatcctctggttcagttggttcttgaacatcactttcaatcttaagatcctttacaccttcttcagcttcatcaatatcaaatatctttttagcttcttcttcttctttttcttcttgctcatagtaggatcaaaaatcatctcgtccccagacatggctgcggctcgagtgggctcggcacggacgggaagtcagacgggtcagccccaggccccggcggcagcgctgcccctgccgatacctctcccacccctaagctcccttttcatttattctttgacacatgaggtatttagaagtgtatggcttagttttcaaataattggggattttgcagagatctttctgttgttgctttctaattcaattccattgtgatcagagaatatactttgtatgacttgaattctattaaacatatttgtactttttagtgcccagactatggtctatcctggtaaatgttttagatgcacatgtaaagaatatgtattcagttgttgttacatggggagttctataaatgtcaattaggtcaagttggttgatagttttgttcaaatcttctatatcttactgattttaggtccacttaatcctaccaattattgaaagaagggtgtcaaaatctccaactataattgtatacttgtttatttctctttgcaattttatcagcttctctacatgtgtttgcaagttctgttagtagggacataaacatttaggattgttatagcctcttgataaactgatcattttgtcaaaattaaatgaccctttttatccctagtaatattctttgctctgtaatctactttgtctgatactaatatagcccccagactttttttgatttgtgttaccatgatagatctatcttttatcctattactttttatctatttgtgtccttatatataaagctggtccctagtagttagaatagatttgcatcttgcctttttaaccagtcttatatcttcgccttttaattgtttagaccactttaatttaatattatgttgatatggttgggattatatattatttgttttctattcatcctacctgttctttattccctttttcctatttttcttcattgtcttggattaaattatttttatgattaaattatatctcctttgttggtttattagtataactctttgctgtattatttcagtgattgctaaggcatagagtagacatctttaacttatgacaatctatctttgagtaatataccactacacgtagaatataagaaatgtaaaacatgcttccttttctcccctcttgtcctttgtgcttttgttgtcctatatttctatatgtgttatatatatgtgttatatttacatttagtttccaaatagataatacattgtcttattttttgctttaaagagttggttatcttttaaagagatttaaataataagaaaaaactttatatttacccacatagttaccatctccactatacttcattcctttatgtagttgcagatttatatctggtagcattttccttctgcttgaaggattactgttagcatttcttgtagtgctggtctggtgatgataaattcttttggcttttgtatgtctaaaaagggtccctgttttgccttccgttttttcacagagattttggctgggtaaaggattttgtgttgccagtgattccctctccttccctcccttcaggacattaaaaaatgttgctccattgtcttgcaccttcatttgccatgctacacttgcattgtttctaaaacgaaatctgtcatactgttctttgtttttctgcatgtgatgttgttttgcctctatctgcttttatgattctctctttattactatttttaagcaattttattactctgagccttgatgtagtttcttccaagtttcttatgcttgaggtttggtgagtgatatggtttggttctgtgtccccacccaaaatttcatcctgaattgtaatccccataatcctcacgtgtcaagggtgggaccaggtggaataatcggatcatggggtggttcccccatcctgttctgatagggaatgagtctcatgagatctgatggttttataagtatctggcatttcccctgcttgtactccctccatcctgctgccctgtgaagaaagcgcctgcttctcctttgccttccaccatgatcgtaagtttcctgaggcctcctcagcagtgtgaaactgtgagtcaattaaacctctttacttctaaattacccagtctggggcagtttatagcagcttgagaatggactaatacagtgagcattgtgaatttgttggtttatcattttatcaaatttggaaaatttcatccattattacttgacatacgattctctcttccctcatttttcttctgtgggaactttagttacacatgtattaggccccttgtcccacagcttgctgatattctgttcatttctttttttaatatttttttctctgtgtgtttcattttggatagtttctatgaaaatgtcttcaaattcactaatcatttcttctgcaatgtgcaatctgacattaatcccatcctgtgtgtttttcatattagacattttagttttcatctctaaaagtttgatatggatcttttttataacttccatgtcttcaattacatgctcaaccttttctctagcttcttgatgataattataataatggctgcattaatacccttgtccacgaattctatcatttgtatcaaatctaggttagtttcaaattactaatcttacaaacacccctccccctgtttttttgtttcttttataagagacagggtcttgctctgttggccacacttcagtgcagcaatgtgatcatagctcactgcagccttgaatgtgtctaggtcaaaatgagatgtacccaagtgtaaaatatacactgaattttgaagatgtggtttcaaaaagtaaagaatatgaaatatctaatgaatttttatattgattgcatattataatgatagtactttgcatatatgtgttaagtaaaatgttatcaaaagaaatttcacctgtttcattttacttttttaaatgtggctggtagaatattttaaattacatatgttactcactttatatttctattagcagtccctagattttattatcaatcacagaaaatcctccttaatttccattttaatcaccctgttcgctgaacattattttctcagctcacttcctatgggactccacctctaataacttttccttcccactaaacttttaattcactgatgctattaccttttcactgaaccttctcccctcccctagggtcctcacagcctttcttacctagctaaaatgccatgttcaatcattaaaaaaacattttttttgagacaaggtctcactctgtcacccaggctcaagtgcggtggcgccatcacagctcatacagcctcaaactccagggctcaggtgatcttcccacctcagccacctaagtagtggggactacaggtgcatgccaccacatccggcttttttttctttttatctttttttttttttttttgagatggggtctcattatgttgccctggctggtcttaaactcttgggctcaagcaatctgcccgctttggcctcccaaagtactgggattacaggtgtgagccaccacgtctggccacaatcattttaatcactccctggcatatacctttaaatcccttatgcttctgcatgggtaatggacttatcaggaacatgactggctgatcttagagagcatgatgagtcaggagctgaagtttatacaaacgtgttgctgcacaatctagtggtgtactgtgatgacgtttcttttcttatatggtcttttttttttttcttccctattgttcattgttggcctgtatcacatctttaaattctcaaaactacttgcttggttaaatctacaaccctggttaaatccagatctctgactccttcatgcctgtatcagcacagcagactgcggctgatggaaacatatgaccagtttcacttcagattcttcctggttaatctcaggagaccctcagtgcagccctccctcataccacatgtgctcagtctgtctgctctccttctctcctgtaccagtggttttcaaactgcgatggcttaccaaggagaaaagagttgaagggaattagctaccagatcctcaacatctacatggggtttcctaaaattcacatcacaaagtttcttctctcactgtgcaaaacaaaggcaatctctcaccccctccaatctcagggtggccctgaggatctcaataccacctgggctaagccacagggcagttccctgtcacctctgatcaagacacagaaacatttaacatttctctgttctgagtatatttccattcaagggaagtcagcatttgacccacattgaagtgttttcagttcctatacattgtagagtagggtggtagatcactgacaattttcgttgaaagacccagacttttttttgtcaagaatgcatcactcttgggggagagtccaggagaacaaagagatgattagtgagaaatattggtgaggatattgattggtaaattattgactattaatgagaaaaagatttttttttagagttaattaaaaaaaaaattgagaccgggtctcactactttgcccaggctggtctcaaactcttaggctcaagagatcctccctcgttagtcttccaaagtgctaggattacaggcataagccactacgcctggccaaaaaaaaaaaatgactttttaaatgtatttaaacattagagaacctttttctctattctcatccttagggctatgttattagctaggaagaaaaaacctttttgaatagcaaatcagtgtaagttaataacaacaattcttccactgtaactggaatgatttctgagattaccagttttaaaaagatatattaaataaaagctatagataaaacttttatgtgatttctttcagattgggtgtactgtattaaataatatagttagtacctattttataaaattatatcatgaaatatttcacttacagtcaactttcataaagtgttaaatattatctacctcctattaaaaaatggttgctagtggccgggtgcagtggctcacgcctgtaatcccagcactttgggaggctgaggtgggtggatcacttgcgctcaggagttcaagaccagcctggccaacatggtgaaaccccatctctactaaacatacaaaaaattagctgggtttggtggcccatgcctgcagtcccagatactcaggaggctgaggcatgagagttgcttgaacctgggaggcagaggttgcagtgagatgagatcatgccactgaactccagcctgggttacagagcgagaccctgtctcaaaaaaacagaatttttttttagtcagctatgaagttttatttcattaaataaacagaaaaatgtaattatgatatataatgcaattaatggagttacttctgatttttatttaaaagctttactaaattattctcaaaagtagactatcagagatcttatatgcacacaaacataaatttaaattaactatttaaattacttaaaaatttgtaaataaacaatgggactaataaataatgcaattagaagtaattaacaataggactaactaaacatgtgtgagcaaaatatgacaatattttaataactttcttcttgtcctttgatacagcaatttgttttatctttttttaactctatattaggtatttaaattttgcaggttctattattatatattcttaagaaaaatacatattttaaaagaacataaatagtattattaaccagatattacctatatttaataaaaaattgcaataacatgtttccttctgtcctgtgatatggtaggtttttttttttaatcttctgttgcctttttcatgtttattttattatttttttattttttgagatggagtttctttcttgttgcccaggctggagtgcaatggcatgatcattcaagcaattctcctgcttcagcctcctgagtagctgggattacaggcatgcaccaccatgcctggctaattttgtatttttagtagagacgggatttcaccatgttagtcaggctggtcttgaactcctgacctcaggtgatctgcccgccttggcctcccaaagtgctgggattacaggcgtgagccactgcgcccggccgcctttttcaataatatttctctgaactgcctgcagcttttacgacatccttccttccttttatgcagtggtaaaactgaatacagtcaaatgtaaattcattttgacttgcagctctgctattatcaagtccgtattatagaagtttataaacagaatggaatttcccaggattttcccagcagcactttctgctgaatatgcagatagatgaggaaagtctagtgttttttttgaacaaagtatcaacaattttttgttttctgctttctgtagtttcactaaaatcttcatagaaataaggcaattgtttgaaactcaatttttcaaattaaagtaactaagagcaggaaaacattttgttgttgctataattcgactcatttcttaatatgttataggaggcatgatcataggtacagcctgatgagatgagttccaaagggctgtactgtgttgaacaatgtcacccccaacattaaaattcatgtccacctgcaacctgtgaatgtgaccttatttggaaataagggtctttgtagatgtaatcaagttaagatgaagtcatactggattagggtgggccataaatccaatataactgctgtccttaagagggaaattcagacagacagacagacagacagatagacacacacacggaagacgtgtgattccaggtgaggctggaaggagaaattggaatactgtagcttcaggtgaaggcatgccaaggactgccaggattacctgaagctaggatggaggcatgcaataggttcatccctagaacctcggagggagcacagtcctgctgacgccttgattgcagagtttccttctccagaactatgagaggataaatttgttgtgtcaagccacctgttttgtggtacttggttatggcagccctagcaacctattacaggggccaacatgtcagttctcaaatttcccccttttgtttgcccacaggacattatagcttcagcttgcgaatcaggaaatgtaacttcactcacttccatagtgccatcaagagaatgataaaatactgtgtgtttgttcatgtggtatgcccataccaattcagtggtcactgttcttaactgaacttaggtgtctttgggagaccaaaaaaaaaaacctcttctgatttagaaattcttccttgtctaatcccagaattgtgaaatccagcgtccacatgtgttttcgcaatcaccttttccgcaacgcccaggccaaagctgttttctgcatattgtgcaatgtgcgccattttggcgacttacctccctaatcaagtcgtatgtgtccttccttctgtccttaaaagaacacagtcatttagcgttccttttcagcgagatctgggtcatgctggtgatattgcagttgttctatttttcacgatctgaacttttagaaaatattgccacaatattcacaatgttaaaaattaaactagcactctctctggaataaggagtctggttccactctttggcgtttgactagcaacagcattgagccccacctctctgtctctctgtctgccccacacctgggcaagctgataagaaaggctgggtgttctctctgtgctgtggagagactcaaactacataagctcctcccaacgggggagccctcaccccgccccccaccccctaactgcaataaaactcagagccagtctctgttccctgctctctcaagccattctggatttacagagaggcctgctctgctttccccagagacttcaagtatgtaagtaatcaacctttccgttatctcttgaggtgtacttggcattatgagtcttaacatctgaactgaactttgggtggggcttatcctagttctccagagtggtcacagtaatcttcagacattgggtggggcgcaatggctcacgcctgtaatcccaggtaggaggatcacttgagcccaggagtttgagatcagcctgggcaacacagggagaccctgtctctgcaaaaaataaaaaattagctgggtgtggtggcacgtgcctgtggtcccagctactcaggaggctaaggtgggaggatcgcttgagcctgggaagttaaggctgcagtgagccatgattgtgccaatgccctccaatctgagtgacagagcaagatcctgtctcaaaaaaaaaaaaagcacaacggttaatctataggttaggtcaaacagactattaatacccacaattgcaactcaagttgtatacttaattcctgttacttgaagtgatgccacaatgggtgatccattatgttaaccacaaactactgttgccaacctcagtggtcaggaaaaatcagtgatagtgactcccaaaggcagagagtctatgctgtatccatttaacactataaatagcatggctttcagtctctagttttcagggccactgtataggttttgtattttctctccaacttctgcccccgttactgacaaccagaacgtttcatatccttgggagggatttgccaggacacagggctttcagagctaaaactggggcagtttcagtgagagacctcgagcaagaactgctcagatgaatcctatccaaattcctgacctacagaaaccatgagtgatgacagtaaattgctgttttgagcaactaagtttttggggtgattggttatgcagtacagacaattaaaacagcaacaaggccaggcgcagtggctctcacctgtaatcccagcactttgggaggacgaggtgggcagatcatgaggtcaggagttcaagaccagcctggccaacatggtgaaaccccatctctactaaaaatacaaaaattagcctggtgcagtggcgagtccctgtaatcccagctactcaggaggctaagacaggagaattgcttgaacccgggaggtggaggttgcagtgagctgagatcgcgccattgcactccagcctgggcaacagagcgagactctgtctcaaacaaaacaaaacaaaacataaaacagcaactcaaactggctacagcagagcctgtatcttttcttttaaactctagtctccctacagtcttctccgtctccttatgtgacaactctgctcttccaggtgctcaggtaaaaaccctggagtcatcttgactgcattttctcccacatccaatcattcaccaatcatattggctctaccttcaaaatagaccaagattctgacctcttctcatctccttcactgccatcaccctacttcaggccaccatcatcctttgcttagattgtttcgagtctcccaactacttttcctgcttcctccccacccccttcagtctcttcttatcacagtatccagagtgggtcatgttcacgtgtacgttggatcctgtccatccactgctcaaaccctctcaaggttatctgcctctgctatagtaaaagccaaagtccttgctttgacttctaaggccctccatgatctgctccccatgacttctctgtctttattcccctctactatcccccttggtcaatcttctctagccacatgagcttccttgctgttgcttgaatacagtaagcacactcctgtcttagggccattgtacttgctgttccctttgcctggaatgctgttccagcagatggctgcttgtcttgatctctcacttccttaagttaccttctcagagcagccttccctgcccagcctacctaaaatttcagctcctttgatcgactcttattcttcttccttgtcttattcccctcttagtactttccattacccagcatgctctatagtttacatatctgttttttgtttgtctccccactgaaatgaaagctctgtgaaggcaaggatttctgtcctttttattccctgttctatccctagagcctagagaactgtgcccaaaacatagcaaactcttaataaacattcactgttcaatgggtagtcatcatagtgattgacactgcatattgattttcaaatttagaatcagcacttaggaaaataacagaagataattatgattacagaacagtatgtaaatgctttcaaccttaaggatggtacagtatgatgacagaggtttggaggtgatcagggaaggagaggtgaaaagaagggaaaggacaccaatgtcttcatcttgcaaagtatcagaaacaagagactggctctgatggttagaaaatgaagtaaacttataagcacaaaattgaaagttgtaacttatggttgtaagcataactgatagaactagaaacaatgaattaacatgggagagagatggaagtgatgatatgaatcataactttgagttcatcaataatattggcaatgtctgcttttgtctgatttccctagaacacagagcccgaggcaaagcttaagtgcttacgcttttgtcgggaggtacagacccagctctgcgagagccaggggaaaaggaagagaggcagggaaggaatggcagcaagtacaaggtgatgaatgactgcactggccattgcttcatgaagagccacgaaaaaacagagccggtttctcagcaggtggctggctgctcagtcacaaaggacctctttggacaggctttatggaaatactgtgcctaggacagtcgctcaaaggcaggagggagagaaaatgcatctgcaagctcactttgtcttctttcttctgctggtcaaaatttgctggctggggcagttaacgccctcacacatccgagttgtgtcacctggcccctttggtagccactggggaagccagatctaggcatgtggcctgatggctcctgcggtggaaccacatgctcacactcagtcagtcaccactgggatgccctgggcagggcaggctgagtggctgggagatagctgagcctaagatatctaagcaagcacctgtgatgtatgcactgcagtgtccaaatgtgaaaaagcaagaaagggagatagaagcatatttttttctggagagaaggaggaaaccaccaggagaatacaaacagaaaaaaggtaaggtggttgtctctggaggtgggaaagaggttggagagcagaatgttgcatcttattattattagcattcctgcacaattttttaaatgcatggatacattgatagaaatcactttttaaaaactcaaaaactaggttttatcactcctctttcccaaattcttcaatggtgtcccattgcttttaggataattgaaacagattgagcaacactatttttctgtgggaatattagctcttagacactgcaagttaatattgttgttatttatatagcctaagtttgttctattaaaaatttactattcaggctgggtgcagtggctcttgcctgtaatcctagcactttgggaggccagggtgcgtggatcacttgagcccaggagttccagaatgggcctggtcaacatggcaagatcccatctctacaaaattttttttttaattagctgggcattgtggcaggtgcctgcagtccctgctacttgggaggctgaggtgggaggatcgcttgtgcttaggaggtcgagattgcaatgagctgtgattgcactattgcactccaacctgggcaacagagcaggactgtgtctcaaaaaaaaaaaaaaatcactattgaaatactcagtgaagtatcagtgattttgtagtaagcttccacaagtacaatatttaagggaaaaaaagtgcagctgctcattttgattttagggggtttcagttctgaactaaagtccctgaatatcaaggtcctgctggcctctcctggctcacagtgagtgacttcctctttctttctgctcaaaccatattggctccttttctgcttgttggacccctgagtctttcttccacttcaggcttttgcaccaggagctccctttatgcccatgactcctctcctcaacccatcctccaacacgcctagtccagtatttaccaagcttcaggtttacacctaacaccttcatgtttgccctttctgtgtaatgcgtactctattatttttcttatgatcttttttacattgacagcttttaaaacttaaatacatttattttacaaggaaattttatatgccaacgtaaatggaaagccaatttcactggccacaaataatgcaaaaccataaaatacagaataatgacaataatatatctgtgtaccactagtttctgtaacatactttgcaacaccctagtttaattactttttactcattgttgagttatttattagcttaaatattgctttgttttagggaagtcttctctaactgcttggactagaccaagctcctatgcagcacattcctggaccatgactgcataacatttgtgagctacgcagcactcatagttacatatttgtgtgattattttacagtgtttgccttgccaactggacttaagcttcatgagaacaggatttgtattaattttgctcccctcacatctgtgctgaccacagcgtgagcctattgttaatgcttaaaaaatacctacggaatgaataagtgaatacctgtatgaaattatcacctgagagcaaccaacttcctttgttttgcttccatgcccaccaatacgtcttctaactacaatgaagtttcctcaaattcctcttcttttttttagagacagggtctttcagtctgtcacccaggctggagtgcagtggctcaatcatagctcactgtaacctccaattcctgggctccaatgatccttctgcctcagcctcctaagtagctagaactacaggcacatatcaccatgcacaactaatttcttgaaaaatttttgtagcccaggagttccagaccagcctggtcaacatggcaagatcccatctctacactatattgcccaggctggtctcaaactcctgggctcaagcaatcctcctgcctcagcctcctgcatagctgggactacacatttgcatcactgtactcagctctgaaattatttttgaaagaaagcagggtaaatataagtaatgtatgaataaatgaatagatggatttcaggaagagggtggcctggagtggcaaatcatagttaccaaaatgactgcaacagtctctcccattccacgtgttctgcagagggactttgtcactcccacatcaagagacagaatctggccgggcacggtggctcatgcctgtaattccagcactttgggaggctgaagcaggcagatcacttgaggtcaggagttcgggaccagcctggccaacatggtgaaaccccatctctaccaaaaatacaaaaattagctgggcatggtggcacatgcctgtaagcccagctactcaagaggctgaggcacaagcatcgcttgaacccgggaagcggaggttgcagtgagctgagattgtgccactgcactccagcctgggtgatggagaactctgtctcaaaactaaataaattaaaaaagaaaaaaagacacagaatctaattccctccttttgaatatatattagtctaagtgactcacttgaaccaacaaatgtgacttccaaagctaatcagaaaggtcagtcagcttccacctttctcttagaacattcacggcctggctgtgcctctcaggacactccctcaccgggcccagccaccatgctgtgaagagccaagccacatgggaaagccacgtggcaggttttctggttgccagctccagctgagcccagtcttcaagccaccctagcccaggcaacagacatgtgagtggggcagccgccaggtgattcctgcccctagtcattccagttttcccaactgacaccctagatattgtggggcaaaaatagaccatccttgttgtactgtatctgaattcctgacccacagaatctgtgagcacagtaagataactattgtctacaccactaagttttgggggtggtttgttgtggagtaatagataaccagaacagaatttggtacctggaagtgggattctcccataacaaaaacccaaaacataagcgaaagcaatcagcttttgactagtcagcagaaagaagcttgtggaaataaaggaagatcaaccaaatgagaataaccaaaggctatttatttagagcttgctgtagcaagggagccagctgccattacttgcatttgggaagacactcaaaagcaggcgggagtgggaaagcttttagtggaaaaaagggaaggctttgggtatgccctattggaggctgctggcattgggaagctttagttaggctaactagaagtggggcatcctctttgactggttagactgcacatttggctttccctggttggctgtaagttggaagtggggacaaaaataaaaaaattagggaagctgtcagttattaatcaagtcttggtcatttggggccagttgttacagaggctattgtttggtttcctggattgttgctagagatagcagactgatttctagtaggcttgcttcttcggctggtttctctaaatcatgggctggttttctaggttggttgctgcagattgtgggtcagagttctattttttcatattttctggccattgtctgtatgtatattcagtctttcaggcttaaatggccttgagaagtttgttggtgaaagctggactgaccttgagaagactaccagtgaaggctggaaagatggggaggaagttatgactggagggtggaagaaaagtgacctcgttaaatgtagcaaaaggtttagcaacattgccacctacagtaacactgaaaatagaaaatatacctaatgaaccagtgggtttggccaaggatatttcctggcagacaatttaaagtgtcaatttgtttctacttatgatgaaatatggctggagaaagaggaactgtcagttttccagcacactttagaggaagtatggagggctcaaatcagtctttctagttagcaaagcattctgaaggtcctcagtgcaatggctgaattgggggcacattctgatactaaattcagtctcaatagcagctcacatccctcccacatagaaaatgtactctccctttcctgaaggtctacagagtcttatcctattactgcatcagttcaaagtccaagattttgccatcaaatcaggtgccagcgctgatgaggtttctcgggtacagcccctttagtatggtttctcgaaatctggaagacctgagggccaaagacacaagtggtgttttaagatccttgaaaggcctacttctgtctgaaagtgttcatgaggtaccatctgaaatctttctgaggtcttataacagtatttagagtcacatcggtggctgcatcttttctacgtgggagggatgtgagcggctattgctggcatgtgggctgtgacagattgcgcttttccaaagatgatggtgttgatgaaaagagtcaaactctgtaaaatagtaaaagaggtttattctgagccaaatatgagtgaccaaggcccgagacgctgtctcaagaggtcctgagaacatgtgcccaatgtggctgggttacagcttgattttatatattttagggggacagaagttacaggcagacatcaatcaatacatgtgaggtgtacattggtttgatccagaaaggtgagacaactcaaagcaggggcttccaggtcacagatggattcaacaactttctgactggcaattgctagagagagctaagttattatctaaagacttggagttggctgggcacagtggctcccgcctgtaatcccagcactttgggaggctgaggagggcagatcacttgaggtcaggagtttgagactagcatggcaaacatggtgaaaccctgtctctactaaaaatacaaaaattagccgggcatggtggcacatgcctgtaatcccagctactcgggagactgaggcaggagaatcagttgaacccgggaggcagaggttgcagtgagctgaggt

SEQ ID NO: 2671 - DNA, 438 bp, Homo sapiens
atggcagaagtagagcagaagaagaagcggaccttccgcaagttcacctaccgcggcgtggacctggaccagctgctggacatgtcctacgaacagctgatgcagctgtacagtgcgcgccagcggcggcggctgaaccggggcctgcggcggaagcggcactacctgctgaagcgcctgcgcaaggccaagaaggaggcgccgcccatggagaagccggaagtggtgaagacgcacctgagggacgtgatcatcctgcccgaggtggtgggcagcatggtgggcgtccacaacggcaagaccttcaaccaggtggaggtcaagcccgagatgattggccactacctgggcgagttctccatcacctacaagcccgtaaagcaatgccggtccggcatcggcgccacccactccttctgcttcatccctctcaagtag

SEQ ID NO: 2672 - DNA, 733 bp, Homo sapiens
gcccactgcgccagcgctgagcctgccagggctggggctggggatcaccttgggatgatggtgtcagtcccagggggcaggagatcgagtgtcctctgagctggcgactgggcctgtagaagggaaccggcatttgtggagtgtctactgagtgccaagctgcccccagggagctctgctgcccttgctggccctgcccttcccacaggtgagcagggctcctgtccaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaatacctcgtgttcctcctccctctattactgtttcaccagagctgtcttagctcaaatctgttgtgtttctgagtctagggtctgtacacttgtttataataaatgcaatcgtttggagctgctgccccctttcttcctggcctcggctgctggaattggaatcaggctgtactctttccatccatttgggcttct

SEQ ID NO: 2673 - DNA, 1768 bp, Homo sapiens
caaagacagaccatctgagcccagagcagagctgctggatgccatgagcgtagccctcagcttcctggtgttcccttagccacgtcctcgttaccaggccaaacgtgacaggtactgtgacacaccaacgacacaaaacaacttactaacgtaatctgctgctcatagtttattttccaccaaccagtgatcagctgtgagtgatgtggctgtgacctatagctggtgcttggcgattacaaacacccaccagctggtggagcaggcgcctccctgccaggatgatgcttcaggaactttctgggcacaaagtgcttcttggtggacaatttttaaaaacacacagagccacgtgggtcacctattgtcaccaagagaaaaaagaacctcaaaatcagtgacgcgacaggaagaattcggacctgttctttctgaggaagttcttatttttcctgtaactgtatgacggcatcacaccttcctcctgaacgtgggggccatagtcactgactccgccagcctcccaccagtgtgctggtgtaggaggagctgcagacgtcctcaagcagaagtcacttctgcgtcctcagtggtaactcctgtccctgctcaagtcctccgccctcccccgcagctgtcttttcccttcgaaaagcaggatgcttgccgccatggccgagttgaggctgtccacaccaggcacaacggggatcagcagcctcttgccaccagtgctctcggccagctgcagggactccaggctcacgccgtaggtctccccgccaatcaccacagctgccggcgcctctgtccagtccgagtcgtaactctgaacctcaacatgaggcagccaatcttgactggctccggtttctacatcttcctcttcctcatacttgtgaaacttcatcactcgttgatcacacacccagccatggtcactagctttattagacatctcagcctgggcataaaggccacagttgtcagccacatagacccgagtgtcagggggcaggtaattgggcacggtttcccattccagattattgataatgggcatccggaaatgtgcgcccatacccgcccggagcactttgggctcccaggcatccacacagcctggaaaataaaaaggaaacaatcaagatgttacaaatcttcccagaccaggggactgtggagtaagtctgatcaattttggatcaggagataaaccagttcttctatgatagctttcttgagggatgggaccttctgcctctctctgacagcatccagcacagcgactataggagtcactcctgctagtgctgaagatattttatgcatcccttcaacatctcccattcacacgtgccagacactgcgcagaagatgcaaagataatgaaagtccccaaccccaaggaacgcacagtgtagtggggtggtattaaacagatggctacagtatcagtaactgatgtaaaagaagcacccacacagtcatagaaaacccacggacaaagcagggcgatgaggaaaaccatctaaaagaccaccacactgagataaaggcccaggcagaggacagagctaggagaggaagcgggagagtggcgcagcctaaggactgcaagcatggtgagccggccaatcagcggtggcgctgtggcggcacaggagagaagctaaacaccttactgactgactgcgatcttcttcagtgaattcctgtgctcctttaactgtcttgtttctacaacctgtgcccatcttcctaccag

SEQ ID NO: 2674 - DNA, 1096 bp, Homo sapiens
ccagaagaacaggattacataataaagttatgcttatctgatgtgtactgggatttaatattcttgcttgtggtcagacatatcttaagtgttaaattgcttagaatatttgtgatttctgtataaggcattaaagaataggcatcagggactagttagaatttgaacaaaatgtatttataacactttttattgttggaaactcaacttttattctgggttaagcctctagataaaatcttaagtctgccaaactattattccccccaccttttctttccccaactatcaagaccattctaggaagtacgtcactctaccaaaaatgattgagttgtgttgggcctggggaaaaagtcgggcaaaaggagcctttcttgtggctgctgatagttaggttcatccaccaccgcactttgagctcgactagagtcgccatggggtttctgcagaggagacaaaagttacagaaacagtgaaaactatctgtaatgtggtatgtagttaaaaccctatcgaccatggcagatatggtaagtgcaggccaaacagctccaattccacgtcataaattagcactgtgtttgtacttttgacaaaacacagtataaatcaagatcagggcacagatcctgcagaattactgcccattaggttgtatggtaagtacatggagaggcaatatgaaagaaacataccatctgtctttgtggccccacagtgctcacatgttccacttcagctgtgccaataggtggtagcagattatttcgactcaggggcgtcggtgagggagaggagagcgagtcgggtgccactgggctgcagatcccaccaacaaacacgaaggtatgaaagcatgaagttataacaataccagcaaattgattagaaatcagataaatgaagcagatgagtttaatgtgcacagaaagctttaggctacctatgttttcaagtagagatctcaggatttttggaaaattagtttttaaaatagtgttttctgattttgttttgaagctctatactctgggtacacaacagaagctggccttttctctcccacagaactggaataaaacatttgtcccta

SEQ ID NO: 2675 - DNA, 2506 bp, Homo sapiens
gtctccagccagttactctcatgatagtactgctataaaactcattcttgtgtggtgttctgtgctatagattctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccgtgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctc

SEQ ID NO: 2676 - DNA, 409 bp, Homo sapiens
gacaggaaatggcactttaatagttggggccagggtgacaggaccaagatggggtcagtggcaggagccacccagaagccccgcagatgacggagctgagaacagggacttcacctccacgtgttgccatttcctcactggaaagtccttgggaggtggctgggctcagcctgagctcagggctcttcggtgggggttggggcaggggcagggcgggcacttgcaggtggcacaggcttcatcaaggcaggacacgggcttcatcaaggcaggagccacagcgcccgagccctggcaggggaggtaaggcccaggatggggcagggccgtgtgctcctggaacggacatccttctctgccagagacctgctccccaagccctgtccctcccaatccccaggcagcccac

SEQ ID NO: 2677 - DNA, 458 bp, Homo sapiens
gctgttacaaaggcgtttagtttattctcatcagtatcactgatattctcatggttcacatttgccaacgccgctcctctccttacagtagttaaatgtgcaatctcacttgggggcccagggaggggtgggggttggggaggcagatgagaggcagggaggacgagggccagaaacacaaacaaggatgtggatgtggatggtgaaatgacaccctgcatagggggatggggagttaaaaaagaaaaaaaactgccttcacatgaaaatctaaaacaacaacaaaaaaccacccactctgggcgagaacaaaaagagaggaatggtaaaagagaaaattctgcaaacaactgctaacaatggaagtggacccggccctgccctgccctgcccagcccccaggagctgggcccagccaaccagccaaggcctgggacacccttaaactatagccctgt

SEQ ID NO: 2678 - DNA, 1590 bp, Homo sapiens
aatggcagacgatattaatattgaagcaatgcttgaggctccttacaagtaggatgagaacaagttgagcagggccaacggccatgaagaacgtagcaaaaaaaggaaaaaaagcaagagcagaagtcgtagtcgtgaacgaaagagaagcaaaagtaaggaacggaagcaaagtacagatcgagaaaggaaaaagagcaaaagccgtgaaaggaagcgaagtcgaagcagagaggcgacggagccgctcaagaagtcgagattgaagatttagaggccgctacagaagtccttactgcggaccaaaatttaacagtgccatctgaggaaagactggattgccttatagtatcaaattaagcataggacgttcccgaagcaaaagtccactcagaaaagacaagagccctgtgagggaacctattgataatctaactcctgaggaaagagatgcaaggacagtcttctgtatgcagctggcggcaggaattcgaccaaaggatttggaagagtttttctctacagtaggaaaggctcgaggcgtgaggatgatttccgatagaaattcaagacattccaaaggaattgcttacgtggagttcgtgggtgttagttcagtgcctctaacaataggattaactggccaacgagttttaggagtgccaatcatagtacaggcatcacaggcagaaaaaaacagagctgcagccatggcaaacaatgtacaaaagggaagtgctggacctaagaggctttaggtggactcattacacttttaacataactgaagatacgcttcgtgggttctttgagcctttcggaaggattgaaagtatccagctgacgatagacagtgaaactggtcgatccaagggatatggatttattacattttctgattcagaatgtgccaaaaagtctttggaacaatttaatggatttgaactagcagggaggccaatgaaagttggtcatgttattgaacgtgctgatgcttcgagtactagttcatttttggacagtgatgaactggaaaggactagaattgatttgggaacaactggtcgtcttcagttagtggcaagacttgcagaggatacaggtttgcagattccaccagcagcacagcaagctctacaaatgagtggctctttggcatttggtgctgtggcagaattttcttttgttatggatttgcaaacaagactttcccagcagactgaagcttcagctttagctgcagctgcttctgttcagccacttgcaacacagtgtttccaactctctaacatgtttaaccctcaaacagaagaagttggatgggatacagagattaaggacgatgtgattgaggaatgtaataaacatggaggaattattcatatttatgttgacaaaaattcagctcagggcaatgtctatgtgaagtgctcatcaattgctgcagctattgctgctgtcaatgcattgcatggcaggtggtttgctggtaaaatgataacagcagcatatgtacctcttccaacttaccacaacctgtttcctgattctatgacagcaacacaactactggttccaagtagacgatga

SEQ ID NO: 2679 - DNA, 1169 bp, Homo sapiens
ccccaaccccctcaatccccctttctctcctcatccttttcccctctttctccctgcctctttttggttatgccaggcaatatctaatctgcattttagcaagtcattcctgacaaatggaaaggtgaatgctcttccacagttctccctggcaaggcaatttttcttgttagcatccttctgtacgctccattaccctttttcctttatgtataggttaagaggaaatgatgaggctctgatttatcaatgagaaatcatttacactgtaggacattcaaatcctttagtctcagacttaagatcagtttcactccaggtttctatgctctgtggaaatttcatcactggacagtgctttccttttaaggaggttgccctttttttgtgttctctcttctcttcctctcccagtaaccaccggagggcgagagagccagctagttatcaggatggaggcatcattttaggagctggaatcctgtttagttatataatgccctgcagtgctgtttggaaggagggaaacctgtagggatattttcccattgggacccagaggaaagaagtttcaaatatatcttttcaaagtaatttttcaccaaatctgagtttagaaaatttcaacaaactccttcctcttttggaaaagcggagaagcttttgaaatgtttctcttccatgtgttatcccctcatcatcagtctaattacctcttttgaaatactgctttatgctctcggccttagcgccatttttttggaaacctctgtgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagaacttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaa

SEQ ID NO: 2680 - DNA, 797 bp, Homo sapiens
ccaggtggacttgctgactgattagtttcatatactacttagtaacctcaagaagtagcaggaggatgccatgtatcaatcttgaacttcaagtctcactgcaacaaggatggagactccagcagagtgcagggtgggcacagacaggccacaagatggcgcagcacctccatacttgggctcttgacaaccaagtactgctgaagttgtagcaggaactactagtccttcactgaggcatgtagccgccttgccgtacagtctgtgtacctggaccaaaagcatctgctgcagaaacttcctgaaacattttcatttgcccagatccacaggattgtgaaatatgatctgaaatctgctgtttaagtctaacaaaatcttcctcattgactgatgaaacttgctttgacctttcaaaatgtgaaatatctggactggattcatgctgactgcagttctgtttgaagtactgttgcctgggcaaaataccatcaccgccatctacatgatctactaattgtagatcttctggccgctcctctgaatctaacaagggctgggtagactcggatcttgagaagacttggactgacggaacttggtgtctgtagccactgtgtaccacggtagaatactggacagtgctcgaagtgttttgtgaagattcattttcatcactgctagaaatgcttggcctagaagatgacatgcatgaagaccccccaataccactgctgtgtccttcagtattaattttttcctttttgaacaggtccaatgatttcagatcttctgga

SEQ ID NO: 2681 - DNA, 564 bp, Homo sapiens
gaagcttctcacatctttattggaaaggcacagctaagcccacccttgatacagcattttccacttctctctgtagagatcagacgattgaacacgagataagctgactatatacagacacaggtgtgggtgttgcttttttttaaaaacacttttgtctttttttttttttaatatcccctttcttaaaagacaagctagtatactggaaaaagaaaaaaataataataaaataaaaaccaagacaactttagtaccctcatctttatttgggaaggggagggggaatcctgggtcgcccaccctcaccctgctcctcccagctcagctaagctcgtccctcgtgcccccccttttgtgggcgatgggagaggaccaggtgggcgtggaggtgtctggaactagcagaggtggtgagtggggcaggtatccacctaaccaggctgcaggggaggaggagggaagccgggaatggggtaggaagaaagctagaggtggcctgcaagctgggctggggcccccgccggcggccaccataaatactatgggagtttagccaatccc

SEQ ID NO: 2682 - DNA, 1556 bp, Homo sapiens
gttgaataacagtaatgatgataatatctgagctttattaagtacttactacatgctaagagctttttaagcacttatttaatcctcattaacaaattcataaggtaggtgctattgatagtttagccataaccagatatggcttgttatttgtaagttatcatgaaaaggtttatattcactattctttatttcagtgtagcacttttagagccaaaaaaactcaggcacaaagaagttaaataacttgccgggtgcggtggctcacccctgtaatcccagcactttgggaggccaaagcaggcggatcacctgaggtcaggagtttgagaccagccgggccaacatggtgcaacctcgtctttactaaaaatacaaaaacaaaaattagccaggggtggtggtatgcacctgcagtcccagcaacatgggaggctgaacaggagaatcgcttgaacccgcgacagggaggttgtgatgagccaaggtcatgccactgcactccagcctgggagacagagcaagactccatctcaaaaacaaaaacaaaacaaaacaacaacaaaaaaagaagttaaataacttgtttaagatcacacagctagtgcagttaccccctctcagtaattatgtttggcaaatatgaaatacaaggatctggcaaggttaggaagaggttaagaatatcagtgacagtactctgaggcatctgggcatgtcagatgaagatttattattcagaaaagttaagtcagctgttgcagggatcagttgttttattcctggaaaatgtttttcattttgctgcaaatctatatctgacctgctgaggaaatcgtttggtgaaatgaatccagaaagcagagaaaatgcttcattactttaaatagcagcattaagcccattatagcctctgaattgtcccttccttgagtttgctaatgcttccaacttagtcatttgaagcccaagagtctaattttatatgccctgccaatgtcctcatctattgcagaatgtataattatctatttgttttggactatatgttacaaaaatttaaaacataagatcctctctctatatttcattattggtgaacccacattgtgctgtgttttgtgatattttatcattttctagattcttatgtggatctaataacgaccacttgaacccagtttcacagaatccttatttttctgttcaaattaggaattagggacatggatgaaattggaaatcttcattctcagtaaactatcgcaaggacaaaaaaccaaacaccacatgttctcactcatagataggaattgaacaatgagaacacatggagacaggaaggggaacatcacactctagggactgttgtggggtgaggggaggggtgagggatagcattaggagatatacctgatgctaaatgacgagttagtgggtgcagcacaccagcatggcacatgtatacgtatgtaactaacctgcacatcgtgcacatgtaccctaaaacttaaagtataataataataaaataaaaaaaaaggaattaggcaaaa

SEQ ID NO: 2683 - DNA, 2596 bp, Homo sapiens
gtataacaaaagttagtaatttagaaaggaggaacatgaagtaatatttttattccactttttcttctgcctttgtttttatgaagaactctggtttgtagatacaacgataggccaagagctgaggaagaactccatatgctatgtttaatgctaaaaaaaggatttttgcttcttcagggactctgtagacataagcagttctagcatgaagagatgcaccaatgtgagaaaactgagcctgttgcatttaaaaaaaaaaaattgagtaagcatgaaacgtgttcagttggatgcatgatgagttctgaatggttcattcaggctacgtttctgtgccctcaaaaccagtctcacctgcaggcaaaataccttcaaacaatccagagtctttaatgtcagagtctttcattaaatttagtccttgattaaatttagggccattcttgatatgactgttcaaataaagtagatattatttagtgtagttttatcatgccagttgtgttttttaaccatcaagtgccccttaccgaacattagtggctcaatctaatagaaaaatctgaataaaatctcaaatttttttctgatttgcgttctggagatcctgcatacagactcagttgtggttcacaaattgcgttccaataaaaatgaagaaagcgcagagttttaaaaaacaaatatttttagcataaactattgaaagggaagcactggggggacctcagcttcatttatcagtctttcatctactccttgcagcaagagctcataccctttccctatgtgttttttgtttattcatttattcatgtatttgttttttctgcagcttttaaaatattaagggttgtttgtaagataaggttgttaccaacttgggtggaggtaggagtacggttgctctttgtaaaatggcaaatgtacatgcaggcaacctttttaaatcaaattataatttatttagaagtacgacatgtcagcattatccgcatttgcaaaatggcctccctctctacttatatacttattcagaaaacacattcagaatgtgccaattggtcttttttgatatttttcgcaagcacagaggaaaaccgtattggaaagggtaaaacagaccacagcaggattaaaagctcctgtcagaaaatttcctcagaaggcttgtatcattacaaaatgtacccctggagtctgcattttcatatcttgctgaaattcaagatacacatgaataaaggattgggaatctaaatgtaataagtagtaaattatcagttcatcaggatcaaagagacaaaagactgcactatagagaaggcatagaagtaacaagaatgaagaactagataatttgctttaaatacatataagttattttacatttcttccatatgaaaccaatttattctgctgagtgatttcacagataaaggtgttacttacttgacttcaccatgacaagaaaaggacaagtttttttaagcagcatctttatgaattttttatcagtggcagatattttaatgggctgcatttttacaaattcctgatatattctggagacctgtggtacatttttgctactctggagatataaattaaattagcatgatgtattgccaaggaccagcacgtggattgtctacattgtgatccatgaggcactgagaggactcggccctcagatacaactcccctgggtagatgcccaggcagaacccagcaaatgtatatgcatctctgggctctgaggacaaaatgccttgagagtaaagggcactttcagggctgccctgaggaggtgctttctggacattctaggaactctgagcaggagcatggctcccatactgtttttccttagggcctgttttgaataatagtgtttttctgaatatataaccaagcattttctctggactggaagccacatttgatccctggttctcagaaatctgggtttggtggttctgtctttatagatacttgtacacatcacaaaatcaccaaatttggggaaatgccaaccatactttgagagaataaatatgagcagttgtgcctacttgcataggggagcctgtgtaaaaagtcagtgattccgtaggctcttttcctgcactaaccagtgcagttaatacctcactttcatgaacagcaaactcatggcaacattaagtgaatcatggccgggcgcagtggctcacgcctgtaatcccagtactttgggaggccaaggcgggtggatcacctgaggtcaggagttcaagacgagcctggccaacatagtgaaaccccatctctactaaaaaatacaaaaaattagccgggcgtggtggcagacgcctgtaatctcagctgctcgggaggctgaggcaggagaattgcttgaacccggggagtggaggttgcagtgagccaagattgtgccactgcactccagcctgggtgacagagtgagactctgtctttaaaaaaaaaaaaagattcatgtccttagattagattgtaagcccactgggcaggtactgtgtctaatgttttgtgtggcacctgtcacattgttagagctcaataaacgttc

SEQ ID NO: 2684 - DNA, 6006 bp, Homo sapiens
ggcgtgtgtgcgcgatgtgagcagggggtgccggcggggctgcagcggaggcactctggaagaatgactctggagtccatcatggcgtgctgcctgagcgaggaggccaaggaagcccggcggatcaacgacgagatcgagcggcagctccgcagggacaagcgggatgcccgccgggagctcaagctgctgctgctccggacaggagagagtggcaagagtacctttatcaagcagctgagaatcatccatgggtcaggatactctgatgaagataaaaggggcttcaccaagctggtgtatcggaacatcttcacggccatgcaggccatgatcagagccatagactcactcaagatcccatacaagtatgagcacatacaagtatgagctcatgcacaattagttcgagaagttgatgtggagaaggggtctgcttttgagaatccatatgtagatgcaataaagagtttatggaatgatcctggaatccaggaatgctatgatagacgacgagaatatcaattatctgactctaccaaatactatcttaatgacttggaccacgtagctgaccctggctacgcaacaagatgtgcttagagttcgagtccccaccacagggatcgtcgaatacccctttgacttacaaagtgtcattttcagaatgttcgatgtagggggccaaaggtcagagagaagaaaatggatacactgctttgaaaatgtcacctctatcatgtttctagtagcgcttagtgaatatgatcgagttctcgtggagtcagacaatgagaaccgaatggaggaaagcaaggctctctttagtacaattatcacgtatccctggttccagaactcctcggttattctgttgttaaacaagaaagatcttccagaggagaaaatcatgtattcccatctagtcgactacttcccagaatatgatggaccccagagagatgcccaggcagcccgagaattcattctgaagatgttcgtggacctgaacccagtgaccaaattatctactcccacttcacatgcgccacagacaccgagaatatccgctttgtgtttgctgccgtcaaggacaccatcctccagttgaacctgaaggattacaatctggtctagttgtgcctcctagacacccgccctgcccttccatggtgggctattgaagatacacaagagggactgtatttctgtggaaaacaatttgcataatactaatttattgccgtcctggactctgtgtgagcgtgtccacagagtttgtagtaaacattatgattttatttaaactattcagaggaaaaacagaggatgctgaagtacagtcccagcacatttcctctctatcttttttttaggcaaaaccttgtgactcggtgtattttaaattctcagtcatgcactcacaaagataagacttgtttctttctctctctctctttctctctttttcttttctatggagcaaaacaaagctgatttcccttttttcccccctaattcatacctccctcctgatttttttcccatgttacaatggcctttatcctagttccattcttggtcaagtttttctctcaaatgttacagtcaggacacatcgttcgatgtaagccatcatcagctttatataagtttgtagtttttgctgaaggattatatgtattaatactatggttttaaatgtgttgctctggatacacacatggtttcttttttaatagaatatactgtcttgtctcactttggactgggacaatggatgcccgtctaacagttaagtgtcatttcttttagatgtttaccttcagccatagcttgattgctcagagaaatatgcagaaggcaggatcaaagacacgcaggagtcctttcttttgaaatgccacgtgccattgtctttcctcccttctttgcttctttttcttaccctctctttcaattgcagatgccaaaaaagatgccaacacacactacattaccctaatggctgctacccagaaactttttagaggttgttcttaattttttattgttgttgtttgagcttttcctttctttttttttccttagtgtttgggccacaattttaaaatgacttttattatgggtatgtgttgccaaagctggctttttgtcaaataaaatgaataagaacttaaaaaataaaagctggtatcttaaaatgtaagagagtaagactgtgaagcctaaaatgactggctgagaatgaaccagaaatgccaattgccaaacagttggaactgtaaatttgattctcacggtccattcttttctttgtccttaagatgacgttgttagtgttcacgtcccatgttcagtgtccaaaccggcaatgtaaaaagtatcttgtgaggtttaacaggaaatctgtttatgtctctttatttgaaaccagttttactctcaatggttctttaagttcaattaagtctgccaggaacattggttgatagtattattctgacacctttaatttcctaaatctgaagttcctgctagtttaccaccttcaagatcttcttgaactggtaactgattaggttgaacttacggaagatttgtggacttaaaagtaacctctcagtgttctatagaacatgtatttgtgtaactgaacctaccaagagaaatgtttggaattctatatgtgcaatttttcaacaaatgcaaaaaaaatacagcacatgtattgacaagcttctgtcaagcagcttgagttgaaatttgatttaagaaaataaatcatgattgtttaaagctgctgggacgtcagaattaggccatgatactggtctcattttaactatagtgctatttggcactagtctaaacttccatataaatcactgttttggaacaacaaaatggggagggagaaaaatcacggcctgttagatgagtaccaaaaccaccaaacagtaatgagatgttctcatccttgattctcccagcctcaaacaacacaggttacttttttttccccttgctcagaaagcacctgtaatttaacaaacagactgcctgcaggtatagtgcaattacaaatgctctaatcattgtacgtacatctctcttgatattgcagcatccatactggctttgtaatcattaattttttggcagattgaatgtgctgtatcgatatgtatctatgtaattgtatgtctatagctaattcacattttgaataatgttattttatttacttttttaagagaggagaatgtaaatttgtcagtttatttctgactagggatattttctttctatttagaaaagaagaaaaaaaaaccttactgtcatacagaacggtactagcgtcatgctgtataaaatcatttgcacattcctgagtagaggtatactgattataagatccaaaggtaatttcatagcaaaatacataaaatcagtcggagcttttatacaaacatggaaaccaacttagtggcacttttgctgtttgatctaggattggaatatgagcttttatacaattcatattcttatttggcaaatgcacagtttagtattacctctctgatggcctttactagaaaggcagttttagaagctattgtgatccactaaggaaatgttttaacagctagagaccactgcttgcctgaaagggcgttcttaaatttggtgcatcaaaaaaaaaaaaaaattaaacaacaacatttgaaggcctacagtgtgtatagagaaaacctcatcacaagatcataagtgtcacggttttagggaatcaagatattctatttaatagagctatagtagatgtagtcaattaaacctgatctcaaagcttgaagaagctgagcaaaacagggaaagattgttatattggtcattatgaaattgggatggaatttgctatgcagaattgaggtttgtggcttcactgttcctgtagggtgcatgacaagatcccttctcttgaggaaggacaaaattgatcaccctagcagcagtgatgcatagaaacctaattttagccacaccagtcaatcgaagctaaaggattttcttttttgtttctttggggttttattgaaggggctaggggcgggatgggattctcttcagttttgtataaaaacaaagtttactcatgctttatattatattgtgattgcaggcgttataagcgtgtgccactggcctcctattgttgatgcttaggtaatggaggcctgtggtgagttttatggtgacttgggcatgtcttattgaaaaacaaaaacataaaacacagaaacctttcgtctgcataccaaggcaagcagccatttcatgactgacttaacacattgcagtgtagcagtttacagatgatttttccctttttgcatgacatggcagttctaacccccagagaattccttatttgtaaattggaagtttctactatgccttacagagcttaaattcagaagtttgtgcctcatatctgaaacaaagggaaataacacacccattcaaaagtaaataaatctcctagaagttcttgtttttaacatttccatataaaaagccctgttgaatgtcatgaatagactggaaaaaaaatttttaggaacctgcatatgttgtttactagcagatgacaactacaaaaggaatttgaagaacacgtgaaacttgttttttttttggtagattaactagcaggcctattttaaaaaggtaattcagctaaagggcaatttacttttttgtacttcagactatcttgattgtcaaagtgtacgaactgtaattttaaaatttatactgccacatgattgtaaattttagttgtcttaagttaggaattggtgaaaagctatttatgctggatttgggtcaaaatgacttatttgcaaaaaaaaataaataatgggaagaaagggctgcataatgacagaaaaaaaaaaagcttcatcacatactgaggactttccaagtcacctggtacatgataagtgcttgacatagggtagctgttacaattgttgtcgatattagtatattacagcaaaaaacttgctttaattctcacattagctgaacagcataaagggtgagatgatttggtagtcatgctgacaaattgctttccagcagtgggaagggaggctgcaggaacagcagagaacaattcgggacaagaagaaaacagcagggtgcaccagacgtagtaatcccctaaaaccaaagggaaagccgcccgctcccacgcagtaaaactaggagtatccaggaatgaacaaacccgaaaagaacgtgagctgttttccaaaacggagacctcctcagaggatgaggccgggcatttcctgggacagcctgtgttaagaccacgtgccccttgccctaacaactcactgtagtactcttcatagacacatcttgcagcatttctcttaatactatgcttgtttttctttctaagccaccacaagccatagtgataggtttgccctttggtacaaaaggtgcattaaaactggtggaaaaggcttactgcattctggataacctgtgtgcatactttatgaaatctcttgtgtggggaaaaaaatgctttttacaatttgacctaattatatgcattgtaaaataaacaccattatttcaaacaaaacacctatctttttacaatatgttttatttctgtttgaattctgttgttacaatgttagtgttttaaaatgtgatggaaaatataatgcttctaaggaggaaagccagtggaatgaatgtttaaaagatcttcatgtgtttacggtctgcagaaggatttttgtgatgagaggggatttttgaaaaatctagagaagtagcatatggaaaattataatgtgtttgtgtgtatatgtgtgtgtgtgttttacaaagatttctgctctgtttttagccagaaactctaaaaactaaaataataacaaagaaaaataaataaaagagagacagaag

SEQ ID NO: 2685 - DNA, 964 bp, Homo sapiens
cccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccct

SEQ ID NO: 2686 - DNA, 474 bp, Homo sapiens
acgaaggtcgagctgtgcagttttagtgggtacaagatctacccgggacaggggaggcactacgccaggaccgacgggaaggttttcgagtttcttaatgcgaaatgcgagtcggcattcctttccaagaggaatccttggcagataaactggactgtcctccacagaaggaagcacaaaaagggagagtcggaagaaattcaaaagaaaagaacccacccagcagtcaaattccagagggccattactggtgcatctcttgctgatataatggccaagaggaatcagaaaccttaagttagaaaggctcaacgagaacaagctatcagggctgctaaggaagcaaaaaaggctaagcaagcatctaaaaagactgcaatggctactgctaaggcacctacaaaggcagcacctaagcaaaagattgtgaagcctgtgaaagtttcagctccccaagttggtggaaaacgctaa

SEQ ID NO: 2687 - DNA, 2608 bp, Homo sapiens
tctaaattttatgtctggtaatggacttgtatatgtaaagaactcttataattgaataataaaagggcaaatagcccaactgaagagggcaaaggatctgaataggcatttctgcaaaacacatgaaaagaagctcaacatcattagccatcagggaaatgatttcacttaatgcccacaaggatggctataatcagaacgagaagacagtaacaagtgttcacaaggatatggagaaatgggaacgttggaactgtcatatgttgctgtgagaatgtaaaatggtgcagccgttttggaaaatagcctggcatttcttcaaggttaaatgtagaattaacacgtgactcagcagttccatttctgggtttatacccaagagaaatgaaaatatatgtccacagaaaaacttgtacatggatgttcatagcagcagcatccataatagcctcaagtagaagcaactcaaatgtctgtcaactgatgaacagatgacaaaacatggtacaatggaatattactcagcaatgaaaaggaatgctttatatgttacaacatgattggaccctaaaaacatgccaaaaggctgtgtattatatgactccattgataggaaaggaatggtttacatgttacaacatgattgaaccttaaaaacatgccacaaactgtgtatgactccattgatatgagaggaatggtttacatgttacaacatgattgaaccctaaaaacatgtattatatgactccatttatatgaaatgtctcaaagaggcagattcatagaaagactagtggttgccaaggtcttcattttttaggggtgcactaatggatgtaggatttctttttagagtgattaaaatgttacaaaattgctggctgggtgcagtggcttatgcccataatcacagcacttcgggaggctgaagtgggaagatccaggagttgaagaccagcctgggcaacatagtgagaaaatgtctccctaaaaggaagaattaacctcatgtggtggtgtgcacctgtagttctagctactagggaggctgaggaggaaggattgcttatcccgggaattcaaggttgcagtgagctatgattgcacccactgtacctcatcctgagagagagagcaagaccctgtctctaaaagaaaaataaatgttctgaaattgattatgttgacggtcacataactgaatatattaaaaacttaaattgtatactttaagttggtgattgtatgatatatgagttttatcaatacagctacttaaaaacctatagttatgcaaattaaaaatttcatttactggggataattgaaatgattataccgaacataatacatgtagaaacagtatagtttttgtattgctggatagtctgtttttttctttttcaatatttgaaactaaaggtcatgtaattgatgtttttcttacataactgtgaaatatttattctctgttgaaatgttttatcttacgttttctcctttaggaatgttacgttcataacttactaaggattagtgtatattttccaaccttgaggcatgaaattctggagcttattattgaaaaactactcaagctggatgtgaatgcatcccggcagggtattgaagatgctgaagaaacagcaaatcaaacttgtggtgggacagattccacggaaggattgtttaatatgggattcgcagaggcatttttggaacatctttggaaaaacttgcaggatccaagtaatcctgccatcatcaggcaggctgctggaaattatattggaagctttttggcaagagctaaatttatttctcttattactgtaaaaccatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtttgcagtatcctcagagtctgaattttgagcggatagtgatgagccagctaaatcccctgaagatttgcctgccctcagtggttaacttttttgctgcaatcacaaagatgaagacttgtggatatggatggtggtgatggttgcacaacaatatcaatttattttataccactgaaccgtgcacttcaaaatggttaagatggtaagttttatgttgtgtattttaccataataaaaaaaattgtagagggaaaaacagtctgcctccacttttgatatgggactgctaacatcttccaccctccctctccccctctgccccacatctgggcaagctaagaaagcctgctgctctctcctctggcaccagctggaaattcatacccaacaagccctagccctcccaccagacccacatttcatccccatccccatcgcatccccatccccatccccatccctaaccaccataaatgctaagggagtttccttgcctggttttctgaaaccatttttggacctgcttgggaatctgccctgctctctcagaaagcttcattatatgagcaataaaccttttcctaccctc

SEQ ID NO: 2688 - DNA, 2075 bp, Homo sapiens
gttcaacccctttttgaccctgcttctagaacacaggtttttctttccttgcttcctgatttttggggggcatccaagagtctctctagttgcatcctcacttcccccaacccggagttcaagggtcaaggtttgcaaggcactattcctggagacagggacagctctctgagcaagaggagggatttaccataaacttgagcaacccagaagctcactgaaaagaacaaaaaaactcgtcttgatttcatggctggtctcaaactcctgggctcaaggaatcttctcagtctctcaaagtgctggggttatagacgtgagccactgcactccgtcagtcttgtgccctgcccagtctccggagcccagccgttagttggtcttaatcaacatggactgagaggaaggaaggcttgtgaaatgtagtgacacagtaacaaaacgatccattaaaatgaaatgagatcacatccctgcttaaaactctctgatggcttcttgtcccacttaaaacaaaattcataaggctggccaggcgcagtggctcacgcctgtaatcccagcattttgggaggccgaggcaagcggatcacctgagttcaggagttcgagaccagcctgaccaatatgatgaaaccccgtctgtactaaaaatacaaaaattagcggggcgtggtggcgggtgcctgtagtcccagctactggagaggctgagacaggagaattgcttgcacccaggaggcataggttgcagtgagccgagatcgcgccactatactccagcctgggtgacaaagtgagactctgtctcaaaaaaagaaaaagaaaaagaaaaagaaactggctcctatgcagatgaagatggggaccccgaagtctccatgtttccacactcagctccccagatttgttttgacccagccttttttttttttttttttttgagacagcgtctcgctctgtcacccaggctgtagtgcagtggtgtgatctcagctcactgcaacctctgactctcagattcaagctattcttctgcctcagtcggccgagtagctggaattacaggaacccgccaccaagcctggctgattttttgtatttttagtagagacggggttttgccatgttggccaggctagtctcgaactcttgacctcaagtgatctgcacacctcggcctcccaaagtgccgggattacaggcgtgagccaccgcgcccggcctggccttgacttttgagggtgcccccacccgtgccacccccaggaggcagagcagagccagagtcatgggggccggtggttgtaaacagagttttattgatggggagggggctgggggaggcaaactccagagagggcagaggacccagccagccacgtggcatgcatggtcagctggaggtcagaggggggaggtcacaaggggacgggtggcatgggactctctcaccaccctggggccgtatttacagaggggccccacccaccttcgccgccccccaggcccccaagccctttagacagctgctgccgatgtgacttccgggcaggccctcctcgtgtctcctgcctgaaaccccggcattgtccccgcttccctctgcagagtggggggggttcaaactcctaaccggcacctcggagacccccgggccttctggaagccccagcgtcggctcagccaacgcccaggccgctggggccaccacgatcgtcgctcgtggacacacaccctgcacgcgtggcccacttgacacacacgcccacagcagccttcgctggcacgcacacacacgcccacctccccggccccttgcacacgaacacggcacgcacacgcacgcacacccacacacgccaggggcctgggttggggagggacctttccaggggtgggggagggcttaggtctgcagctgtggccccccattccccaccggcgtccaagcctcccctgcctgccgccaccccgagaacggagttgtgcaattggttagaaaaccgcaaaagaaaccaaaactgcaaaaaaaaccaaaacctacgcgcataaggtcaacctcaaatccatag
